United States Patent 11,242,544 (MICROBIOMES AND METHODS FOR PRODUCING MEDIUM-CHAIN FATTY ACIDS FROM ORGANIC SUBSTRATES) - sequence listing, part 10

SEQ ID NO: 673 - DNA, 17861 bp, Unknown
  Metagenome-assembled genome
tggtagttggttttgatgaacggacaggaaatgcccgttttttgttcaataataatatacaaaaaaatctgtcattaataatagattaaatctattaccaacaacagatattgtacagcctcttttttgaggattaagtgatatttattagaatgaatgaatttatcaaggctaccaaaagtgaaccgatatcattaagatgacgaatttgagctgcttattcactctctttccaatttacgggttgctcgtggtaaaattagattcagagaattattttaaaggagaatttaatgacaaaaaaattattattaattgatggcaatagtgttgccttcaaagcattttacgcgttatataattccttggatcgatttactaattcatccggattacacaccagtgcaatctatgggtttaatcggatgttggaaaaagtattagaagctgagcagccaactgatgttttggttgccttcgatgctggcaaaacaacctttcgaacaaaaatgtattctgattataagggcggtcgggcaaaaacaccaagcgagctttctgaacaatttccgtttattcgggaattggtaaaagcaaggggcattaccagctatgagttacctgactatgaagccgacgatattattgggacattggctaaacaggctgaggatgctggtgattatcaggtggtgattgtgaccggtgatcgtgatctaactcaattaacctctgataaaacaactgttcaagtttccaaaaaaggcgttaccgaactggagtcttatacgccaacacacattaaagaaaagcttgggattacacctgctcaaattattgacatgaagggacttcaaggagacaattccgacaattatcccggtgttgaaaaagttggtgaaaaaactgcccttaaattagttcaaaagtacgggtcaattgatcaattatataaaaatattgatgatgtatccggtaagaaactaaaagagcatttaattaacgatcaggataaagcggaacgtgcacgaacacttgcaacaattaagcgtgatgcaccggtgactgtttcacttaaggatttgaattataatggcgacgatcttgaaaaattgacagacttttatgagcgaatgggattcaagtcgtttttagccaaattagccgtagatgatgattcgcctcatgaagatgactatacggcgattaaatatcagattctcacgaagaaaaatatgccatctttacatcaattttctgatgaagtttctttttatttagaaatgtctgaagaaaattaccacacgtcaccaattatcggttttgcgattggtcagggtgatcattggtttgcaactaatgatgttgcattattgaaatcaaccgtcattaatcaaattctaggtggttcggcggttaagaaaaatgtttttgatgctaaacgtacttacgttggcctttatcgtgaagggattcagttagtaaatgttgattttgatatgttgttagtttcctatttgctaaatacaactaataatagcaatgatgttgggacagttgccaggcttcacggctttcagaatatcaagactgacgaggaagtctttggtaagggtgccaaacggaaaattgatgtcaatacgccagaatttatgagtcacatggttcataaagctaaagcgatcgatcaattgcatgatacaatgtttgatcaactggaaaagcataaccagtcaaaattgtattgggatattgaaattaaaattgcaattgttttagctaaaatggaaattgcgggaatcaaggttaacccgacccgattggaagaaatgggcagcaagatgaccgaacgacttagtgaaattgaacaaaccatttttcaagaagctggtgaagagtttaatatcggttcacccaaacaattagggcagattctatttgaaaaaatgcggctgccagtcatcaaaaagactaagacgggttattcaacggctgttggggtgcttgaaaaattagcacctgaagcgccgattgttcaacatgttttggactatcgtcaaatttcaaaattgctatcaacctatattgatgggttacttaaagtgattcataaagatgattccaaagtccacacacgatatttacaaacgttaacacagactgggcgtttatcatctgttgaccctaatttacagaacataccaatccgaactgaggaaggccggatgattaggcaggcatttgtgccatcacatcccggctggcaaattttttcatctgattattcacaaattgaattgcgggtattggcctcgattaccggtgacaaaaatatgcaggaagcctttaaagaaggcgaagatattcatgcaacgacggcaagaagaatttttgggctctcttccaacgaagaagtaacccctaacttgaggcgtcaggccaaagcggtaaactttggaattgtttatggaattagtgattttgggctggctcaaaatactggaattacccggaagcaggctcatcagtttattcaacgatattttgaggaatatccgggagttaaaaaatatactgaagatattgttgagtttgcaaaaaaccacggctttgttgaaacaattgctcatagacgtcgttatttaccggacattaattcaaagaactttaatttacgttcgtttgcacagcgaacggcgatgaatacgccaattcagggaagtgccgccgacattattaagattgcaatgatcaacatggacaaagctttaaaagatatgaagacgaccatgttgcttcaagttcacgatgaattaatttttgaagtaccggatgatgaattagaaactgtgaaagagttaatccccaaagtcatggatgacgcaattactttaaatgtcccgttaaaagttgatcgccactggggaaagacatggtatgatgccaaataattgattaaaaagctgacagacaaaagatagtagattcagggaatttggttataatatataaccagcttgagactagctgatcagtttaatcaattgtttgccgcctatttcaatttattgttaattagatgttaaagaattgaagctgagacaatatttaaatttgtttcaactttaattaatcacatgatctacttttcctgaatcataaaataaaccaggcgcggttatctaaccgcaccaatgttacatggagagataaaaatgccagaattaccagaagtagagacagttcggcgtgggttaacggatttagtagccggatgtcggataaaatcagttgaagttcgctatcaaaaaatgattaatttgtcagccgatgattttaataaagccttggtaggccgaacaattgacaaaattgaccgccgtggaaaatatttgctgattagaatcagtggtggtttgacaattgtttctcatttgagaatggaaggaaaatatgatgttgaacctgaggggacacccgttggaaaacacactcatgtgatatttcatttaatggatggtcgtcagctgcgttacaatgatacgcgtaagtttggtcgaatgaatttagtggatactggtaacgaaatgactgtcgccggcttaaaaaccattgggccagagccgactgagagtgacttgaagttggactacatggtcaaaatttttggaaaaagtcgaaaagtgattaaaccttttttattggatcaaagtaacattgcagggctggggaatatctatgctgatgaagttttgtggatgagcaaaattcatccggagcaacccgctaatacgttatcattagatgaaattaagatactcagaaaaaatattattaacgaaattcagaaggcaattgccggtcatggcacgactgttcattcatactctaatgcatatggtgaagctgggagctttcagaatcagttaagtgtatacggtcgagaaggccagccctgcttacggtgtggaacaccaatcgttaaaattaagttagctcagcgtggcactcatttttgcccagcttgtcaaattgttcatggtgataaagatgactaaaattattggcttgaccggggggattgccaccggaaaatcagttatcagcaactatttaaagcaaaagaacattcctattattgacgcagaccaaatcactcatcaggttgagaagcgtgggcaaagcggttttgatgcaattgtgagtcattttgggggtcaaattcttgatgaaaccggtgaaattgatcgtcagcgtcttgcccggattgtattttcggattcaaaatcattaaaacaattagttagaatcattgatccgcacattcgcagtgcgatatttcaacaagtttcaatgcatttacaagcgcagttggtggtcattgatgcaccaacattatttgaaaatggttatatccatcttgttgatgaagtggttgttgtatactgtgattcagtaacgcaattgcatcgtttaatgaaacgcaatagactaagtattagtgaggcaaatgctcggattaaaaaccagtggccacttcaaattaaatgtaacttagcaaatacaattatgtataattctggaacaattaaagaaactctgattcaagttgatcagtggttagcaaacgaaatagattaggtgaggtgaaagccatgcaatgccctcattgtggatacaatggctcaaaagttgtggatagtcggccaacggatgacggtcgagttattcgacgccgtagggaatgtgaacactgcgggtttcgatttacgacttttgaaagagtggaggtaacacctttacttgtaattaagaagaatggtaatcgggaagaatttaaccgcgagaagcttctcaggggaattgttcgttctgcagagaagcgaccagtttccatgaatgcaattacggatttggtcgatcatgttgagaatcggttaagatctttgggtgaaaatgaagtgactagtcaacaaattggcgaatatgtcatggaagatttagctaatctcgatgaaattgcgtatatccgatttgcaagtgtgtatcggcaatttaaggatatgtcagtcttttacaaagaattaaaagaaattatggaaaaggataggaagaagaattctgaacacggtcagggggaaaaataatggctcaacctatgcaaaaattaactcctgatactaagtttttgatgataaatacgagtataaatacggaattggaccataatatcctcactaacttgtacttaccaattatcggtgaacaagcacttgttctttatgagttattatggtcgttaagtttggatgataataaccgactcaaactgcataagcattacgagctacagagtatgttaaatatgggaacgagtgaaataagtgacagtcgtaaaaggcttgaagctgttaatctgctagctagtctagtttcaaaaaaggcgcctgaatcgttagtatatgcgttacagaaaccattatctgctacagaatttttaaaaactgatgttttgtcaattttgttacttggaaaagttggtgatgacacctaccaacagatcgtctcaaggctggtgattccacgccctgatctaggtgaggttacaaatgtgtcggctagtttattagatgtttttcagattccaaaaaatttaattaaaaatattcctggtacagttaatgatgccaaaagagccgttaatcaaaatagtcagtcagttaaaatgagtcaacttgagccgaatcggtcaagttttgattttgaactgttgttggaaatgcttgacaattcgtatgttgacttaattagtgtcaaagctgccagaaatttaattttatcagaacatctattatatggtattgatgagattgaaatgtcaaaactcattcagcgggcgaccaacttgagtacggatcagctaaatgaaaaacagctgaagtttctgattgctaatgattttaagcaagcgtcaattaaaccacaaccagtaaacaaaccagttgcttctgagtcagctttgtcggcagacaaccaacgcgtcaatcaaaaaacgcaacagttgatcaaaatttgtcaaacgactgccccaatggtttttttagagcaaattaaaaagcagaaagacggtattgttaccgagggcgaacaacgggttcttcgtgatcttattaattatcgaaagttttcaaacgaggtcatcaacatgatggtttatacaattttggtgactgagaaacaatcaactttaattaaagctcttactgttacgattgccgataattgggctcaacatcacgtcgtagatgctgcgagtgcaattgcttatcttcaaaagcgcggcgatgataagaaaaagatggctggcaaacgttataataattctcgacgtgttaatgttaaggaaaccttaccggattgggcaaaagaacaaccacaaaaaaaatcaagccagccggctcaaaccaaggtatctcaagctgaaaagaaggcaatccaagagaaattggcgaaattcagaaagcaaaagtaggtgataagttgtggaaagcgttagtgattatattaagcagttaatgaaagggcgaaacttcaagggaaacaactttaatgaaggattcaaaatgattattggcgagataaaaaaagatccagaaattaagcgttttcttaaagaacaccaaagtgatttggcggacaatgccgttgaacgttcagctgcaaagctttatgaatatgttaacgttaagcatcaggttgccgaaaacaagcggtcattcgcccctggctacttacctcaattggttgtaaacgatcacttgatcgatgtttcttatgcagcttcgccaagggtgattgcaaagcaaaaagccgaagcgctatcaagacgggtgaccacgatttcaatgcccaaagatattagggatgcaacgattgatcaagttgatacacctgatgacaatccgtctagattaaatatcgtgaacttggcacttgattttatgaataacctcgcagcacataaacaggaattctttccaggactatacatttatggtccatttggagtaggaaaaacatttttgattggtgcaattgctaatgaattagccaagcgtgatattcaaacgacactggttcatttcccaagtttagcggttgaaatgaaatcagcaattaataccaattcagtgaatgataaaattgatgtcatcaaaaagtcaccagtattaatgatcgatgatatcggtgctgatgccatgtcttcatggatcagagatgaagtcttgggggttatccttgagtatcgaatgcagcaacaattaccaacgttttttacgtcaaatttttcaatggcacagcttgagcaggaacatttacggatcaataatcgtggtgatgatgagcctctaaaagccaagcgaatcatggaaagggttcgattcctttcacgcgaagttgaaatgactggcgaaaaccgtcgccccaaatgaatcctttttgtaattttaattgacattataaaaaaggcattctatacttatagccaatgaaacaaagagacatgataattatttctcatcacagggagaatggctctagcctggaaggccgtttgtttagaaagtaattattaccactctttgaagatggattgcggaaatgctatcccggtcgggtaccgttaataaccacttgagagctttttgtgaaccattgtgttcacagaaatccaaattgggtggaaccgcgctaattgcgtccctggtgtactttgtacatcagggactttttttgtggttctaaaaataaaaaaggagctaatagctatgtcacaactttcatttgaatttccagataacagtgttaaacaatttgatgatgggattactgctgaagatattgccaaatcaatttcaattagtttaggtaaaaaggccgttgctggtaaggtagatggcaaacttgtcaacaatcaggagccattacataagggtggtaagattgaaattatcactggtgacagtcaagatggattgagtgttttacgggaaacagctgctcaaatattaaaaatggccatcgctaacgattttaaaaatattcaatttggcgaaagtgaagctgatgaggatggtttcttcgttgatactgataaacccgagactcaaattagtgttgatcaattgtcagatctaagcaaatctatggaaaaaatcattaaacaggatttgccaattaaagtggttgagctcagccaagccgacgcactaaaattagtcgatggtgatgcttatcaggctgaattaattaaagaaaacaccgttgacggaaaagttaaattttatgaaattggcgatttcaagtcaattgctgaaggtgctgtcctggcttcaactggtaaagtaaaaatctttaaattgctttctgtcgccggtgcctattggcagggaaaatcgtctaatccaatgcttcagcggatttatgcgactgcttttaataaacaaaaagaacttgatgccgacttagcaaaacgtaaagaagctcacgaacgtgaccatcgagttattggtaatgaacttgatctattcttcgttgatcccaaagttggtgccggtcttccatactggatgccaaatggtgccacgattagaagaacaatcgaacgttacatcgttgataaggaagttgcccatggttaccaacacgtttacacaccagtcttagctaacctcgatttatataagcaatcaggccactgggctcattaccgcgaagatatgttcccaccaatggacatgggtgatggtgaaatgcttgaattacgtccaatgaattgcccgagccatattcaaatttacaatcatcatattcgttcatatcgtgagttgcctttaagaattgctgaacttggtatgatgcaccgttacgaaaaatcaggtgcattgagtggtcttcaacgagttcgtgaaatgaccttgaatgatggtcatacatttgttgctcttgatcagattcaagaagagttccaacgcattttgaagttgatggttgaagtttataatgactttgatattaaagattataaattccgacttagttatcgtgatccggagaatactgagaaatactttgatgacgatgaaatgtggaacaaggcacaaaagatgttgaaaggtgcaatggatgaacttggcttggactacgttgaagctgaaggtgaagctgctttctacggtccaaagcttgatgttcaaactaaaacggcacttggaaatgaagaaacgttatcaacaattcaattagactttatgctgccagaacgatttgaccttcactatgttggtgaagatgggaagcaacatcgtccagtgatgattcacagaggacttgtttcgacaatggaacgatttgttgcttacttaactgagatttataagggtgctttcccaacatggttggcaccacatcaagttaaaattatcccagttagccaagacaagcatggcgattacgctaacaaaattaacgatcaacttcgtcaattgaagattcgttcatctgtcgatacccgtgcagaaaagatgggatatctcattagagatgcacaaacccataagattccgtacacattagtcgttggtgatgaagaagttaatggtaatagtgtttctgttcgtcgatatggtgaaaagaatactgaatccgaatcacttgacggtttcgttaatgagattcaaaaggatattgcttcatattcaagaaacgaataataacttgactaacttatcacttatcgcaactgatttgattatgaatttgggggcaccttattagttttgatggcttaatattgacaccctatctaattcatgctaagatataaaagttgttaaatgaaagcagaagcaacccgcttctcgccttagtgaactgattcgctgggcacgatatcgagtaagagcttaattgtttaagttctttaattgaggcgggcacaattctgtgcctgtcttttttctgcttttttaaaatatttggaggtggagtaccatagcaaaagatatgatggttaatagtggaatccgcgcacgtgaagtccgtttgattggtgctaatggtgatcagcttggtgttaaatctaaaagtgaagcacttcgtttagctgaagatgctgacttggatcttgtccttgttgctcctaaagctaaaccaccagttgcaaagattcttgattatgggaagtatcgtttcgaactacaaaagaaggaacgcgaatctcgtaagaaacaaaaagtcatcagtgtcaaagaagttcgattaagcccaacaattgatgttaatgattttaacactaaattgaaaaatgctaagaaattcttggctaagggtgaaaaggttcgagtttcaattcgatttaagggtcgggccattactcataaagagattggtcgtaaagttcttgaacgaatggccgacgaaacagctgacgttgcaaccgtaacgcaacgtccaaagatggacggaagaagtatgttcttaatgctttcgcctaatgaatcagataaaaaataattagtcgttaaaatacttgaggaggatcattactaatgcctaaacaaaaaacaaaccgtgcagcagccaagcgtttccgtaaaactgctaatggtggaatcaagagcgctcatgcatatactagtcaccgttttcacggtaagacaaagaagcaacgccgtcaacttcgtggtacacatatgatggatcacactaaccttaaaacttacaagaagttattatctaagtaatccagttctaggtaatgacatttcgaatcgtcattaatcatgtttttatatataggaggaatttaaaatgccacgagtaaaaggtggaacagttacacatgcacgtcgtaagcgtgtcttaaaattagctaagggttatcgcggtggtaaatcacgtttatttaagactgccaaagaccaagtaatgaagtcacaggtttatgctttccgtgaccgtcgtgccaacaaaggcaatttccgtaagctatggattgcccgaattaatgctgctgcgcgtttgaacgaccttagttacagccaattcatgcatgggttgaaacttgctaatatcgacatgaaccgtaaaatgttagctgatttagctgttagtgatgcagatgcttttaagtcgctcaccgatgaagcaaaaaaggctcttaagtaattttgatgtgctaaaatgactttcaccgatccttttggtggaagtttttttaaataaaataactatttgttaaggagcgacatatgttgtcacgatttaaaccaacgtggatgattgagaatattttcagtatttctccgcaattcttgttggataataatatcaactgtgttctaaccgatttagacaatactttggttccgtggaattccaaacaaggctcagctgagttgcgtgattggttactggatatcaaaaaatacggtatcaaagtgattgttgtttcaaataatagtcatcgaagaattaaagaggcggttaaagactatgaactgccatttgttccccgggcaatgaaacctttgaccattgggatccgtcatgcaatcaaagaatttcatttaactaaaaaaaatacggtgatggtgggcgaccaactattaaccgatgttgtttcagccaatagttgtcgtgttagaagtattttggtgaaaccacttgttagaaatgatgcttggaacacaaccatcaaccgttattttgaaagaattatttggaacaaattaattaaaaaatatcccaatttacactggaaataggaggcctttatggcaagtaatgaagtggttgttgatggtgaagttgttcattgtattggctgcggcgcagcggttcagacaattgataagaatatgattggatacaccccagaatcggctttgaaaaaaggtcttgaaaatggggaagtttattgtcaacgttgtttcagattgcgtcattataatgaaattgccccggttagtttatctgatgatgattttctaaagttactaacaaaaattgcaagcactgattcattgattgtttatgtggttgatatttttgatgtgaatgggagtatgatcccaggactgcatcggtttgttggtgataatcccgtattgctagtgggaaataaattagatgttttgccagcgtctttaaagaagaacaaagtaaaggattggttacggcaacgagctaatgcggctggaattagaccaattgatgttgaactcatttccgctaaaacaaattttgatattgatcgattgcttgaccagattgaaaaatatcgaaagggcaaagatgtctatgttgttggtgtcacaaacgttggtaagtcaactttgattaactcaattgttcgccaatcgacaggaatcaaggaattgattacaacgtctcgtttccctgggacaacgcttgatcgaatcgatatcccacttgatgatggtaagctattggtcgatacaccgggaatcattcaacctgagcaaatggcacatcacttggttggtaaggaattaaaattggtgacacctcagaagacaattaagcctaaagtttatcaattaaatccagaacaaactttattctttggtggcgttgcgcgatttgattacaattctggtgataaaaagcatgggtttacggtctatgctgaaaataatctctacattcatcgaactaaattagtaaacgccgatgcattttatgccagtcacgtggggaatttattaacgccaccgagtgaagagaataaaactaattttccaccacttgagatgcatgaatttaaaacgactcgtaaaagcgatgtcgttatcgagggccttggctgggtaactgttccggcagatgtagttgtctctggatgggcgccaaagggtgtttcggtattgattcggccagcaatgatataaaatcagaagaggaatttatgaaattaactggaaaacaaaaacgttttttacgtgcgcaagcaaatcaaatgcgaccaatttttgaagttggcaaaaatggtctgtcaccaatttggctagaggaaattgatagagctctggaacgacgtgaactcattaaaatcaatgtattacagaatgcgtcagttacaactagtgaaattcaggactatattgaagctaaaagtgatattaacgttgttcagacaattggtaagacgttagtcttgtttaaaccttccagccaagctgatcatcgggatttatctaaaaaggtactatcaatttaggagtatgaaaaatgtcgaacgttattggtaatgtccaaacattatctcaaaccaaaaggattatccaaaatcctaagaaacggattggaattctaggaggcacgttcaatcccgttcatagcggtcatttaattgttgccgaacaggttcgcgaccaattaggactagatcaggtgtgtttcatgccagatgcaaatccacctcacgttgatcgcaaatttgcgattgatggcaaagatcgtgtggcaatgattaatggtgcgatatgtgataaccctaaatttgcgattgagatggcagaaattattcgcggtggtattagctactcttacgaaacgatgaaagaacttacacaacagcatcccgagaataaatattattttattattggtggtgacatggtaagctacctgccaaaatggcaccgaattgatgatctggtcaatttggtttctttcgttggggtcaaacgggatgggtatacgcctgcatctaagtatccaattctttgggtagacgttccttatattgatatttcatcttcattaattcgatcaaaaattcgtcagcatcaatcaataaaatatctcgtgccggcgtcagttgagaaatatataaaggagaagcaattgtatgaagaatagtcagttaacgtatcaaaatacaccattcactcgtgatcagctcgttgccaaattaaagaaatctttaactgatagccgttttcagcattgtttacgagttgagcaaactgcaattgatttagctgaaaaaaatcacgttgacattcaacgtgctgcaatcggtggacttgttcatgattacgcaaagcagcgttcggatagtgactttattgaagcgataaaagcctatcatttggatcgagaattgttaaattatggtaacgcaatttggcatggtgttgttggctggctatttgtaaaaaatgaactgcatattaatgacattgagattttaaatgcagttcgttatcatacggttgggcatgaatttatgacgcccattgaacagattgtttacatggcagattatattgaaccggctagagattttcccggtgttgatgaggcccgtaaagtgacgtttgatagtttgcaggatggggtcgcttatcaaacccaacaaacgttaagctacttagttgctcataataaacctgtcttcccacaaacaattgtcacatataatagctgggtaccaaattcaggattgaaataaggagagacttaaataaatggatagtaaagaaatttcagaaattgttgttcgggccgctgatggcaaaagagcagaggatattgttgttttagatatgcaaaaggtaagcttaatggcagattacttcgtgattgcagatgcaaattcaaaccgacaagtaaaggccattgctgatgaagttattgatcaagttcaagcgagcgatatccaagtttatagtgtttctggtaaagatagtgccaaatggattttaattgatttgggggatgtgattgttcatatctttcaaaaggacgttcgtgcattctataatcttgaaaaactatggtcagatgcaccaatggtcaatattgaatcatgggttgaggcatgatttatcaagagtttgctcacttttatgatgaactttttgatgaaaaattatatgatcgttggctcaattatactgtcaaacgaattcgttcaaattggcacgtgcttgatttagcatgtggaactggtagattggcaatcaggcttgctcaccgagggtatgatattgatggggctgatctctctgaagatatgctgacgatggctgaacagcgagcacgtacagaacatgtcaatgttccatttattcaagccgatatgcggaatctagaggggttgccacgttatgatgcaattagttgttatgatgactcgttgtgctatttaattgaacaatcagaccttggacgtgcttttcaatcgattaatgatcatttgagtccaacgggagtatttttatttgatgttattacgccatatcaaactgacacggtatatcctggttttatgtacaattatcaggacgaaggatcggcatttatgtggaccagctatgaaggggagtttgctgctcattctgtagaacatgaactagctttctttctttataatgctgataaagatgcttatgatgcgtatagcgaacttcatcaggaacgaacatacgatgttgaaacgtataaacaaatgcttgccaatgcgggcttttcaagaattttagttacgacggattttggtgaccgccctttcagtaatcatgtaaagcggtggatgtttgaatgtcataaggagatcggttaaattaatgctttcagctgttggaattgtttctgaatataatccatttcataatggacatctttatcaattgcaacgggcaaagcagataaccggcgctgatattgtcgttgctgtgatgagtggtaattggctacaacgtggtgaaccagctatttatgacaagtgggagcgaacaagagcggcaattaataatggtgttgatattgttattgaattaccgtttttttcagctgttcagccgtctcatattttttcgactggtgcggtacgtttaattacagccatgaattgccgctggttagcgtttggggcagaaaatcccaatatagattatcttaaattaattaaaaatcagccggaacgcgatgccagtttcagacaatttgatcgaccgtatgcgtcaattttccaggactatttaaagaagaaaacgggtattcaattaaaccaacccaatgatattctggcatttgggtattcaaacgccaattttaatcttggttcaccattaaaattggttccaattcagcggatcggtagtgatcataatcaggacaaattatcgccatcggggttaattgccagtgcctctgcaattcgcaacgcaattcacagcgatctcgtttctgaagtcaataagtttgtgccacgttcaactttttccatgattcaaggacaacgttccattacttggaatgacttttggccactgcttcgatttgaattagtggaagcacccatttctcaattgcatcaaatttaccaaatgacagaaggaattgaatatcggttaaaacgttgtgcgattaaagctgatacgttcaaaacatttttacaccttgtcaaaaccaaacgatacacttatactcgaatccaacggctatgtacgtatgtgctgttacatgcaactgaagcgcagatgttaaatcagcccaattatttacgactgttgggttttagtaagaacgggcaggtatatttaaatcagattaaaaacaaacttaagttgccattgattacaaaggtaaatgaagaggttgtcaaaaattggttgcagatggactttggagctggaatgctctttcaaatgattaataataagtcccaagattattatcggcatccgctaatcattggaaattgaacaagttcctatcaaggaaaacaccttgacaagcctttttgttgccggtataataagttttgttgcattggaggaattacattgaaatggtactttaaagatttacagaagtactctggtactgatccatttacgttcaatgaaactctcaatattaaagaagaattgttagatcgatatgctgatgaagttatcgatgcttcgagctttagtatcgatggtactgcttttgccgatcgtggtgatgtcgtaattgatactcacattgttggtgaactagtggtaccatcttcaagatcattaaagccggttcatttaccacttgattttaccgttgaggaattttatgttccttcaaagattgctgaatcaaggtctagtaaagacgacgttgtttttgttctcgatgaggaagatgaggttgatattcaatcagctgtcattgataacgtaattttgcatattcctatgcacattttaacgcctgaagaggccactggcgatcacatgccaagtggtgatgattggaaggttctttcattagatgactatcaaaatcagaaggcggaacttaaaactgttgatccacgtctggaaaaattgaagaacttctttaaagatgatcattcaaaataaccgggctttaaaatttcactagtggatattttatttaacgaggagggaaagaaaatggctacaccagcacgtagaacatcaaaagcgcgtaaacgtatgcgccgcggtcacattaaattaacgactcctaacttgagtcttgacccaaagaccggtgaatacaccatgccacatcacgtttcaccatctggcttttataaaggtcgtaaagttttaaagaataagtaagacctaatttaaaacaacttagaacgccatggattctaggttgtttttttgttgtctaaagatagttaatttttttggctctttgtcaactgaggttgatatcagcttatatagcaaatccgaaaggatttgctttttcttttgcattaattgaattaagcaaataattccatttgaatcctagttcgataatggtca

SEQ ID NO: 674 - DNA, 7150 bp, Unknown
  Metagenome-assembled genome
atcgtggtttttttcgtttccgaacccgtgtgctctacgttttgcgcattcatactaaaaaagccctaatcacgaaatgattagaactttaatatttgaattcaccaacaacagttgacgaacaacctaaaaagaagctggtaacagacacaaattgtgtctgttaccagcttcttttcgaattttactacatgcttttaagctaattgtccctgatcaataaattgatcgttcaaaaatccaaaacgttttggatcaccaatcaacttactaaacggatacggttctttttcttgagccaaaatttgtttgaataaatagtttcttaatatccacggctcttcaattcttgcaggatgtaaattcaaaactgcttggatatgttcaggagttgaatgtaaatctttagcagcccgttctaatgacaccccggccagatcaaaattcttctgtaattcatcccgagtagctgcagcttcatctgcggttaaagacattatcaatcccgttcctttctgtaataaagtagccaaatgcgcttggcttgcctagacagttctgtctaaacctgttcgcaattgcaaatccattgctcgattgagactttcaagagtgtccaaatctcaatcattgctccagagcatacgcatcatttctcactctcatcatttccttgtatgcgaatacattaaatgtatgctaacatatcttggcagaagtcacaaatatttatcatgattctttggtataataaaagatgttctatttttcaaaatgtattaatatcaatacctcaggggtgatttaatttgagaaaagttttgcaatggcagtatgcttatcgtttgacagaaatttacactgcaccattaaatattgtctggttcattcttggcggcgccattgcttatcagcaattcggcacaatcaacctaaccaatatcctactttgcctaattgatgtctttatctttgatcttgcagttaatgtttccgataattattttgattttaaacatgctgccgatcaaacttatatggaacaaacgaatccaattggtaaataccgactagatccaaaagccgttggtaaattggctgttgcactctacatcatttctgctgttttcggtttctttcttgttttacgaactggttggccaattcttctattaggtattgtcggttatgcaatcgggattttctacactgccggttcacatccaataaatgccactccggtcagtgaaaccgtggtggcattatcaattgcttacctaattcagttggtttgtgtctacgtgtcaatttatcatgctaaccagatgacttggaaggtagctgaggttacgtttatgctctgcttaccattaactctgacgttcttcgttctccagctcgccaacgatacatcagatttggacgaagatatcaaaaacaatcgctttactctggcttactaccttggtaaatcaggatccgtccggctcatgaaacttttgatgattagtgggataatttttccgttgattacggtattcttaagactcgccccttggccggttgccctttcaacattattattacccatcttgtggaagggaatgcagccttttttccgggttcaggataaacagaaaacattcttgctaaccgttaaaaacatgtcattattttttattgtttacaccctatgttttgttattggaacttggctgatatagtgaaaacgctattaatgtcacgaacggctcaattaatgtgtagatcatggtaagatattcgtgtactcaatttaaaagggtatccaaatatttatgagcttgttcctgagtggttgtctgttgccgaagaaagatccattccagcactaataatactgtatcactacaatggtctgccattaattcaacgggtaagtcatatttagaatagtcgattgcctttctgaatattttttgcattgtatttttgaaataattaataaaactattaactaactgcccggaaaactgattattctgaaggatgttattaagcaggtgcttatttttatcaaaaatatcatacagccggtcaaaataaacaattaatgcccgatctgactcaactttagtgactttgtcgacttgaatttctttggccaacgtgtaccaacaatagtcaaccaaatcatatttgtcatcgaagtagttataaaatgttgctcgtggaaaattactaatgtcacagatttcattcacactaatgtgttcaaatgacttctgagaaagtaattctaacatcgtcttggagaatgcttctaaagttcgctgcgcaccgcgagtcggtttcttggacaaatcatatttcattattgacccacctttatttttcatttattgcattttgtctaaaaataaacaaatgtcttaaattgttgcttgcatcaatttcacgttgagtttatcatcttgaagtgacttatacaagtgtctaaatttgaacgaacgttagcaatcgattaatcaaaatagaaaggaagtcaaatcatgcagaaatttaaagaaaaacatatcttagcacttatcatctggattggcctgttgttaattgccatttttacattacccaacatttcacaactggtccgtgataagggtgcaatttcattaccttcatctgtccaaagtgaagttgccagtaccattcaaaaaaaagaggaaggaggtaaaagcgttcgaacgcttatcgccgtttataacaacaaagatggtaaaatcactgccgaacagtcccagcaaattcaagcgacagttcaagccattcgaaacgattcaagtttacatacagtgagtgtaacgagtcctggtgataatgcagcagcaaagaagcaattagtttccgatgatcagacaactcagatggtcatgatcaccgtcccaaagaaatataaagtccgctcccagagcaatcaattattagcaaaaatgaaaacagccggactgcggacttacgttaccggtaacgatattttaaatgaagacttttcaaagattaccgaagatggtttgaagaaaaccgaaattattgccgcaatctttatttttattgtgctgattatcgttttccgatcaattctaattccaattatctcgctgatcaccgttggtttatcatttttaatttcgttaaacctggttatgaatttagccgccaaatataattttccaatttcaaacttcacccaagttttcatggtggtggtgctctttgggattggaaccgactacaacattctactgtatgaccgcttcaaagaagaaatcaaaaaaggccaagaagccgctgcggcagcaaagattgctcaacaccatgccggtcgaacaattttgtatagcggctcatccgtcttaattggatttaccgcccttgcgcttgccaaatttgaattttatcgttccggtgtcgctgtggctgtgggagttgctgttctactcgccgtattactaacactaaacatgttcttcatgtcaacattgggcaaacgcctattctggccaagcaagaacttagatgcccatgatcgcagctttttatggcaccatttatctagacttactttgtcccattcatttattatggttggcattctagttattgctgccattccgttactttttgtcgggactcaaaagttgaatttcaatgatgccgttgaattgccaaacactgtcaattctaaagctggttataacatgatccaagcccactatcctgctggtatgtccggcccttcaaccgtctatattcaaagcaagaaaccgctcaataaccaaaaggatttggcagaaattgaccaattaaccggttaccttaaatccgaacctggtgttaaaagtgtcgcttccgtcacccgaccaggtggtaccaagatcaagtcactctacttaaagagtcaactaagtaagctggtggctggattaaatcaggctaactacggtctgaagaaagttcaaaaggggttagacagcgcgaataaaaaactggccagtcaaaatacctcgcagagcgtttcacaagtacaaaaattagccagcggcgccaatagtttacaatccggtacccaacagctgagtcgcggtgttcaaagctacacggccggcgttaataatttgtccagcggctcctctcaattaagtcagagtacgggcactctatcacaaagtgttggtcaattatcagcaggtagtcaacaactcaatcgcggtgttcaacaattgcgatcccgaaccacgaggattcaatcacttcgtaatcgcgtgaatggtctggccgctggatcaagccaattatcatccggtcttggtcaacttaattcacaggtctctcctttctcaagcggagttagtcggctcaatcaaggtgctggacaattacggcaaaatagttcgtcgttaaattcaggggcgcaacgagttgccagtggtagtgcccaggttaatgccgggatgcaacagttgaccaccaaaatgaaacaactggaagctcaaagcaagcagctccaatccggtttgacatcggctaatgcagccctttccaagattgatgacgggactaatactgttaaccaatatctaaaggaaatgcagaaatcctacttaggcgatactttctacatgcccgccgaaacggttaagagtccaaccttcacaccatcgttagactcatatatgtcaaaggaccgtaaaatcactaatatttcagttgttctcaatagtgacccaagcacaactaaatctgctaaccgaattcggacgattacccgtgatgtcaatgctagactaaaagacagtgatcttaaagatgccaaagttgcgattggtggtcaaagttctcaaactgctgacctgcaaaaaaccgccaacggtgacttcttgaggactgtggctattatgctgatcggaattggcttagcattgatgattgtaacccgttcgctggttcaagcattgacaatcattggtactttaattgtcacctacttcggttcgctacaaattaccaaatggctttccagttacttattattccaaaacatgttaacgtggaataccccattctttagtttcatcatgttaatcgcattaggcgttgattacagtatctttttgatgatgcgttatcgggacgatgccagtgctattccggatgttcgtcgacgaatcttaaattcatcaacgattatcggcaccgttgttatttcagctgctatcattttagggggtacctttgcagcgctaatcccttcaaatgtcctaacactgatccaagttgcaatgaccgttatggttggattagttattctggtcattactttaccaattatcatgtctgcaatggtcaagtggacctatccgtacgttaatgataaaatgtatcagaaatccatggccgaaaaagataaaaagctcagtgacaaagtttcatttagaagacgccgtcaagaaaataaagataacaacgactaatcattactaaaaaatggctcccagcaaaatgtgtttaattttgctgggagccatttttatttacaagtttaaaatacagaagctatttaatttaacgagctgtccaaccaccatctgctgtaataactgttccgttaacgaagctcgactgatctgatgctaaaaagacagcaacatcagcaacttgttctggcttaccaacaggagaattcatgccgccagcatcccctaatgctttcattcccaattcatcgggagcatcaagtgttttaccaatgttggttgcaatactacctggtgcaattgcattagctcgaacattgccataaacaccataagtcgctgcaatgtttttcgtaattccaattaaaccgtgttttgaagcagtataggcaacgccacctctggaaccaaacagtccaccaaccgatgcaatattaataatattaccaccatctttttgattcttcatatatttaactgcttcacgcgatgctaaaaatggtccggttaagttaattgcaagtacccggttccaaagatcatccggcatattttcaatgattttaatattgtcaacaatccccgcattgttaactaaaatatcaacctttgaataagtgtcaaccgtctttttaatcatcgcaacaatatcatcttccttagctacattggcaataacggtatcaacggcttctccagtcggatcgatgtcgttagctgcctgcttgagaccatctggattaatgtcagccaacattacccgagccccttcttcaacaaaccgggtcgaaatagccttccccattcctgaaccagcaccggtcacaatcgcaactttcccctttaataaatctgtcataggtatcggatcctttctaaattgcgtgcctgacttcccttctccagctttatattaccgttaatacattgattttatcaaatataatgctttgtttatcgataaaagataagacatcatgatataactttatcatataaaataaggcaccacatttgacaacaaccagtaaaaaacgctatgctcatattattagtttttaagatttcgtaaagcttgctgaaagccttgcatattaattgcaactatttatttggaggtcctcatgtcagaaaagaaaaacatcaatgcattgtcttatttttcaattgtttttgcaccattcatttttccatttattgtttggctgttaactgcgaacaataaagacgttcatgaaacagccaaacacgcgtttttacttcacttaattccagtaattctttcaatccttacattaatgttagttgggattatgggacttgccactaaacagacccaggcaactgctattatgttcgttattttaatcgtgttagtggccctagttgacttaagcatgtttgtttacaacttatatttgggaattaaaattctgttaagcgacgaaaatgacgccgatcagatctcataaaataacgaactacaaataaatcaactttacaaaatataatgggtctaaaatttttggggttgataccgtaaggtatcaatctttttttgcatataaatagggcatcgccctactattgaattagccaataattcagatagaaagaagtaaaaacgatgtcccaag

SEQ ID NO: 675 - DNA, 189645 bp, Unknown
  Metagenome-assembled genome
gacatcgtttttacttctttctatctgaattattggctaattcaatagtagggcgatgccctatttatatgcaaaaaaagattgataccttacggtatcaaccccaaaaattttagaccccaaagataaagggatcaattctttcattgcgaaaggattggtcccttttggttattgtaaaaagctatcgctgtagcaacgcaataatccgaaaaaagctggattgtgccaaatggctattgaccaaattttttccatacaagtggataacaagtccacccagtgcctgggtcaaataaattttattcacctcatccatcgacccatgacataaccatcatcaaaactgctatcactatcaccgccaccaccgcccggtgtatgccgaataaatcgaacaattccgatgaatcccaaaacaattaagatgccaaaaataatttcccatatattatcccaactgatcccttgcttgatcatggaaacattggcgacgtgtttattgataaacggcgtataaacatgaacatatttcattaatgcggcattactatcaacttgtttagacaatcccaaattcatgcgccaattttggaaatccgataccgcactccgcaaatcctcgcttttgataaaaagtgcccgttgtccaccacctcgtgggtaaaccaccaaaattgagacttgattggttaaaaatgaaagccgctgatcgaccattgtgtcccgatcataatcactatcggccgatgtataacttttaacggctttggttagaattgacgtggaaacatcgtctgaaatttcgcccgtactatcatcgtcgctgaggccatccttgatggtacttggcatctgcttaaacgtgtaaacccagatttgctggtgcctacgctgatgagaccatttcccattctgttggatgatttgctgcttttgagctggcgtgagaatgtgaagttggtcgtggatcatgtagggttggagattggcggcgtgggtggtggtggctgtgaggatgattgataatgtggtgattgttattagtagaatcgtttgaattatttttttcatggtgtggcctcggatggataagtttttggaaaataaataagtcatagttgattacatgtcagttcgctatactgacttacatttaaatatcattgatccaacagtcttctaaaacaagtaagacagatcaatgatatttgatcaaagactaagactcttcgaaaactgaaataatatgtgaactaggctgtggcttggactaaacatcattgattcgatagtcttctaaaacccagctactctagttttatttacgggccagggactaaacatcattgattcgacagtcttctaaaacccaatagtcgtttaatgtaatacaaaatttggactaaacatcattgattcgacagtcttctaaaacatgactcacgggaaaagaaatatatttcggggactaaacatcattgattcgacagtcttctaaaacgacggttaaagcgtcagttaagtaattatcggactaaacatcattgattcgacagtcttctaaaactaagggttatactgctaaagccaaaccgatggactaaacatcattgattcgacagtcttctaaaacccgatcgttgatgataaagttcagactgccggactaaacatcattgattcgacagtcttctaaaactacagtattttgtttcttcgtccatatataggactaaacatcattgattcgacagtcttctaaaaccatcttaaacgacaatgacgacttgaatttggactaaacatcattgattcgacagtcttctaaaactttgtttagcgcttaaaaaataaaaaacttggactaaacatcattgattcgacagtcttctaaaactgaatggagaatgatctttttatcttgatgggactaaacatcattgattcgacagtcttctaaaacttgcttgccgattatttgtacatcagcactgaactaaacatcattgattcgacagtcttctaaaacatgagtaacgtggaagtctacgaaaaactcgaactaaacatcattgattcgacagtcttctaaaactcaatcatgactaacgaataggggtgttgagaactaaacatcattgattcgacagtcttctaaaacgccgtgggaatgggacgtgatcgtagcaaggaactaaacatcattgattcgacagtcttctaaaaccatattgatgcttataagtattattccgatgaactaaacatcattgattcgacagtcttctaaaacatacaatggcacgaagtttgagattccgctgaactaaacatcattgattcgacagtcttctaaaactcttcgtaatcaaaagttttccgcctcctcgaactaaacatcattgattcgacagtcttctaaaacaccaaacagtggcgtaaagaaaaggatgcggaactaaacatcattgattcgacagtcttctaaaactacgactgaagaacacgactcgtggataaagaactaaacatcattgattcgacagtcttctaaaacggcgatggtggcactcgttgctgacaacgtgaactaaacatcattgattcgacagtcttctaaaacggagggataggaatgctaccacttgattttgaactaaacatcattgattcgacagtcttctaaaaccaacatgattgtcaccatgatggaattggggaactaaacatcattgattcgacagtcttctaaaacataatctgcatcggaaatggaatcaaggtcgaactaaacatcattgattcgacagtcttctaaaacgagatgtatagtcacctaaatttagttttagaactaaacatcattgattcgacagtcttctaaaacagacaagaattctagttatggatcaaaagggaactaaacatcattgattcgacagtcttctaaaacggtgaggaagatttaaagacattatctaaagaactaaacatcattgattcgacagtcttctaaaaccggaattgttcatgagttttccaattgtaagaactaaacatcattgattcgacagtcttctaaaaccgattttttataatcgtattttaagaattaagaatgccaatcaacaaagtcttcgtcaatgtagtagaactcagcatttccataaagcgtctgaaacttcatttctgtgaattctatcataattactggaattttcactgtactaacaagtgcgttcagatcatgcatcttatcctgattaagataatgagcgacattagttaatccgatacatgactcttcaccgcactccaagtgaacctttagaattgattcaattatagcatagggatcccgcattgcatcagcgttaaagtgaattttgcaatatttaaacaatcgctttagatcatcatcttttttgacctctagtggtaaatcaatcataaacagcgaactttgaaccgctgtatataatttgtcgttcaaatcgttaagcgtcttacgctgatcgtcagtcaacgttttctcaagttgtttcattaacaatgagccatattgctcggtcaggttttctgaggtgacaacatccccatgccagtcaattgctttcttaagctctagttcattataagcagcatcaaaaatcttcaccttttcattaaagctgcttagacctgtcagcaaatcataatagacagttggattattcgtcgcgatcacggttggtttgtcatcagcgacctcaatttgtttgtgagacgcgtacgaaattttcatagaatgatcgtcctttccgatgaatttcggacgtctttcttgggctcacctagaataaaatgcatatcgttatactgcttctcagtcaacatcaacgattgaataatcccagaatccggtgagatggctgcaatccgtttttccataaaatcagcggattgtctggtcacacaaactcggacataaactgaaaactgaatcatcaaaaagccctcgttaatcaacgctttacgaaatttccgataagcccgccgctcttcactcgtttcaaccggcaagtcaaacatgaccattaatcgcattattcggtacctcattttttaattccacctcaatttgaacttcatccttttcaccgctcaaaaatttaagacaatttcgaacgtgatcggtaatcatatttcgaaacagggtttgcttgccattaaatttcaattccaaattaagcagatccaccagtccaaatttaacgtctggcgtcagctctttgaacttctggttagccagccaataatcaatgattggtcgaaatggttccatcaaatcagaccccaagttaaactggttatcatcgctgtggtggtgaatgccaagatatgttagataaccatttgaaacaatctcccggttcacgttagccagtaaaactgaatagccgtagttcatcgccgcattatagggattgaagtcacggcggttaaaacttttatcaaacaactgttgaaagtatttgcgggcaacaacggcttcccgattggtaacatcatcaacttccagcttattcaattcatcaatcagttcactgttatcaaccccataaattgccaatacattaatttgattgataatcttgctggcaacaatctttgtccaaagtaattgctcccgtcctttgtcccagttgaactgtttctttaataaatcaacatttcgattatttggataataatcaaccgtttcgctaactggttcgttagcattatctgtaaaaatgacttttacttgttctttagctaattcactaattagcatagtcgttataacggcctgagtcgttgaaatcaataataaatcaatatcatcaagtggaatttgattaatcccatcgtctgtttgaacaaccatattcctcgatgaatacgacaattttgcgtgctgtgaaataatgactgaacgccatcccataaaaacatccccttgtcaaaacttttgaaacgagttatcatatctttgttgggtcgctcccaaccgattaaacattattgattcgacagtctgagttaaaatcaagcaatgcgtgtaagcgcggagtttctacacaccattattggtgaaacccttatgggtgtacataaagaaaaggaatcgttcatcttcatcgatgaacgattcctttttgcttacaaatctttcaacgaaactcgatgttcgaaaagaccagttggtgattgataacaaatcagggtactttgtgaaagagtaattcccctagactcttgtaaaaaaccaaacggtgttgaaattcccaaatcctttaaatgtccaaatgttgcatccgcatgcaagccgttcaaaatttcatttagtatctcttttttacccgtatgaattttcttatttcctttaaaaatcgttgaattaggtaattcttcaaactttttatgaccattctgcaatccttttcggaaagaatttctatcatataacgaaaaatacctatttactttttcaactatttcatcgtaaacagcaactaaccttttggaatcttcctcagaatcaaaagtccctttgcttgctaatgtatcaaaggaatcatccgatagcaccaactgtttggcattatattgataagttgaactacccaacataaatttcttatcaccgtcaattaccagctgtcgatacatcactttgccaagaacaatctcgaaatcttcaaccttcttagtaatctcaccggtcttccgactcttcttaaccttggtaaacttcggaacaagaatttgttttaacttggcatcataatcctctttatcatgagctgtatttaaagttcctagcgctctcactggaacacccacaaccttatacttatctcccttcttatcatgaattcgcgcaatcgccatgtaggcgtcaacgctaccactatatccaccataaacatcaaccggcttgccctgttttattgcaatcagctttcttctattcgcttccttcgccggataaatcgtctgattaaacatggcatcccttctcgtatacacctcctgcgaaatcagcataaacttaaagtgataaacccgcttcatataggcaattgccggctcgcgttccaacacaacctcgccagtctcgggctccacaatccgcttattattctcgtccattaactcatgcaaaaagttaaagtaacggaacgacacgtgatcttcgttgaattttttgaaattgccataaacaaaatatggccgcaacttaggatatcgtttatacaaatattgacccacaaaggctgttaaataagcatcgactgcatgatggtaatcattgacttcacgattcttgactagcttaaagttttcccgcatctgatgattcatttttgcggtcacttcaatgattttggtgtcatcattttggtacttatcacccaaaatttgagcaaccagtttgataacctgacttgtttcaaccagttgccgacgaatgaagccacgcatggtgtatttatcaattgtgtctggatccgtcagcagatgcttcaattttcgtttgctgatcagtcggtgatccgccaattctttccagaaaccacccatttttccaccaaacagcttaaccggtacattattggacttaccgttattgaccgctttgctgacgagaacccggttgtccaaagaatcatccttaataaaggcttgtggcaaaatatgatcgatatcgtaagtgctcaattcatcgatattcaatggatcgcccgtatacatatctttaccaagctgagtgaagtacagatagagccgatcagttagtccttttttactcttagaaaccgtctccaactctgttaccagatcactatcaacgatttctttggcgtccgccttaaacgtattttgcaattgactttcacgtgattgcgttcgacgcggattttgatcttccgaccgagtaaactcaattgaaactgatgttggcgcgacaccacccattgccttttgaatatcatcgaccacccgaataacctgtcggatggcttttttattttgcggtgaggtataggcatcagccaaaatatcctcaatgccggtgactttcatttgcttagcattggcttcatgaatccgtttggcaaatgattcctgagattgaacctgcatgaagttctggttggtattccaaagaacgtcaatgatccgctcaccattttcgtcaacaatccccgttaacaatttcttggaaagccgaccccagccgttatatcgctttgtcttcaacgcttgaatttgatcttcgttgagccagtccagtgttcgcagcttggcttcataaatttgccgatcttcaaataccgttgaccactcaatgattttctcgtaatcatcttgacggtccggattatccacttgatcaccgaaaatttctttgaaatcaatataggttcccaatgatgaattaaatcgttctggatcggataaaccggtaatctttggtttggacgtaaagtatccgtgatcaaccaagtagttttgaagattttccgcgctaattgatttctgattttcgaacaggtctcgataaacagcctgtttttgcgctggttccagtccatgataattagcttttaccaagtttagctcattcaagaccttataccgttcgtaaattaaactggcgtccggcaacacgtcctcaccaatcaaataagtatctttggtcgtcattcggcgaataaatcggttagccgatgccattcgatcaactttttgatcaaagttccatggcgtaatcgtgccgggctgcttgcgtttcatccaggcaaacacctgactggccgacttctcctgctcttcaggggttactaatgggccgacgtagtaaggaattctgaacgcaaccaactcatcaagtttgtatttagcttggtgaattcgttttggatttggattagcagccgccaaccatgggtaatacttactctggttttcaataatttgatccagttcaagttgatgaagctgatgcggaataacgccattctgtgaagttcgctgctttggcataaatttttgtgcctcaatgagggcagcaatttgcttagcaagatctgaatcatccaagttctttttaacactggcgtaaaagacatcttgattggccactttcatgtttttaccaacataagcgtcataggcggcttccaagccctttttctttttcggatcgtcaatcttatcttcgagctgtttgagtagcttcaagtgatcacggtgatcgttatatttttcaatcattgattcagacaatgacatgccattgggcacaatctgatttaaagtgacttgcgcatagagattctgaatgattgaaaccatttcctgacgattctcatccaactgggataacaagccaggcaacgtatcgtcaatgttttcatcgtccagctcaattttccaagccgaagaattaattgcatcgtatttgagcaggacgtcgagttgcgttttatagccaagaatggccttactaatctgagtcgccacttttgtattttctttatcaagcgctttatcgccggtttctgacaagatcaacttggctgactgtttctgcttgtcgaacttttttgtctcgtcactaagaagcagggtttcaattgctttactgttatcgccattaatcgcaaacggttcgtcgggtgaaaccgccgcgtataattcgttcaaccggtcaaattgttcatcgaattttacgtctgagacactaaatgaactcacaggcgtagtgtttaaaaagtttccccgatacttaacaatgtgatgaatcgctaaataaatctcccgaatgtcaaactttcgatcttcagtcatcaattgatgacgcaaatgataaattgtcggataatcctcgtgaaatttgcgatcagtgcgatccgggaacaacattgatccggtccagtcgcggttctgatctttaggcgataagtttgattgctttagccgagcaaaaaaggtggcatctaccggtgttatgtatggatcaaagatttcatccaatagctttagtcgccactttcgccggttgagtcgacggcgggttgttcgatacagtcggcgctcttcagcaatctggccttccctaaacaatcttgcaccaattgcagtttttcctttgatgcgcaagatttttccgttttcgtcaacaacaacccacccaattgatgatgtcccgatatcgagacctataaagtaaatccctctcataacttgaatcctccattaatattaactattgatgcctagatgatcatcaattaatatcatcataaacccttccttatacaattggaataattttttaaagattttgtgcacaaattcactatccatttttcagagtcgcgagcttgactcacccctacttgttggactaccttgaaataagagtttcatggctagtgagataataataaaggagtgacaattttggcatccagcatgattgattcagaattattcaagaatcaatacggcacagaagaaatgcgccacatcttctccgatcaagcacaaattcagaagtggctcgacacttgggcagcattagcgaaggctgaggcagcccaaggggttatcccaaaggcagctgccaaggagattgctgagaaagcaacctatcaaaatattaatatgagtgaggtccgcgaaggctttaagaaaaccgctcatcccctaatgccccaaatcagaagctttgcaaaatcactgtcaccagaagcaggcggctatgtccattggggtgcaaccactcaggatatcaccgataccgggctgaccttacagttaaaggatgctcagcagcttatcgttaagcaacttcaggaattactgacttccagtcttaaacaggctaaaaagtatcgcacccttatcatggctggtcggacgcacggacaacaagctgttcccatcaccttaggttataagatcgcgatctgggcaaacgaatttggtaatcacttggatcgcattaaggacggccaaaaacgttatttagttggtgaacttggcggtgcggcaggcacattggcttcccttggtgacaaaggactcgccgttcaacaagacttctgcgatttgttgggattagaaacaccaacgattacctggcacgtttcacgggacggttttgcggaatttgccagtatcatcagcatgattgccggtaccgtggctcgggttgccaacgaaatcatcaatctccagcgaaccgaaattggtgaggttgaagaaggattcacgatgggaaaagtcggttccagtacaatgccacaaaaacgaaatccaatgaagtgtgaaaatatcgtatcgctcacccggattattcaagcaaacgcaacgttgggcttttcttcgatgatgcaggagcacgaacgtgacatgacattctggcaatcggattggtcatacctgccacaaatttgcattaacctgagtgccgcgatgaaaatgttaaatgacgtgttgaatcaaatgattgtccacaaagataatattaagcataatctctttgagacgaaggggctgattgtctcggaacgggtaatgctcgacctgggccgttacctgggtcgccaaaatgcccacgaagtcatttacgaaaatgccatgaaggcgttcgaagaaaagaagccgcttttggatttactacttgccgataaacgggtcacggccgacgttgacgaatcgacacttcgagaaatgctcgatcccgaaaaatatagtggcgcatcagctgaactggtcgaccgggttgtcaacaagtaccatgacttcttaaaatagcccatttaacgggattttcttgacgaattcacgtcaatcatttaaaattaagtcattctacacgaaaggaaagattgcgatgacagtcaagcattatcttatttggcaaagccggtaacaagtcacatcgacatagatgcgacttgatcttaagcatgcgatcatgaacgcatctgtgccggcaatcttttcggaaaacgaaacggtctgtgcagatgattccggacaggccgatgtcattagcgagtatttcggtcaaaatccggaatgctcgttttttgttcgccactatttattgaggtgttatttgattcataaattatttgaggagtgtttgcaatgaagaaaaaatatttgattctttcagtaattgtcgtgttatttgcaattttaggatttgccctatttcagggaaccgctaagaaacagacccagaaaaagccaaccgtcgggattttacagctgatgtctcaccctgctttagatgccattcataaaggcatccttgccggtttgaaggatgagggctacaaacccggcaagaatatcaaaattgattttcaaaatgcgcaaaacgaccaaggtaatttgaagacgatgagttccaagtttgccaatgaaaatgctgatttaacaattggaattgccacaccgtcagcacaatcattagccaatacaatgggtaagacaccagttattttaggcgccattaccgatcctaagggtgccggtttagtgaagaataatcaaaagcccggcggtaatatcactggggtttccgatcaagcaccattaaaggaacaacttggtttgattaaacaattcatgcccaagctaaaacggctaggaattatttatacatccagcgatgattcggccgttgcacaatataagaaattcgttcaactatgcaagcaagaaaagattccactaaaggcctactcgattgctaataccaatgatttgaatcaggttgccgaacaagctgcctcagctgttgatgcaatctatgtaccaactgacaacacaattgccggtgccatgccaaccttgattggagcagctgataaagctagagtaccggtctttccagccgttgatacgatggttaaagccggtggggtcgctacttacgggattgatcaataccaattaggtgttgcaaccggtaagatgagtgccaaaattttgaagggccaaaaaccagccactacaccaatcaaattcttccgtcacggtaaattaattatcaacgaaaagcaggctaagaagttaaacattaaggttccagccaacctgttaaaagaagcccaatctaaaggagaattagtcaaatgagtatcatcgtatctgccatcggccaggggctcctctggggcatcgtcggcattggactatttttaacatttagaattctcgattttcccgacatgaccgttgaaggcacgtttccaatgggggccgccgcctgcgtcgcagcgatctatcaaggattttcaccatttacgtcaaccttaattgcgttcatcgtcggcatggctgcgggctttgtcaccgggattctttacacaaagggtcacattccggtcctcttggcaggaatcttggtaatgaccgctgcctactcaatcaatttccgaattatgggccgggcaaatttatcattatttggtaaatcttccctgctaaagaattcatttttagaatcactgcccccttactttgacagcgtcgttcttggcattgccttcgttgtggttgtgacgttactgattatttatttcttacaaaccaatttgggtcaagctttcattgccactggtgataacccaaccatggcgcgttcacttggaattaacacggatgccatgcagatcatggggcttagcgtttccaacggcttaattgctttaggtggtgctctagtggcccaaaacaacggtttctcagatgtcaacatgggaatcggtgttatcgtggtggccttggcttccatcattattggtgaagtcatctttggcgatttaaccatgaacgaacgactcatggcggttacaattgggagtattctctaccgctttgttatcttaattgtgctcaagctgggcttcaacgccaacgacctgaacttaatttcagcaattgtcctggccatcttcatgatgttcccggttctggaaaagcggttccgcatccgccatacgttgcaaagggggttaagtaatcatgactgagccgatttttgaactaaaagacattgttgtcaccgttaatcaaggaacgcctgaacagatcaatattatggatcacgtcaatctggcaatttacccaggagattttattacaattcttggttccaacggtgccggtaaatccaccttgttcaacgtgattggcggtaaccttcaaattgcggaaggtcaaattctcctgcatggtaaagatattaccaacatgtcagttgaacaccgaacccgttttctaagccgagtcttccaagatcctaaaatggggactgccccccggatgacagttgccgaaaacctcctattatccgagaaacgtggtcaacaccgcggcttggacccccgtcatttaaaacaaaatatggcaaagttcaaagaaattacatccgtcatgaacaatggtcttgaacagcggctggacacggcgaccggtaaattatccggtggtcagcgccaggccttgagtttcttaatggctacgattaaacggccggaaataatgctgcttgatgaacatactgctgcgcttgacccccaaacatcgcaagaattaatgacggccaccaacgaccagattacccgaaatcatctgacttgcttaatgatcacccaccatttggatgatgccctcaaatatggcaaccggctaatcgttttggatcacggaaaaatcacatacgatgtctctggtgatgaaaaggacaacatgaccaaagaagaattattaggcttctttagtgatattgatggttaataatcatctggaaatttaattttaaattaacaaaaaatgggatcgagacgagataatgatcatgttatccagtcttgatcccatttttgtaatcacaatgattccctattgaaaagcaactgtcagccttgtaagaatcttatccaaatactcaagacctgaacatccgaatgagtttctcgcttttaagcctactacttttcggccaacaccatccgatttaattgccctcaaacaagcgttttagtatcataaacataataactaacaaacaatcaaaacaaacaacgaggtgataatgatgtcccgcccccaaaataaagccgcattactgcaacaatccgagcttaaatttaagaaattgacaacactcattgatcagctaacccccgaacagcaacaagcaaccttcctatttgaagaccgggatcgcaatgtccgtgatgttctcatccacctgtatgaatggcaccagttgctcattaagtggatcaatgccaacttttatgaccatcgccccacgccatttcttccaaaaccatatacatggaaaacctatggtaccatgaacgtgattttttggcagcagcaccaaaccaccccattggtagaagctaaaggccttgtcacaaagagtcatgcagctgtcatagtagaaattgatcaattttccaacgaggaactgtttaccaaacaatttttcgattggactggaactacttcgcttggcagctactgtgtttcgtcaaccgctagtcactatgactgggctataaagaaaattcgtaaacatcaacgcaccctgaaaaacatgtgaaagaaaccggttgacaattatcgtagcctaactctaatgactaaactaccgtccttttgctgttgcggctgccaaccatccccaacgccaatcatgccacgctcatcactcttttcggtgataaaatccatgccaataaagcgatccaagatttcaataaaatcactgcggtcatcatccgtctcaaagtaaagccgggcttcttgaaccgtataaacgtttaaagaaaattggccattcgtattttgtgtttctgtctgttgaaaatcgtcatagtagctgggcgccgttgttgaaagcccattaaattgataacggtgattcgccaaatcggtgaaatataatttttgaataacttcacgatgtttactcatttaactgtcctcattaattccgacgaccatttttatggcaccacaatcttcgtcttactctttccctggccttccggtttcacttgtaactgatagggaatttgttcctggagcatggtgacatggctaatgatcccaatcatccggctgctgctttcgatgttttccagtgccgccattgccatgctcaatgattcctggtccagagagccaaacccttcgtcaacaaacaacgtgtcaatactgatcccaccggactcgctcatgataacttcacccagtgcaagtgccaaactaagcgcggcgataaaactttcgccgccggacaacgtatgaacactacgggtttgaccaacattaaaatcatccacatcaatttccaagccggtattcttttgataggaaccggcctctttgtgcaacttcaatgtgtacctgcctgaactcagttgctttaaatgttggttggcaactctgagaatttcgactaattgcgcccggagaacatagcgttccaaaccgagcttagcatccccactcccgttaaccgtttgaaccaataattgcaattgattgatcatttcctgttgatcgtgaatctttttaaagttccgtttaatccgcttcaaattatcattattgcgcagtgcctggtcatgctgcgcaccaaattgttttttcagctcgtctcgagttgttgccaatcccgacaagcggtccttttcggctgctaaatcaacgacttgatggtcaccaatatcctgccgatctttggcaataattgtctcgatccgctgaagttgctcatggtaatcctgaatggcctgttggtactgggataacctggctagttccggtaacagtgctgtaaagacagaccagtcttcggtttcaaaatgcgcccgaatagctgccgttaactcagtttgaactttaaccaagtcattgctggtattttctagttcctgattaacggtcttctcggttgcatgcaatgccgaaatcctattttcaattttttgaagctgctgattgttagcggcaacttcagcgtcgtatttttcaattaagttggttaactcggccactcgctgatccagggccgccaaatctttaaactgagtcggcaaacttcccttggctgattccaattggccggtcaacttttgttgttgactttgagcagcataataccgatcttgtgcttgcttagcggctgccgtattgacaactaattcttcttggattttggtttgctggttggcctcttcatttagcgctttgacagaagtttcaacgtccttactggttgcttggtaatgagcaatgcaatctttgacctgtttgatgacctcatttagttcagtctggtccgcgtcaattaacttttgagccgccaaatctcgaacggtgtcatcaaaggctgcttgatactgttgctgctggcggtctaaaatatcggtctgttctgtgactgacgcttgttgccgactcaaccgggtcttggccttttgcaggtcattttcagccgccttcatctgttcatctgaaacgcttggtaaatcagcgacgacagcgggattaggatgctccgggctgccgcagactggacatggtgttcccggcttaagctgactgaccaaattggcaatttggttacgtagccagttattacgtaactgatcataatcctgttgctcttgtgccacctgcactgtcaattgttgattctcagcttgttccgtttttatctgatcggctaaccgctgattgtccttttgatctttaaataaccgattaagttgcttcttggcactttccagattgttttgctcttgatttaatcgggtgagctgctggtttagcgctgattgctgtttaagatcgtcactaatctttcgatctcggctggtcaggtcatcaacttgagcctgttgtttttttaactcctgctgaagattggccgtcaccctagccgcctgcttgacttgcctttccagctcagtcgccttttcaaaagccggccgttgatgttgcaacactgatttttcagtttgccgttgactctggtcgtctttttgatcctgcaaccgggtttggctatccttggcagcttgttcgctaatcgtttgctgctttaattggtctgcattatcttttagttgcgcttgataatcagttatggttccctgtaatcgttgaaaatcatggtacttcggttggtaactttttacccacgtcaactgatcgatctgcttttgtaagtgctcatattttttcttttggctttgcaagtcagcttgcgttttcagctgctggtttaactcatcaatttttgcattcatcttttgatcgtcatttaatttttgagtttgaacttcaaccgcctgttgcgcgtcctgttgttgtttttcgagttgcttcaacttaaggttaacgtcactttgctggtcactaagcgcatcaatttgggcttccgtattttgcttttgaatatcttctggcgcaccgtccaaccactgaacagctgacaaatcccgagtaatcgcgtccagggcctcactggtctttgtattctgttgccttaacttgtcaccaagtgcatcactccatcgctgaaacagctgggtccgaaaaattcttcgaaggacaacttccttatctttactatctgagtctagaaagtgacgaaattcaccctgtggcagtaacacgatttgaataaactgatcacgactaagctgtaaaatatcttctattttgatgttaattaattgcagcttggtaatttcatcaattttcttatcagcatcaaatatcgctaattttcctttgctggcatattctttttggccttctccacgctgtttgtttcgagtttgcttaggttgacgatcaacttcgtaaacctttccctgatgttcaaatcttaaatcgacttctgtcggctgatcaggatcggcaaaatccgaacgcatcatgtctatttcacgatcattatttgtaccattaccatacagggcaaacgtaattgcatcaaaaatcgtcgttttcccacttccggtcttaccagaaattaaaaagaccgatgccgcgcttaatttggtaaaatcaatcgtttcattttcgtaagggccaaaattcttcagcgttaattttagtggtttcacgactattgcttcccttcgttagcgatcttcaaagcgtcagtggcccatttccgttgatcaactgtcaatggttccttggcgactgattcgtaaaaatggctcaataaatccattggatcctgcttgcgtatttgggcgccgctttctcccttgtagccgacaccggtatcataatcatcggtatgggctaatgaaacaatattgggataaattttccgcagactggttagtaagttaggaatgggcttgttatcagtaatggtcattccaaagaagttatcgcgatccaaaggctgatagaaggtcggatcagttaattcagcaaaagaagcggtcagccgctggacgtcacgcaaaggttttaacggtttaaaggtgagttcaaacggatcggtgtccacaatccaaacgcccttttgctgattggcttcggataaggaaaacttcacgggtgacccgctgtatcgaacttttttcgcgtgcagggcatcttttccgtgtaaatgtcccagcgcaacatagtcaaaatcctgaagcattgacaccggaatggctgctaaaccaccgacagttaacttggtttcggattcggtctgctcactgccggcagcaaagaaatgcgccaccaataaatgttttttagccggattaaattgggcaaccattttttcgacaattggtttaaacgcaagttccaacgtccgtaacgactcatcatgaaaatattcctgagcagcgaatggttcaaaatagggcaatagaaaaagttgtgtatccggtaattcaaccggcgtaaatgcctgttttaaatcagtatgcatataaaaatgtgtgtccttaaaccaaggcgttccggttgccaatcgagtcgcgctgtcatggttaccggaaatcgcataaatgggtaatttgtcagttaaattcaactgctgcagcattgcgtttagctgagcaacggaggattcagccggcagacttcgatcgtataaatcgccggcaatgatcacgccatcaaccttctcatccaaagcaatctgttcaatttgtttaaatgccgcttgctgttcttgggctaaatcaaagccgtgcaggcgccgaccaatgtgccagtcagcagtatgtaaaaagcgcatgtttatcatcctccgttcaaaaaatagtatctcaattatataacagttcaggggcttgttttaaataaattcacattttcaaaacaaccagagcgggacaaaaggcggttagcttccagagtgtagggggcttatccgaatattcaggatcagaatattcggataagccccctacacggccggaagttgccttttattccgcgttttcactcggtaacaatcgtgtttacacgaacagaggccgggataaattaattttgtctcagccccattaagcaaaaacacaccaaggcacttcttgaacttgattcgttctaaaagtgccttaatgtgttgaatagtaagtgacagttatcatcgtcatcaaaaaaatcgatttttaaaaactaaattatttattcacaacatttatcggcttaccagccaaataagctttcaaattatcaacggcaatgcccattaaccgttcccgaatttcggttggtgcccaagcaatgtgcggtgtgagataggcattcttagcagttagcaatggattgtcagcattaattggttcctgagaggccacgtcagcccccagtgcatacaatttaccgctatttaatgcagctgcaacgtcctgttcgtttagcaggccgccacgcgctgtgttaataataatcgcgccgtccttcattttagcaattgtctcctgattaataagatcagttgtttccggcgtctgtggcgtgtggagactaatcacatccgactgttttaacaattcatccaaagaaacctgcttgagccagtctgattgaacctctttttcgtgatgattataaaaaatcacgttcatgccaaagacacgtgcaatttgggcaaccgcctgaccaatatggccaaatccaataattcccaaagttttatcggttaaagaaattaacggcttcttccaaaatgtaaagtccgtgctggcactccattcaccatctctaacagcttgtgcatgtagcccgacttgattggtaatttccaacaacaaggcaaacgtgtgctgagcgacggcatccgttccgtaacttggaatgttggtcacaaccacgttattatccgttgcggctgataaatcaaccacgttaaatccggttgccaaaacgccaatatatttcaatttaggtgccgcgtcaatcacctgtttatttagagatgtcttatttgtgagcacaatttcagcatccccaatgcgttcgacttttttatcattatcgtcatcagccgtccgatcgtaattggtaaaatcacctagtgctttaaacccatcccagcttaaatcaccaggattgagtccgtaaccatctaaatcaacaatcttcataagttcgtcctccaaatattatttgccattagtttatcacttgtcacccttcttcggctttcttttaagcttatgatccaaaatttttcgaattctgagcaaactttcttcatattatttggacgatgatcagccaaattccagtctgccagttctttcatgacttaacgtcaactataaccaacaccatttttacgatttgattgtgaatttggatataaacattcaaacattattcacggaaaatcaataagtcttttgtaaaatcaaatcagaataagaaaaggaagtgacaaccatgaaaaatcaacaaacgccacctaagaaaacctttaagatgccttccgcatataccattctgtttctgattattatcttcgtcgcacttttaacctggatgattccggcaggccagtattcaaccgacaaagcaggtaacattatcgcccacacttatcgggcggtggctgctaatccgcagggaatctgggatattttttccgcacccatttacgggatgatcggtaatgacaaaacagaaggtgccatttcgatttcgctatttattttagttatcggcgggttcctgggcgttgtcaatcaaaccagagcgttggatgatggtatcgccagtgttgtggaaaaatacaaaggtaaagaaaagatcttgattccactgctgatgatcctgtttgcactgggtggttcgacctacggcatggccgaggaaaccattgccttttatccgctgttgattccagtaatgattgccgttggcttcgattcactggttgccgttgcgattgtcctggttggctcacaagttggttgcttggcgtcaactgttaacccgtttgcaaccggagtcgcttcacagaccctcaacatctcaccgggtgatggcattctttctcgaattgtccttctggttattgttgtgattatcagtatcctgtatgtttatcgatatgcttccaagattgaaaaacaccctgacaagtcattggtctttgcgcaacgtgaagaagatctgaaacgctttgcgctgaataaccgggatgaagtcggcaccaaaatgacaactcgtcaaaagctggttctctggttgtttggcattacattcttgatcatgattatggggctaatcccttgggaccaaatcaatgaaaaatggacattctttgtcagcttcacaaaatggcttcagggaattcctgtccttggcagcctggttggttctcatttagtcccatttggttcatggtactttacagaaatcacaacgttattcctattgatggcagtagttgtaatgtttgtctttaaaatgaaagaatcggcctttgtgacatcatttttaaatggcatgggcgaattcttgggcgttgcaattatcgtggccgttgcccgcgggatccaagtgatcatgaatgatggtaacattacagccacagtccttcactggggcgaaatgggactttcaaacttaaactccgctgtcttcatcactttggcttacattttctacattccaatgtcattcctgattccgtcaacatccggtttagcagccgcaaccatgggaattattggtccaatgggtaaatttgccggtgttgatccaagcttagtcgtgactgcctatcaaagcgcatccggctgggtaaacctgatcacgccgacatccggagttgtaatgggtgccctggcaatcgcacatgttaacatcacggtttggtggaaattcatgtttaaactcatgatttacctactaatcacaaccatgattttcctgagtgtgctagccttactgtaatgacgcaaaaccagccactttttataacccgttttaggaggcaattcatatgacaactattatcactgaagtgcagcaagccgccgttaaagctttaaaaagactaattaatcagccatccgtttacgatgaaccaacaattactgcgacaactccgtttggaaagggaatcgacgctgcgttaactgaagtattaacaattgccagtgagaatggtttcaagacctataaagaccccaatggcaactatggttacgcagaaatcggaacgggtgaacaaatttttggcattatcggccatgtcgacgtcgttgctactggtgatccagacgattgggatcacgatcccttccacgccaaggtcattaacgatcacatttatggtcggggagcccaagacgataaaggtccgacgatggctgccatgtttgcggttaaatcactaatggatcaaggataccaattcaataaaacgattcgctttatttttggaaccgatgaggaatcactctggcgtgacatgaaagtttataacgccaacgaaaaaccaattgacctgggaattgccccggatgccgagtttccgctaatttacgcggaaaagggattggaacaggcttacttggttggacctggccaagctgacttatcaattgacttacagggggccttcaatgctgtccctgccaaggcaagttacaacggtcccaaaactgctgaggttaaacaagcgttagatcagcaaggctttgactatcaagaccttggcaccgatggtctcaccgtgattggaaaatcagtgcatgcgatgaacgcaccacagggaactaacgcggtcctaaggttggcaatggcattagatcaagtttttccaagccagccacttgattttcttggtaaacactttaaagaagacgccaccggaaccaatattctcggtaatattgaggatcagcagtcaggtcatttgaccgttaatatttccagtctcaaaatagatcaaaatgaaaccagaatgcaacttgacatgcggattccagtaacaattgatcgggatgagttggtcaaaaaattggcaaacaaaattgcaccatatgacctgcactatgaaccctatgattacttggcaccactctatgttccaactgacagtcacttggtcaaaacgctaatgacagtttatcaagacatcacaggtgatcaaacaccacctcaaatttctggtggcgccacttacgcccgaaccatgcaccattgtgtggcatatggggcaatgctgccgggaactccggatttcatgcatcaggtaaacgaaaattgggcgttggaatcaatgtttaaagccatgaaaatttatgctgaggcaattaaacgactgtgtgttgatgatgaataaacgcagatcaccgtcaaactaaatcatgatcctgtaaattagtaattgttcgctgattttacagggtcttttttacttgtcattaaccaaatagttactaatgacaacctaccagagaacattcagaccaattttcatcaatatgcttaggtaccgaaacaaaatcgttgaccttttatcttggaccagctatactactcattgttaggtacctaagcaaactaacagagtcgtttgaatgagccagtttttctacttgaaccagctggtttgttcaaccgcatcaatcacgaaggagatttttatatgacagacaaaaatgagttattacgaaaaatctttggtttccttcacggctcacaacggctagcccggcattcagctcgaccttatcaattaagaggccagcaccgggtattgcacgttttggctaaagaaggtaccttgattcaatcacaactagctgaaattctagatattcgaccatcatcactaactgaattgttatccaagttggaagatcgcggcttgatcacccggacccctgacgaaaatgacaaacgagttaccaacgtttcattaacggatgaaggaaaaaaagcaattgaaactgacgaaggttcctcagatgacctgattaattcaatttttgacggcctttccgatgaagaagtcgatcagttaaacacattgttcgataaattaaatgggtcactcaaagccaaacttcctgatcgcgatgatcgaccagacggcttccaccatcaccatggattcggtggtcctcatgggcctcgtggccgtggtttcggcggtcccggtcctcatcatggccatggatttggcggtccaagatttgttattttcagatagcttgtcttaatattgtccaaaaacaccagagtggaccagcaagcggttagactccagaatataagctccctaacttaatattcctgattttggaatattaagttagggggcttatatggccggggtctgcttgctgggccacgttttaaccaagtaacaagttcaccggaatattcccgattttggaatgttaagttagggggcttatatggccggggtctgcttgctgggccacgttttaaccaagtaacaagttcagcaagatatcctgaatctgaatatttggctaattcgattacatggccggaagttgtcttttgtccgttctcactcgggaatgatcatgattgacctaactgagaggctggtgcaatcgtcaaaaatttatattaaaacgttcttatcccaaagtggaaatcccgtcaaatcagcgttcttgtaaactgatttgacgggatttttttaaaaataatattttttcgacttatgtcccagtctcgttttttaatattgtctaacggatgctagttccctgttaaataattactttgaaaaaatgatgttattaattccaaataagttaagcccatacattatcaccataatcccgttcacggcggttgacgctatgataattgagtaaggaatggttgccttgaaaataccgaatatccaaggattccggtaacgtttacccttgtatgagaaacaaaatcccaactgaatcaacgtcacgataatttgtaacccaatccccaaaacgtaaataaatggtgatccaaaatgcagctgaaagaaataggcgcctaacgttaagcagtcaagcaatatggctaaaaatggcatgataactcccctaattttaaaattggtattccatatactctgcgccagctaagggattaaaccgatatggttgaatatttttaaaaccggcggcttcataaagtttgatggctgattgcattttatccagcgtatccaagcgaattgactgatagcccaaactttttgcgctgactaagatgcgagctaccagctcctgaccgatccccaaatgccggaaagcatcccgaacgtacaatcgtttcatttctgcaatgccgggcttaaattcatgaacggcaaccgaaccggccagttggtcacccaccgtcgccaaaatcaagtcaccctttggtccactgtaccgatcgggtaaggcctttaattcaacggcaaagtcttgaaacccaaggtcaagatgcatcacttttgaatattcaacaaacaattccttagctgcctgaaaatctagtgaatgactagcatggtgatacatcacttgtggttgatttgattgttcctgcatacaaaaacctcctgacatttagcgcatattttaccgcaatttaattctcgttgcaaaagttgataaatgacctaaattcagttagtccttgttagcctttgaagctttttgcgaggcctcatgaagcttcttatccaacgccaatttagcttcatgttctttttcactggcagccttctgcggcaaaatcagattcaaaacaattccaataatagttgcgaaggccaaaccggtaaattggaaactcttaatttgcagataagcattcccaacaccaatcaccatgaccgtcgacgcgatcatcaaatttcgcttcacacccatgtcaattttattttccaccataatttgaatcccggcggtcgcaatggttccaaataataagaaactaatcccaccaataactggcattggcatctgcataatcagcacgttcaacttattaacaaaggcaaacagaatggcaaatccggccgcacccattaaaacgtagacactgtgaatcttggtgatggccataacgccaatattctcaccataactggtcatggcaggtgccccaacaagtccggcaaataatgaggccgcaccatcaccagccaaggttcggttcaaaccaggatctttaaagaagtcgcgaccagttaattcatccaataccataatgtgccccatgtgttcagtcatggtcacaaaggcaatcggagtaattgataggatcgccgcccaatcaattttgaaatgataggataatccgggaatctcaaaggctggcagtttaaaccacggagccaccgcaatggcatgaagatcaaccaggccacaaaagacagagatgatatacccacagacaatcgccaacagtaccggaatcaatccaataaaacctttaaacatcatattaaataaaatagctaaaaataaagttgccaaggcgacgccaaagtacagtaaatgatactgctttgtatttcccatcatggcatcattagcggcgctaccagccaaggataagccaatgaccatgacaattgggccaacaacaatcggtggtaaaatcttatccacccaatccgatccaattgcccagataattgttgcgacaatcatataaacaatcccgacaccaacaattccttgaccgacagctgaatatccagttgttttcattagtgaggccatcggaatgatgaacgcaaaactggatcccatgtaagctgggattttgcgttgtgtaatcatgatatgtaataatgttcccacacctgaagcaaataacgcaatgcttggacttaacccaacgatcaatggcacaataacggttgatccaaacattgaaaacatatgctgcaacgataagccgacccacggccaaaacggcggcatatcgtgaatgtccaaaattgcgcgatcgtcatgaaactcatttttatctgccattaaattttgccacccctattatatttttaagcttcgatctcaataacccgctcaaacaatgactcatcatttgaaccagaattcttgggaaaagtttaattttgctaatgaatctttaaaccgaaccacagtgacggcaaataaaaatccaccatccctgtctgtccagccagtaagatgatggatttcaacccaaaaattgcctgggttaatttcggactcttactggcctcacgggaccagagttaaagattcattaatagttactcattattatagtctagcccgaataagaagtccatgcagttaagcattgtttttgtctatcgaaatcgttctggactaaccatgtcgattcgaaatgaccatttccatgtcgatatgaggaatgtcatcttccaaatacacgtcgcttacgtcatgaaagccaaatgaatgatagaaatctttcaaataagcttgacccgccaacacgatcttgttagtgtagggtattaatttaattgcttgattaattgccacttgaatcagataccggcctaaccccgcttttcgaaaatcaggcgccacaatcacccggccaatccgagcaacggtttgatttttttcaggaattatcctggcatatgccattaaggatccgtcgtcatcctgcagcattaagtgaaacgatcttaaatcgtcaccatcaacttcttgatatggacactgctgttcgacaacaaagacagccacccgcaactgatagattttaaataactcctgtgttgtcaggcttgaaaagggtttaacagtcattttaggtttaatcattcttttctttcctccatccaaaaatacaagcatttggctttctgttataatatatgcaataggattaacgtgcaacaagaatacaaatgaggtattaatgtgaataggcatgacaatgaaccacaatataagaagtatgatttcaactctgagcaaacgaggcgccgacgacgtaagaagcaatacagtggctggtggtttgcccttttgattctgctaattgccttggcaatcgcgttttctgttaactggtttctaactcggggcgatcaaaaatcgtccagttccaacaacgcgtcatctaccatttccaaaaccatcaaaagatcagagcagacaatcgaaaacaaaaaatccaagggtgctttgaccaatgatgtggagaaaaatcgaattgccgcctttaattctaaattgaagcaggcggacaataatgggattacatcccagcaacgccaacaattccagcagtcaatcaaccaagaggtcaacaaaactgtcaaatcccgagaacaaactttactcaacaacgtggggacaaggcagccagctaagccgagcggccccaaagctaaaaagaacaagactgcagatcaattttcagcaaatcatacatttgcttcggttcaggacgccaaaaactgggcaaatgccaccaagcagcagtggctgaaagcaggttacgtgaattacaccattacttctaacagccaaggttactatatccttcaatttgtaaaatgacaaaaacaattaattacatttaacggcaaagtggcataatatggaagtggggagggatcaacacatgaaagttcaagtaccgttaacaaaaggtctcttagcagacaaatacaatcaatacgcttcacctgacaacattatcgatgataagccaatcgtttcatttccaattcaaattactgatgtgccaaaagaagcaaaatctttagcattaactttgattgactgggacgccatcccggtcggtggctttgcctggatccattggacagcagccaatatttcaccggacgttaccgaaattccggccaataatagtcaaacgttaaaagtcccaatggttcaaggtcgcaatagtactgctggtggtttaatcggcaatcaggatccaaaaacggcttggcattacaatggcccaaatcctcctgataaagttcataattaccacctatcagtttttgcgttggattcaaagttaccattggaaaatggtttttggttaaacgaattacaggatgtcatgcgtagccatatcttggcgactgcggagtttattatcccatctcgaaattagtgatataattaacataaaattaccgcaaagggaggccgcttcattatggaagccaattacaaaaccatcctggtaccagttgatggatccagtcaatcagaagacgcactagcaaagggtgccctgattgctcacaacaacaacgcccacctagatgttcttcacgtactcagcacaactcaatatggttacaattacggtggcatggtggatggtgacgtcatcaacaatttagttgaagacaccactgactatttgaataaactaaccgatcgaattaagaaagaatctggtgttgatgacatcagcatccatatccgattcggcaatcccaagaccgtcattgctttcgaatttccacgcgatcacaaatcaaatttgatcgtcatgggagcaaccggcatgagccgcctgcaacgggtgcttgagggttcagtttcatcattcgttaaccgtaatgcccactgtgatgttatggtcattcgaaccgataccaatatgaaaccatacgcaccatttccaaagaaataaatgaagtttcaaagagcaaaaggatcaggacaattaaattttgtcttgatcctttttgtctcttcgctcagatcgctattttccatacagtttaatggcaacgtaaaaattgatgaagagcattccgattatgaacagcaccacaaaagcacaattttcatcatcgtacgttgatggtgaaagcagcccattagaatctagtgcaacccagaaagtcaactcatatatccaaaaattgcgattttctttcatcttttcccatcccatatcaagcctcttctgattaaacattttgtcaccttcttttgagatagatcaaaatagtcctgatagaaggaagaaactggtcgttgtactaaaaaatattcttaatacaaattcagtgatgtgattgaaattatcttgcaagatttacttttacgatagtaataaatcgatcacaaaaacaagcaacgtctgttttacgtcaggttacatcatgtaatttgaggcaattatccgcggtcaacctgtcattagttttcggtttgcgttctccagcatttgtttaagggcataaaaagatggcagcctaggcaaactgaaatttgtctggactgccatcttttttcattgctcaataatacgttgccacctgatacatctttttaacaaatgcttttggcgtcatgttgcttggatcttgattctcaaagacaatcgctaaatgataattaccagtcgttgcaaaataacccgagtgataattctgcccgccaaaggagccattattgtattttacgcccttttgcgtcacgtacagcccaccggaatagaccgacccatagcttaacaattgttgatattgctgagctgtcagaatcgccccgttttggaggcccaaaataaattgataatagtcgctgggagttgttaataaattacctgctcccggaattgccgacagtcttggcaatgaagccgtctgataacttgaatagtctgtttgaccattccttgtatagctgagtgcaattggggttgaaggtgctttgccattatcaacaatgaacgtatgcgtcatcttcaccttattcaaaattcgggtctgcaggttctgggcataagattgcttggttattttggcaataatgcctgctaacaagacataatttgcgtcgctgtaatcaaacgtcgtcttcccggttgcattggcccgcttaaccatactggcataggcttggctttcagtcattgccttgctaggatcaatatccacattgtctaaccccgaagtcattgacagcatttgtttgatggtaatattactgctgcccttaatttgaggataaaaattgcttaacttggtcgtaggtgttagttggccacgactgattaactgttgaatcattgcagccgtcatggacttttgcagcgatgctaaaggataaacgaccgagccattgctggtattggccaactttttggtacgattagcaaaaccattgttcacgataacggtgtgtttactgcctgcagaagccaacaatgcacttccactgacatcattctgcttcatcgttgcattagccacctgtgtcaaagttgcttttttgagtcctttaatgttcatccaaccgatcgtttgattgaacaatcttaacttcgcataagttcccgtcttggttgtctttgtctgcatcactctgacataatcatttgaatagttactgctattgctatcagctgttcgtgaactagaactggtgaaataaggtcccgaataataaatcggataaccactcgttttagacggtttaacaatctgggcgtcataacgctggttactgatcttcaaaacgggattgtaccccgccattaatccatgaattgcaaatgatccggccgatagcagtccacataaaaaaagcagtaacgttctttcaatcttggctctttttatcatgataatccaccagctatcgttttaatcaaaattcgtatctgtctgctgccatttttttgaataaaaattcttattaatgacataatgtggcgtcttaatctttttcgttaaaaacgggtcaatggcttgatccattttcaaccatcctcgccaacccggatgaatggtatcgctcatgaaatagttaatgttgccatctcgacttaaatcatcaatatggttaaatccttgagaacgcaattgatacgtcacttttttatcgaactgcgccaacatctttgctgataatccggtgtatgcttgccaccgtcgattaaccggtggaatcacaaacaaaacattggtgtggtctttagcaaattgatttaaaaccagttgaaagtcaccatactcgggtgatttaaggaagctcatttgcgactgaaatccctttaactttttaacatgatgtttgagccgtcgattccaaaattgattattaatcagaaagcggtttgaattggtttgacgtttaccaatctggccagccaaccgatccagccgctgattattatccgtctgggggagttgcttggcatccttagaaatcgtcacggcattgttagcgggaattctaaaacgagaatagatttgatcctcatttagcagcacctggtgacgatagttaatgtaaaacatctgtgatgacgttggtttaagccctgccgcaatccttgccaaagctgaagaaatgattttgtcagaattccctgaaggcatttgcagtagacgataagcggcgtaacgatccattttcgatccggtttctgattggatccaactcgttgcttgtaatggggagtaataataggcaaatgcattaggatcctcccccatcggaacaaaccactgtggtgaaatgaaaaagatcgcctttttgttccgcatttgatggttaattgactgcatgacaaagaattgcgtgagtgactggcttccccgagcaccgagtaaaaatggtcgatatgatcgatgatacttggctgcaagcacagacggatgaaatgggtcaaaccgcgaccattctgaagaaccgaaaaatggcacatagtgattttctaatgcacttcgtttgataagttgtccttttaagaccaatggtgataatgaagcagcggcattcctctgaactctggggttaacataattgaattttatccaaaacggtgacaaaaacacggcaaacattaacactgctgcaaataaaattggcccaaaaatttcaaataaacgcttttttattgtcattttgtcgcttcaactttcgcaataatttttgctggtgtgtcccattcagatcggttgaactctgaaattggtgcctcaacccctaacttatcctgtaaatccaatagaagcgaaacggtccccattgagtccaaaagcgcgctgtcatacaaattttcatctagtttagttgaaaaatcttcacctgttaaatcctttaaaattgaaagtaccgtttcttttacatcatccataatttccagcccctaacttaatttagtatccaaatcaaaatttacttggtccaaaaaatagcgtattgagaaatcctgagaatatcaggaaagtgaaacaaacaaagttaaatgtgataaacgttgcaaataactccgtcaatttattatgtggaatcttgtcacgatgtttcttcttgtagcgcagccaagtatcattaacgactaacgcgcatccatgaagtaagccatagagaatgtagaaccacgtttcaccatgccagaatcccataattaacatattaatgatgtagcagacgttggccgttgtgatgcggctcttaaatgtcttatgcttcatcataaagaagaccagccgcataaaaatgtaatcacggaaccaaaatgacaatgtcatatgccaacgattccaaaagtccttaatgttcttcgacttgaatggttgattgaagttcatcggcgttttaatgcccattaaataactaattccaaccgcaaacaagctatatccggcaaagtcaaaaaacagatccatactgtaaacatacatataaccgacaatgtaccaagaaaatccgtgggccatcaacgcggcaaactgaatttggggcatcaataccgttccgaaaaaatatgccaaaacaaatttgtaaagaaaccctagaaaaacatagtgaacccccgtttgaaccaaatcaagataatccttttgagcggggacattctgataatcacttacaaatcggcgatatcggtcaatcggtccagaggaaattgtcggaaagaaaagcaagaactgggcaaagacaaccggatggtaatctttgataatcccatctcgggtttccataatcgtttgaaccactttaaacgtaatataagaaatcccaaggaaaccaataattgactgtttcccagcttgaattgcaggtgtcaccttcacaacaatcaatggcacaatcgctaaaacaactgctaagacaaacacccagcccttattcgctgatgattttcgttgccgataatgagaataagcgccaaccaacacaatctgataggccaggtaacaaattagtgcgatccccgtgtgccaattaggaccaccaaaagttaatatcaaaaagaacagtgaaattaaagtctggtaccaacgaaatcgatgcccatatagcaagccaagcatcaatggaattaatgcgacggcgagccaaatgaagtacgttggatttccatacggaatataccatctcattgcgaattagcctcgttaatcattgatttaatgtcaatcttaccgttcttgcttagcggcaatgatttccgataaataattttttggggaatcatgtatgacatcattgattcttttaaatcgcgcttaatagccgccgttaattccagctcactattaaagtgattttcatttggcacaatgtaggcaatcagcaccgatacctgatgttgcgcattgtactttggaacaactgccgtttgcttaacgtacttttgttttcccacaagaattgcaacatcttcaagctcaatccggtagccattcattttaacctgaaagtctcgccgaccaaaatactgaatcagcccatcttgccgaatcttggcaatatctccggttcgataagcattctgaccatgaataattgaaaaagccttcttggttttttcaggattgttgatatagccgttgtgagaaacactggttccaaaaatctgcaattcgccttgagatccatccaaaaccggattgccatcatcatcaataattcgtgcgtgcatccccggcatgatataaccgatcggcagccgatcaaactcattaatcatctcattggtaatttcaacttgagtaatcgccaccgtcgattcagttggcccatacgtgttaaaaatatgtgcctgaggaaacttttgctttaacattctggcagttctggtcgtcaactcttcaccacaaaataaaaagtgtttgagttgcggataattagttgaattaaacgaaggctccaataagcaaatgttaataaacgaaggtgttgatacccagacattaattgataaggttggcaatgctgtaaagagaaccagaaaattatcagtcatctttttggacaagacatgcaaggtgccacccttaaacagtgttgggtataaactcatcaccgataaatcaaacgagtaggccggttgctgcagcatttgcaaattttccggtaaattaaagtcagtgccggcaatccaggtcacaaagctcaataaattattgtaactaatctcaacacccttagggacacccgttgttccagaagtgaaaataatgtagaacgtttgatcatcgcttacagcgtgagtcacctgataatcaaccggttgttgaaatatgtcactaagggtcggcgctgagatcactggaacttcacctaaattaaccggtaaatcatcaactgcaatgactgcgaccggttgcgcaatcttattaatcaaaattaatcgttcatccggtgaatcaacatcaaccggaatatatgagtgtcctgacttaataaccgcaagaaatgttgcaatcatggcaaaacttttatcgccaaaaactaaaattggtcgattatttggcagcctcatctcgtccagatgctttgccaatgcatctgagtagtgctttagatccaaatacgtgtttatttgatcattatagtggtagacgacgtcatccggtttagtcttagcgtacgaatcaataacgtcaattaagtctgttttcattttcttccccctcattaaaaatcgttgtaaatgaacttcgcttgattaatgccgctataatcatacaagtaaaaaagaaccatcataatagcaaaatagaacagtgttgttaagataaatttcacgataggtcgttgaagccactgtattaagaacatctgcatcccccctaaaaatagttgtcatccattttcgagtcaaaaatcatccaatcttctttcgactacaaagatttcaactaagttaatgtccccgccatcacttggtcatataatgtttccgccaaattctggattgaaacagccggccgataattattagttaaaagaacgacaccagatttaccattgtgcgattcaaacagagatgattcatacccataaccaattccatgtgaacgaatcccattcggttggttataaacaccgccgccatatgtcgaagaactgccaggcgtatgaagggtcctcacattacgcagcgatatcactttcccacgcagtagataatgctctgctttaaataactcaaatggcgtcatataaacttgaccggttccaagttcattaaacattgaagcacgaggctcattaaaagctttttgataattttggctaacctgtgtttcttttaggtagcgatatcccgttgtttgatagactgtcaccggctgatcttggacaaacccagtgcctttaagatgcatcggcttagtgaatacctgagaaaaatactgttgataacttttatgagtcaatctggcaataattccagccaacaaaacgtagttaaccggttgataattccatttgccaagattggcagctttactcgatagatgcttaaccgcatagtcaacaacctgattctctttgagaactttatttgaaccaagttgtttcattgcaattcccgaatccatatcaagcaaatttctaatttcaatctgcctggcatttggaattgatggataaaaggtcgccaaccgagtcgttaaggacaggcgcttttcttggataagtttcatgacgcacgctgccgttaacgatttttggatcgacagaatttgaaactctgaattggttcgattctttacccggccaagatagtttgcatatccaaaagccttttgataaatgagtcggtcatttctgataataagtgcagatccgacgaaatgattttttcttagatatcgtgttacgttattaaccggtgaattggaacgattaagatctcctttttgtcgttgggaagtcgacgatcgattattatttttcgaatgatcactcgccgaccgtcgatcacgcgccttctcttttgctggttgccgaacaaccgcttggcggacatgttgtgaatctaatcgccaaaccgtcagcgcaccaccgacacaaataattgtcagaatcaataagccggatgcccaaagacgtccccgtttcatcaaatcccccccttattaagatatgtatgtcacaaatctgaagtcgtccgtaagattgatgttgcagtccacatggtccttggtgtgaattcattaaatgtgatatttgccattgtcaattcaaactaccggccaaatcaatatggttcccaaggtacgccaactttccaataaaaggcaagcaacgaatactttacatcggcttacattgcctgctattaaagcaagcataaaaatggtttacgattcagtggttctcggtttccgataccaatcacctctttttgtaaacgaattcacatatttttccatattgtaatcccctaatagcctgttaacaattaattaaacctattatattctgggagctttcaatgacaatctcttcctcaaaaatgccccctgcttttagataagctttagtatctttcgtattccgttaaatattttttcctgattaggaatcatttaccgtaaatacataactaaacaatgaagttcaccattaaagttatccaattttcaaattggacgtttaattaattgatcttcttagatatccatgtatgattaaactaagaatgtgaaatcgctatcattatgagaatcatcgcggtagtttataaatcctttaggaggggtcaaccatgaaagtgctagttatcgggggaattgcgggcggaccatcatttgccaccaggcttcgtcgaattaatgaagatgccaacatcattttatttgaacgtggctcgcaaatatcagttgcaagttgtgcattgccctactatcttggtggcgtcattaaagatcgatcggcagtcattgagcggacaccagaaattcttaagcaaaagaacaatatcgatgttcgaatctttaatgaggtcactgccattcatccagacacaaagtccgttgacgttaagaatctcagaaccggcgaaacttattcggaagattatgacgacttattaattgctaccggcgccagtccaaccgtcccgaatatcaagggattagaagatgccgacaacgcatttgtactaagaagtatggatagtgctgacaagatcaaacactttttagacactcagcacccgaaacatatcaccatcctcggtgctggttcgatcggtattgaaacggctgaagcatttgttcgaaacggaattgacgtcacaattgtcgaacaatcggctcacgttgctgcgccgtttgatccggaaattaccgacattgtcgccgaagaacttcataagcacggtgtccacgtcattctcaaccaaagtgttactgaggtccaatatcacggccatcaggttgtattgagtgacgggtcaagtcacccaactgacatgctctttattgggactggcgttaaaccaaacagcgagatcgctgccgcggctggcattaccttatctgatgataaccacattatcattgatcatcacctgcaaactaatctgcctgatgtttatgcgattggggatgtcgttgaaaccaccagtttaatcaccgggctgccaacaccaagtctgctttcaagtgctgctaatcgtcaaggccatttgctggccgatatgcttagtggcaatccatttgaaactgagtacaaagggtttattggcgcgggagtttccaaattttttgatttaacagccagttatgtcggatataccgaacagtcgcttaaacaattaggaatcacaaactaccaaactgtctttatcacgccattcgaccacgcttatttttatccaaatgccgaccgggtaaacttaaaactgatttacgaaaacaaaaccggtaagattttaggtggtcaagctgtcggccgaaacgggattgataaacgaattggtcaactttcagcagccatcaccggaaacttaacggcatttgacctgcctcaattggaaattccatactcaccaccttactcagcaacgcgagacgttttaaatattgccggctacattgccattaaccagcaaaccaaccagtatgaaacggtcaacgttagtgatattccggccgatgatttgaccagtgcgactttccttgatattaaggaacccggaaagtccaccaccggctcaattaccccaacgctgaatattccactctcacaactccgtgatcggatcaccgaaatccctaaagacaagaaagtgtacatcactttccgaaaaggaatcggtccctataacgccagcacaattttagctggtaagggttatcaggtcgcgatgattaccgaataattttagacctcaattaattaatcaagcatccaggtatgcctaacgaacttaggatatctggatgttttatgattcaggcaaagaaccctaccatttttcagtcacataactcggaacatttgggaaccacgattcaacgatgatgccaatctggcagactgaccacagcctcaggcaattttaattttcttgcaatttctctcatgcttggctaaacttagctgtaacactgaatggaggaacaacatggattctaaacatacgacaaaaattggcctgtttcagctggtcatgctggcactggggtcactcatcggttctgggtggctgttcggtgcatgggaggcttcaaggatcgccgggccggcttcgattatttcctgggtaattggtggcttggtaatcggcgccgtcgcttacgattacgttgaaatcggcgcgatgtttccagaagccggcggcatgagcaaatatgctcagtactctcacggctcgttactcggctttatcgcggcttgggcaaattggatttcactaatcaccttaattccaattgaagctgtcgcggcggtgcaatacatgagtacctggccgtggtcatgggcaaactggactcaccaatttctacataatggggtaattaccaatttaggtttactcgtcgtctttggcttcatcctgatttttacgcttctcaattattggtccgtccgggtcttaaccggattcaccagcttgatttcgatttttaaactgggcgtcccaacactaacaattattatgctgaccctctccggcttttatcctcaaaactacggcagctcaatccacgactttatgccatatggcaccgcgccaatttttgccgcaacttctgtggcaggaattattttttcatttaatgcctttcagactgtcattaatatgggaagtgaaattaaaaattcccggaaaaatattggccggggaattgcgatctcactcatcatcagcgggattatttatattattttacaaagtacctttattacatcccttgatccggcaatgattgccaaatcgggatggcacggcatccaatttaattcaccgtttgctgacctcgctatcttactgggcattcactggttggccgttttattgtatatggatgccttcgtctcaccatttgggaccggtgtttcattcgtggcctcaaccgccagagcactgtacgccatggaaggtaatcaccatatccccagctttatcggtaaagttaacaccacctatggcattccgcgggttgctctgattgtcgatacctttctcagcatggtcatggtctcgatttttcgatcatgggctgttctggcaaccgtgatctgtacctcaaccttaattgcgtatttaaccggccccgtcactgccgtttcattcagaaagatgggaccaaacttcaatcggcccgttaaattaaaacatcttagttggatggcaccattttcttttgtgctcgcatcactggcaacctattgggcaatgtggccaacaaccatccaagtcatcttggtcatcttacttgggcttcctttctatttttactatgaatataaaacaggatttaccagtacccgaaaagctttttggtcaagcttgtggatgattggttatcttatttttatttcggcaatgtcctatctgggcagtcatgaatttaatggtatcaattggatccattacccgtacgattttgtcgtgatcatcattgcctcgctcgcattttattattggggcgttcatagctggcaaatattcccggattattaccaagctaaaaaattaaatgaaacggtggttactgagaaggaaacatcaacaaagtagcagagtaagatgaaaaacacttctcgttctatatgtaagtcgggctgagacaaaagtgattttgtccagcccctatttttgtaatcacgattattaccaagcgaaaacgtgagataataggacccaaatcagtcaaaggagccttctagatgaaaaccgaacttgataaatgccttagcggcgaattatatgatgcccacgatcctgtttttaaacaattcaaacagacggccactcgctttctccacatctataacaataccaactatgatgaatccgataagcggactcaactcctaaaagaaacgttgggcagcttgggtgatgacgtatctgttggcaccccatttctttgcgactatgccagaaatattcacattggtaacaaggtttcaatcaacatgggttgcagcttgatggattccaacgtgattacaattgaggatgaaacaatgatcgcaccaaatgtccaaatttatacaggtaccccccctgttaaactacaggaccggcttaatcaggattgggagtctcaccgggaacaacactttatccgtacccgcgcgctaccagttcacatcggccgtggctgctggattggtggcggcgtgattatcctacctggggttacaatcggtgacggcagcgtgattggtgctggaagtgtcgttaccaagaacattccaaccaatgtggtagctgccggtgatccatgcaaggtcatccacccaatcgataactagttctctcaccattttctaataatttctttacttccctgctatgacaacgatcaatccaacacatgtgttttcaattatttgcattaatctatgggtttgttacactagttgtcattgaaaacaggaggtacaaatggattctaaaaatacgacaaagatcggactttttcaactagtcatgttaacactcggttccttaatcggatcgggctggctcttcgggtcttgggaggcctctaagattgccggtccagcatcaatcatttcctgggtcattggtggcctggttattggtgcggttgcatacgattatgtagagatcggggcaatgtttcctgaagctggcggaatgagtcgctatgctcaatattcacatggaccattacttggtttcatcgcatcttgggccaattggatttcattaattactttgattccaattgaagctgtcgcagctgtccaatatatgagcacgtggccgtggtcatgggcaaactggacacatcagttcttgacaaaagggacgattacaacccccggcttaatggtggtttttctatttattatcgtctttactttgctaaatttctggtcagtcaaattactaaccagttttacaagtttaatttctgtcctaaaaatcggcgttccactgctaacaattatcatgctgactgtttcaggcttttatcctgagaactatggtcactcaatccatgaatttatgccatacggttcagcacctattttcgcggccacttcagcagccgggattattttctcgtttaatgccttccaaacggtcatcaacatgggaagcgaaatcaagaaatcccgtaaaaatatcggccgtgggattttgatttcattgctcattagcggggttttgtatgtcctattacaaagtacctttatcacggctttaaagccttcaatgattgctgaacacggctggggtggaattgatttcaattcaccattcgctgacttggccattatgcttggcattcgctggttatccgttctactgtacatggatgctttcgtttcgccagtcggaaccggcgtttcctttgccgcctcaaccggtcgcgccctctatgccatggaaagtaatcagcatattccgagtttcattggtaaaattaatcaaaaatacggaattccccgagttgcgatgcttgtgaatctcgttctcagtatggtcatggtatcaatctttagatcttggtcaacgctggcaaccgttatttcaacctcgacattaattgcttacttgaccggaccagtgacggcagtcgcctttcgaaaaatggcgccgaacttcaagcggccggttcgcttaaagaatctcggctggatggctccggtttcgttcgttttagcttcactcgctgtttactgggccatgtggccaactacggtcgaagtcattctggtcatcttacttggcctgccattttacttctactatgaataccgggcaggctgggtcgacaccaggaaagccttttggtcaagtatgtggatgattgtttatctgatcttcatctcaattatgtcttatggtggcagccaccaattcaatggagttaattggatttcgtacccttatgatttcttggtcattattcttgcatctctggcgttttattactggggcgttaagagtgctcggatcttccctgacttctatcaagcaaaatcattgaacgatacggttaaggttgaggatgacgattagccattcacttattctgaaatttgatcggactaagagctgggagaataatcattttgcccagttccgttaatgtaaacacgatgattattgaataaaaatgcgggacaaaagacaccttccggccatatcactgaattatgcaactatctaaactcggaatatctcgttgaacttgttacttggttaaaacgtggaccagcaagcaggctccggccatataagccccctaacttgttacttggttaaaacgtggaccagcaagcaggctccggccatataagctccctaacttgatattccaaaatcaggaatatcaagttagggagcttatattctggaacctaaccgcttgctggtccactctaatcaaataaaaaagccgacgattgcaagaatgcaactgtcggcttttggcacatatgcgcccctgccaaggtgcttttatcatacaccaaaacttatctaaaatctggctaaatttgaattaaccagctaatcggctataatattaaccatcaacccgttctcgtactcaatttaaaggagtgaaccaattgaagaagatgctatcgatcctattagtcagtttatcgctaggacttgcttttctcacagctaatcagcaaactgccgctgccaattccgatacgacgattccaaccgcttttcgaggcacttggtatcagtacgccggccagaagcagtggaacgttaccaaaattactaaacattcatttcaaaattacatggcaaatagtaagaaacaccgaattagcagtaatctaattactgcgaccccatctaccagtggtgataataagctttcaattgccaaacataaaaccaaatcccgaaccgcttacacgttctttccagacaaaaataacggctatttctggatccaaaccgctaaaataaatggtaaaaggcaaaaagttttggttaactttacagtgcaaccaaagatgtcggtcatttcaactaagggccaatacacaaaagactacagttataactaaatcttgatcagtgggaaggagcggcacaaaagttgtctttctcgctatttttactagataacaatcatgattatcaagaggagttgggcaaaatcatttttgcctcaactcctctttgtttattgttgtaataacgattattgccaagtgaaaatgcggtaacaaaaaatcacgacaacatgatcatcaaccattcttgtcgtgattactaagtcgactctccacgatggattagcattaacttattggccaactttctcatagattaaataaccaacgtcgttcagcaaccgactaattcctaaccatatcaggttccggctgaccatttaaatcaatggcaaaccgaatcaagactaaactatcaggggtaaccggcaaactgtcaatatagacttcacgatgctcattgggccgagttcgcttataattaccttccttaattgtcttgtttaacacttggaatgcctgacaattttcgctcttaattggaccatggttaatggtttggacttcaataccttctgctaattgctcaaagtgtaattcctcacgatgcgtattcacaaaatggattttttccaaagctgccttgaaggcattttcatcaataaagagtggctgcttaatccaaattttaaagtcttctccgtcatcggtctttcgccaaactgcttgaaccgggtatggtacataagctttaaatccagaaactggaatatcttcttcaggtccaccactaatggttttggcaatccgagcagccgctttagccagtcgtagaaattcaggatcatcggtgtgtttagtggcatgtccctcagccgtaatgtaacttcgagtcgttagatcaacgaagtgggcgtgctcactcttactatattcatctggttcataagtttcccaattaaacattttcatccctcctccttgccctcaatttaaaccataacccctatcattggcaaataatgtgactgaaaatgtaatcgttatcattcaacttatgaaatcccaaatgactttaccgaagaaaatcaataacacgacaatgatgattggccgtgcaatcttgctgccatatcttttataataagctgcacctaaaaaattagccgcaacactaaataccccagctgttaagcccagcagcatgatgaccttaccgcttaatagaaagacgaccagtgcagttacgttggtggttaaattaatgactttggtattaccggccgctaaattaatcggcaaatgagcaacaccggttaatagtagaattaaaaaggtcccggtccccggcccataaaagccatcataaactcctaagcacaacgaaatgataagggtcaggataaactgatgaatttttaattttgtcgaatcagccaacttggaatttaacgcatgtcgatttaacaataagtatcctgccgttgccggcaaaacaattaataaaattaatctgaaataggtatcagaaatatgtaaggcaatgtgcgcaccaatcgtggatccgataattgccgccagaacggaaaaaaaggccagcttaacacggatatagccgctacgtgcaaactccgcggtcgaaataacagtgcccattgctgaagatagcttgtttgtgcccaccgcaaagtgcgcaggcagccccgccattaagtatgcgggaagtgaaatcaatccgccgccaccagcaattgcatcaacgaatcccgccagaaaaaccaatgggcagacaattagaaactcatgaagcacaatcgatcatctctttttaggttaatattttcattatatgcaaaaggattggtcaccacaatgaccaatccttaatgtttattacttttaattaaatgctactattatcatcattattaccgagcggaaacgtgcgccaaaaggcaacttcctgccacgtaaccgaattagccaaatattcaagcccagaatattcggctaatccgattacgctctggaagttaaccgcctttcgtcccactctttaatgtttgttacttttaattagatgttgctattatcatctttatcaatttaaattgttggcaacttgtttatgcttcctgcagtaatcctctggggttaaataaaccgagtgatcacctaatgccctcgttatcgtcataattcttggtggcagcaatcccacccgcttaaccagtcctgaattaccaaataaggctgaaggtgtcccggaaaaggcaatctgaccatgcgccatcacgtgaactgtcgaaaattcagccgctacccaatccatatcatgagtaatcgtgatcacctgatgaccactttttacaagttgatgaaaaatgttagtcattcgctttcgactgggccagtctaacgacatcatcggctcgtcaaacaaataaattgcaggattaatggccaaaaccgttgcaaacgttaataactttcgttcagataacgaaaggtcatatggatttgcagctgctttatcagctaatccaaccgcaaccaaagcttggtcagccgcttttttaatcatcaattgatccgattcaatttgagaaagcccccaggccacttctttttgaaccgttgcgttaaataattgatcatctggatcttgaaatgtcacgccaatttgtttcaactttgcctgtggtttcaactcatctattgaaacgccattaatcataatggtcccttcttgcggtgttatcaatccgatcagtaactttaacaaagttgatttaccagcgccgttctgaccaacaattgcggttagtggactgtcaaaagattgccgatcaatttccacctgaaatgagtgttctggataagtgtaacgcaacccactaatttcaatttgcggcataataagcctcctctaattgttgattggtaaccggaaattcgtctgctgcaccagggattgaccacttcattaattttgccaatcgaaacacagtcggttcagcaagctgccagtccggcttcagatgattaaaaacagtcagcggttttcctgccgcaactaactcgccagctttcagaacccaaatttggtcagcaatttcacagagatcgtcgacttcatttgacacaatgaagatcgtctttttttcaacactgactaaccaactgaagaaatgctgacgtccaagtggatccatttcactggtgggatcatctaaaaccaagattgacggatcagttacgattgctgtggcaattgccagccgttgtttttgtccgccagacagcgttcccggtgattgatttaattggtcgcctaaccccaactgatcggcaacattgaggactcgccgtttaatttgatcggctggaactccttgattaatgaggtcaaacgcaatttcatcggcaaccgtatcggcaagcccactcaattgaccagccggattctgcagcacaacaccggtttgctgattatacttctgccaatccagatttggcgataatgatccaacttgaatggttcccgttacatcacctgaaataattgttggtacaattccggctaatgcccgacataacgatgttttacccgcatgatgattaccaatgatgccaataacgtgcccaaattcggcgtcaaccgaaatatgttttagcgctgatgtttcaattcctcggtaacgtagacttaaattttctaaatgaatttgctgccgattatccataatttccacccaatcaatataattgctaatacactcaagccacgatgattaaccatttcgtgccgataaagatttgccgattttaatgccacccgacggggactattaaagccacgtaatcgcagggcaattgaccgttccattgattgatcaagcgttttgatcactaacggaaccaacactggtaaaattgatttaatcttttcaagaatggttttctgttgattaatgccacgtgcccgttgcgccatttgaatttttttcatgttggccatcatttccggtaaaatatagcaaaccgacatcaatacatagaccgctttataggagagaccgacctgctccaaatatttagaattttctgacactgtagtcgttgtcataaaaaagctggttgctaaaataatgacaaaaattcgacaccccatcgttgctgcatacaacagcccttcttgatagaatcgaatcccgaccactgaaaccaacagagtctgattgtgactgtaaaagaggccctgaataatcagcattgtaaaaattaagaatgagctgaattcaattgcgtgaaccgccgacttgccggctttcgaaatcagtagaatcactagcgcaacgaatacaagcgcaatttcaactaacaaattggtgaaacaaaagcttaataaggccagatcaagggccatcaataatttcgttaccggatcaattaccgacgtccagccacggtgagctaccgaaccttgtaaaattgaatttggttcattcattatttatcatccctgaaaaagcgaatcatccgctgtggcagttgccgatagataaagaatgccaagtaggcaacaacgactttatccaaaatgtccaaaataaattcatcagtaaatgatgaaatccaaaccggaatgtgattagcgatcatcgcagcgaaaattgaatcaccccaaggaatcccagtttgaccaccccaaaagatgacattgagtggtgttgaaatgacagcagatacaattgcaataataatagcggatacaaatactttctttgcggatgaaaaccatcccttggcgtggagaaccccaacggcaatcccaatgccaatactagtaattgcgtagaccgttgaaaccggtgatagcgtcaatccataaatgacgttattaataaagccactaattgcaccagccaccggaccagctaacatacttgccagaaaggtccctaatgtacctaaccaaaccggtaattttaacccttcggcaaacgccttggcaacataattaattccgactgctgcaggaatcaacgtcatcgttgctgttgacaaccgaatcttccagatacttgaacgcttaatattttggactctcaaaatccgcacctcatttgcttaattattttaaataaaggtataaatcacttttatttaaaagtaatttatacctttaatctaattaaaaacattgtacgattgttttgataaaagtcaagtcgactttaatagtttttgcggttgtgacttggtcttttttcttcttgaagcttatgttttgtttaatacggaatattttggagtaagctggctaccgagtctaaacgtgcaaagcagaagcaggccccggccatataagcctttcaatctaatattcaaaaaacaggaatgggatggctaccgagtctaaacgtgcaaaagaggagcaaatcccggccatataactaacttaacggaatattccaaaatcaggaatattccgttaagtcagttatattctgggatttaagcgctcctttttgcactctctacaacaccttatccccctccgcgatatctcttctcaatccctttgcctgccggtctctgtcatcataccagtaccacaaaccactcagcacaaagacgatgattccagtgacgattaattcaaccgaaaaactcaggattagatacagcgtgaccaaaaacgccaagatcggaattaataatccccccggcagcttaaatccttgcggtaacttttcatgctttcgtaatttaattgacgccaaaattgtcggaatatattgcacgaatgatgtaaagacaatcgcagacgctaggaataaataatttcctgaaagcaacataagcccgcagatagcacacgataacagtagtgacacgatcggcacaccacgtttgttctgatgtcccaaaactctcggcaataattggtgttcggacgctaacgagctcgcaattagcggcgttgagaatgaaattgataacgccactcccataatcgaaatcagcatccccaccaacgcaagatcataaccaaactgcccggcaaaatgatagaatgatgccgcaattgggacattatctgttgctaaatgactaccagagacgccaattgcagcaaattgtacaatcatatacaacaaagccgatgtcagtaaaaccgcaattaaggctttaggcagtgttttttctggatttttcattttagaagcggcaatcggcagaaacgaaaatccggtaaacatgtagaaaaccatcccaaagccttcattaaaacgaccgaacaatgggcttgaattggttgtcgcaccggttagatttgcaaaattggcatgtcggacaaagaataaccccgccaccacaaacaaaatcaacacacccattttggcaaccgtcgaaatattatccacccaatccataaactttgatccaaataaatttaaacaagtcaagatcgccaaaataccaagtgccacaattaaataatttcgatggacatcaagactgggaaagacacttcgcaaacttgtcacaaacgctgaaatttcggtggccattgtaatgatgcccagcaaccatgtaaaaataccgatttcaaaaccggcaaatctaccaaatgctgtatacgtatataaccaagcaccgccatctcccggaattttacttgccaaattggcaaaacacagtgcaatcattaaaactgccaccccggctagtggcattaacagcaagcttaaatcacccaatttggcataaatccgacttggcatcaaaaatattccggagccaataatgccgtcgacacctaacaagaaaacgcttaggaaacttaactgcttgattttcccagatgacatttcactactcccccttcagccaattttcaacccgattgtgtgatgtaatcggtatcacaagttgtctttatcttagcatgtgccaagaggcaaacgtagtaaaatgtcttcgataatgtggtgtttttagagaccctaacccatctccagaaaaagcttattttaaagatatcaactttgaagagcaaaatacgggacaaaaggcgcttaacaaaataatggctaacgaaagtcaatcagcaataacccaactaaaaagcaaacctcaataaacgtaatcgacaaaataccgccatcatcataaaatttattaaaaataaggccactcactgatttaaataagctatataaaaagatgagcgtatacacaccaaaaatgacgtgcattatcgagttactaatataaaacgcaccataaagcacaaatgagaatagacaaaatgcatcaacaagtccccataaataaatatttttagacgttgggtgaatgagtttgtccataattgacatctcctaagtttttggaattatcatcattataaacccaatcatttcgaaacaagtccaaagtccattgaccaacctgttcagcttatcatttaagaagtgatgatctactggtacaagtcggctgttttccgggaatcgtttcaagacagcaatacagaactgggaattctgcctgcaggtgctccttgacatccttgcacaattgatggctctccgtaaccgtcatttcaccggcaacttcaatttgagcatcaatgatcatattgtcaccagaatatcgactatcaataaagcaaaccttggcaatccgttcattgctcatcatattggccctaatttttgctcgaatgaccggatcgaatccatttgataatttactggcactggtgctaatgatctgagaaccattgtaaataataaagccctccagcaaaagagccgagactgtgtcaaaccaacgaattttaaatatgaccgccacaaaaatcgcaaacattgtgccaaacgaagttgccgaatcacttagataatcttttgcggctgctaatagagaactactcatcatctttttaccaatcactttattaacaatatattcacccaacattgttagtcctgaaagcagcgcaaaataaacagcatttcgactaactggctgtccatgaccatgaatgatcatgattaaatgtaaccagccattccaaatacaatccacgcctactaaaagcatcatcaatcctgctaaaaatacggccaaactttcatactgccaatgcccttccaaatgaaatttatcgcgtggcatttttgaaaatcctaatccgacaatcagcaataatgctgaaataatcccggtaaagttattttccccatccgaaagcaacgcaactgaatgggtttgttgaccgactgttatttccattattgaaatgatagtataaataacaagattcagatagagtaacttccgtgcccgttgaattttttgcacactgcgtttttcaagagacactgaggtttcaatccgatcttgcccgacaacctgtttattaattggatgcatgtcttatcgccatcctcgaaatgctatattagaaagaaagttacgctagtgaaacctaatttaaaggtcgttaaaactgaacaacttattcaaaaggcgtttataaaaattgtttcccaaaagagctttagtaaactcaccgttaatgcaattattaccgaggcccatatcagccgtggcacattttaccttcactatgccgataaatttgaccttcttgctcattacgaaagcgcactactggcagaaatcacaaccattttccaacgctttcccaaaccattatcatcagataatccgttacgaaccaatcagaatgctttctatcagctctttaactatctatctaagaaccgtgaactaaccaacgttttacttcagaaccctgaatcagatattgtcaaacgagttaaagcactgatcttcaacgaaattcaattaactggtccttctgaaaaatctgccgatcaactaccaatcccggaagactatgcgcgcgaaattattgttcaaaatattctggtgattatcgtcttttggttaaataaaaccacccccgaaaatcccgaagtcgtttttaacattttcttacgcagtcgacaattatcgcccatcgacctttcgaggatcttatcaaagtaaacagccgctgataatggattgaccaatcaaattaacgacctgttcatacccaatagtttgatatcttaatccctgtttgacaatatgcagttaggctccaaatgttcatttaaatcccccgagccataactaagaggtggggcaacattagacttgccaccatctcttttactgtcctaacgatatagcccatttggtttgagcaaatagacactttgacattttttgcatattgaatcgcgactaaaaaaggttagtcttttcaaatgaacatgatgtttatttgaaggagcgataaaaatgattaaagaagaatggaaatacctaaccagcaggaaaatgatgatcgtcgttttaattgcaattgctctaattccagcaatttattgttacttatacctgtcgtcaatgtggaatacatatggtgagatggctcatatcccagttgcaatcgtcaatcatgatcgacaagtcacttatcgggggaacaagattgatatcggtcatcacctcgttaagaacctcaagaaatcagattcactagactatcatcaagttgctcaatcaaccgccggtaaaaacctgactcatggaaaatattttatgatcctcacaattccaaaaaacttttctcatgacgcgacaacgctactaagtggctcacctcgccacctacatttaaaattcaaaattaattcgggagaaaattttattgtttcaaaaatgaccagaggtgcgattaccgcgattaaacaaaaagttgccgctcaagtcacaactctttacgcgacaatcaccctcaaggcactaaaaggtgccactcaggggatgcaacaagcagctaatggaaacgaagaattagccaggggtgcacgaagactgcataccggcttgacaagtaccaattccggtacaatcgctctagctaaaggtttaaccaaattcaaatccggcacaacccggttagcggttggcaatcagcaaataatcaccggtttaaaacagcagctgactcctgcttcagcaacaactttatccccagtaatcaaagccaacaggcaattttcgatcggtcttaatcagctggcttcaaatgttgggcgcctccaatccggcaccaacaatatgttgactggtgaaaaagctctcaggactggtaccaatcaacttgttgccaacaaccaattaatcagtcacgcgttgtcaaccggctcaaatcgccttaaaaccattcataccgccacccagaatgccaggataattgcgaatcccgtcaaaggatctaccaatgacattgccaaagtccctaacaacggaactggaatggcaccatttgccatcgccattggcatctacgttggggcaatcgcattaggaaccatgtatgatggttatttaccgagaaaaaagccgcagcacgcaattaactggtgggcaagtaaagcttcaattattggtggtgtcgcggttattaaatcaattttactgtatgttactttgacagatgccaataagctgacaacggtttcgcatccccaactctttgcattactgttagttggctcaatcctatttttatcactgatctttttcctaagaatctggctcgggggatttggcacttggctggtttcaattattttagtattgcagctctcatcatccggtggactctacccaacacagctattaaattcattggcaaaggacatgaacccttggctgccaatgacctatttgattgacgcattgcggtcaacaatttcgaccaatcaaccaattcaaacggatatgatcattatggttggcgttatcatcctgttaaatgcactcattctattgaaatttaaactcgatctaaacaaaccactcatgacgctaaccgaccctgacttaagtgataattagtttagagaatcggtcaatggtataaatagcaacgttgttcgaactcagaaacaaacttaatggatattcataccttaactactacaagcagcttcattgtttaggtatcattcatttacgtttttcaatagatgacggttgtcgtaatgcctcttttcaattaaaattaacacactatgttttgataaggggaatcaactgtggactacattaaacaattgcaacacttaaccgataccagccatgcttcattagcgcagaaaattggtatctcgtcaaccactctgaaccgtattcttgccggcaaccatatttcccaacaaacggaaaataaagttgttgactttctacataaaaatatcgatcaagccaaattgtttctggatgagacgtatgttggcaacatggaccatgctacagagatgaacatctcctgtgttttcgctatcaccagtcatgcgtttcatgattttaaaaaaatcgtttatccgttaggttggcgaaaaggcgacgaggtcaaagctgccggcaaagatattgccatgttaggcgacttactatccactaccaagagcgatgagttacaaactttttataccaaaacattaataaaatataacgaggttgccggactacaatatttatgcccctacattctggcagtcatggaaacactcgaaaccattagcatcgaaagaatcaacgacttagaaattgtgattgacactcgaagtgaatttttcgcggataatttaacagattgtcaaaaaattttggcaacatacttaccattaatcggttgccacgttaaagaacttaaagtctcttcctgcaagagccgagatctcattggtttacaatacgccgattttgtcgctaatttatcgacaagaggatcgcaggaaattctccaagatgctcaaattaatccaaccgttactgagcaaaatattcgcgatcagaaattattgatgatctccggtcttcatcaaagaaccatcagacatgcgttggcggctgggaacacattggctgtgagtgatggggcatcagccacgattgaatatctacttaatgatattcgccaagttgcttatcaagaacggtttagtgatgatcgaatttatttcaataaattaaagcaggctttaaaactctgcatcgataatttgcctaataaaaatgatcggcaaccaattctcagctacaaaggaacaagatttattgatctggaagctcgcgcatgtatggccttacataccgatttaagtacaatcgaattagaaacagagcagtttaatcaagttaaggaattaattgattcattgtaaagaattatcgtttgtttcttttaaaaaggaaaaccatagcaggtttattttgcttagttttccctttttttacgcggtgaagatcattaccggattaatcgctctgttggatatcaaccatgctttaccaattggttggatttttttccaaccaattggtggttcttatcaataccctttatttttatactgaatttattcaatattaatttaatcatgaagggaaccaatgcatatgacatcatctcaccgtttaacacctcagcgactggttttgctctccttgtttatcgcaattattatcgtccaatcaattgtgcctttctggggttacatcacagttggcgttgttagcatcacgctaattcaattaacggtggcaatttccgcaattttgctgggcagccgtgctggcgtgctaactgggtttgcttggggattactttcatttattcgatcatggacatcaccggccagtcctctagcggttcttatgtttcataacccattcattgcgattctgccaagaatgctggtcggattatttgccggaatcgtttataatatgatcagaaaacgaaaggggcaagttcttgctgccagcttggccgggttaaccgcatcagtgaccaataccattctggtgctcggattaagtgccatttttttcattgggtttcacgcaacaatgggaagtatttccggcggccaatggctttggattttagtcgggattggcactaataacgggatttttgaaggtattttttcctttattgtgacaccagttatcgttaccccactattacgatcaagccactttaaacatcttttacagggagattaaattatggactggtaccttgaccgttccgcgcatactttttgctaccaacaattgattgatcggatccaaactgccattcaaaacggcgagctattaccgggcgaaaagctcccctctgagcgtcaacttgctaccatgctggggattgaccggtcaactgttaatcgcgcttatagtgagttggctgccagtaacattgtttctcgagttgtcgggcagggaacccgaatccaacagcaaaacaccccacaacaagccaactggttggcatatctgcgcacccattccaatgcgttcgacaccctaaatgaaactgcccaacaaaaagaactgttagatttagcaaccaatattctaccaactcagctttggccaacattgccatcagtgaagttcccccactacctacccaaagaggggtcgcaagatgctgttttgggactatccgaacttcggcaccgaattctaaggacgatgatttcaaaggaattacaatctcaaattgatgatcctcaagttctgattacttcaggaattcaacaagctttcacgctcttagttgagggcttattagcccccggagattccgtggcaattgaatcgccttcttcgttacatcaactgaaaatttttcagttgcttggaatccgaatttatcatgtgccaatcacccaagctggtcgcctgagtctaactcaactaaaaaagttaaagcgccaacatcaaattaaattgctcttcgttatgcctaatctccaaaatccaaccggaacgaccatgaccctagtcgatcgccaagaattagtcaacgtctgccgtgaattatcgttgccaatcgttgaaggagacccatttcagccacttatccagtcaacgttgcccacgctgtttagtctggatcccaataatgtcatctacgccagcaccctcagtttgctaatgggcactcaagctcggattggctggctgctcggccctgcacatgttatgacgcaactggggatcttacgcgataaacttggtgagcgaattggattagcccaacaattagttgccgaggagtttttacacagtccagccttactaacccagcaacgacacctcatcaaggcattatcaatcaaaagacatcacttgctacagaaatttcaaccactgattcaacgtaaatggctaagcgtgacacccacgcaaaccggctttttcctatgggcaaatctactaaatctgccgccattacaacctcacgattaccaattttttcgtgagcacggcctattaattttacccgcctactattttggaagtccaaacaacggtctccgaattagctttgtcgcgttaaaggatcctcaatatgaccaactgataataaaacttgaagcagccttaaaacagttacaccagcagtttaaccataaatgattcaatcatcttatccaatttttaatccaaaaatgatgccttctcattttaagagcgggcatcatttttttgaattcttgtgatctgaattgttcaaatctttggaatgagagttttaacatctcacggtttcttttgaagtatttaggcttccacgcttccctgatagtttgaaataatctcaagaaattggtcaccatactttgccaacttactctcaccaacacccttaacagccaacatttctgaatcgttggttggcatcagggcgctcatttcatgcaacgtcttatcagagaaaatgacaaatggcggcacgccctgatcctcagctaattgacgtcgcaactgccgaagctgttcaaagagctcgtcgttaaccggtaaactcttagttgcttgaatggcagacttgcgaaagacttgctgcgtgccctgcagcactgccacccccagtggtgcgacctttaaaattggaaattggccaccatcggtaatcaaatagccggccgccgttaaataatcaattaattcaacaatctttttctgtgattgacctttcataatgccgtacgtcgataggtcatcaaaatggaaattcttaatcttttgaccttgtgacccggccaatacctgggcaacaagatttttgccaaaccgttcgtgcatccggtaaacacatgacagcaccttctgagtatcaaccgtgacatcttgagattctctggtgtcaagacaattactacaacggccacattttggaccatcttcaccaaagtaatttaaaataaattgctgcaagcattgctccgtattggcgtattggctcatcacctgtaacttcttgtattcacgctgcttacttgcttcgtcacgatcagattgctcaatgaagaagtgctgagtctgaacgtccccaatcttatacagcaaaatcgcttcacttggaaggccatcacgaccggcacgaccagcttcttgataataggcttccaagctgccgggaactgaatcgtgaatgacaaatctaacgttacttttatcaattcccataccaaacgcgttagtcgccaccatgacaaatgcgcgatcatacaggaagtcatcttgattttttcgccgttcttctcgactgagaccgccatgatacatcgtgactgaaaattgatgtttgtgaaatagtttggttaaccgttcgacttcttttcgagtactggcataaacaatgccggattggccttcatttaattttaaatagtccagcaagtattgatcactattttgatctttgatgactttaaaagccaagttgtcccgttgaaatccggtgttaacttcttcatggattcccagtcgttccttaatatcatcagcaacgcgcggtgtggccgtggcagttaacgccacaatcgtcggttttgtcggcaactgattcagtcgttgcgccaacgccaaataactgggccgaaaatcatgcccccattgtgaaatacaatgggcttcatcaacggctaccagatcaatcggcaaagccgctaattgggaaaaagcgccggaatccagtcgttctggcgagacatatagtaatttaacatcaccatttcttgcttgatcaaaccgatcgccaatttcatcgaaggttaaactactgttaacgaaagtggctggaatcccattttcatttaaagcgtccacttgatccttcatcaacgcaattaagggtgaaaccaccagcgtcaaaccgttcattaaaagcgccggaatttggtaacataacgattttccgccacctgttggcataatggttaagacatttttatgagccagaatatcgtcaatgacggtctgttgccccggccgaaaactgtcatacccaaatttagtttttaaaagttcttggggtgccataaataattattgccgcctttctaaaataatgagctatatagattatatacggaaacgggtcaaactttaactaatctgacgtaatcatcacaaccattttttacttgattgtttcggatcccttttattctagcaactttcgtattcaatcgcaccgtcgaaaatgacccgcaataaaaaccgcctcgaaaatttcggtttccgaggcgctttcagcaataaccaggaaaaagcacaatcagctgtcgccataaatttctaaagataactcgactttcgagctttcttaatcgacgtaaacttctcacgttgcgcctgagcaatccgtaacagcaacgctctgttattgtcatctgttgtttgggatgctaattgatttaacgccacataattaacgtgggcatctgtaatcgatccacagacatcctgaaccctttttgcctggcgccgaattttttcagccttcttgggtacaaattcggcgaaataagtcgcggaataacgcaaggttttcgcctttttgcgaacatgatgaacccgcggataatcttggaaatcaaggtgatcgtattgcttaatcagttgatgcttacgtcgttttaattctttggcaatcaatttagtccagtctggtacatgattaaagttcaccgttttcaactgtgctttaacttgatcaagatcaactgttaattcctgttggacagaatctaccaacgtttgctgcatttcctcatgccgtttgttatcaaacatcttaaagaaatcacggtaattcgcctttccttcaggatgcgcataggcaaacgcacctgcctcaacaatcaaaacgtcaagatcccgcaacggactaaaaatcttggcagcgttgctaagggttctatcaagggtttcatatgcttccagtggcatttcccgtttcaaaaatttaaccaaaccgcgcaatgttcgaatcgctactcgcaaatcatgaacccgttcaggatcatatggattattttgataacgaatttgctccgtttgaattgaatggtattgttgctgcaaaatggttgtgattgacatcatcgcttagcctcccttactttaaagcttagataattggtaaaaatcaactttaacataacacattaggaacatggctgacggatagactgtctctttttttctgatttagcagatattacttctcaaattaaaagatacctgccagtttcaaaataagattacgacaggtatcttttaatcataaacaaaagtcactatttgatctaccaaagtagttaacgttttttagaattaaccagtatttcgggaccagcctgtttgccaacaacgacctcattcaccatccccagaaataaaccatgttcaatcacaccaactgtgttagttaacgtttcggccagcttacccgggtcatcaatttcgtgtaaatgaagatccaagataatgttattggaatcggtcttaaaaagttgaccatcgttaccaattctaacaactggattaaaaccagcatttgaaaattgcttcaaaatgtggccactcccaaagggttcgacatccaccgctaagggaaaagcgccaatttggttgacaactttagattcatcaacgacccaaatcagctttttggaattaactgccacaattttttcccatagtaaattcccgccaccacctttgatgccattaaaattgcgatctacttggtcggccccgtcgatcgttaaatcaatggcgttaactgcatccagatcaacaatcttgatgcccaacgaccttgcctgttcagcagttgagattgaagtcgatacgccggtaaattgcaagttttcctcctgcactcgccggcctaattcatcaaccaacattctaacggttgaaccacttccaagcccaataatcatgccatccttcacataatccgcagctttggtcgctgcagccttttttaactgattttgaagttctgaattgcctgcactcattacagtcatctccttaattgaagaagttccaagttttttcagtgatggtcaattatcaacgatcacatcacattttctgttacgccttatctctgaaccttaccgaaatcaaccaacagataaggttgtcatcagtttaactgattaacggtataacacaagaaatccaattgtgaataatttgttaattctcagtcaaatgtagactatctccaaggatggattacgatctctaatatctgacaacgtttcaactaaaaggcccagtaaaaccaacgttctcaaatgctggttttacgagaccattactatctaattacttcgaggccaagttttggatcggtaatcatcgccccataaatgctattactttatccaggatctacccgtgggaattcttcagctgacaataaacatgctttttcccgtctaccttgataatctctttctttaactcatggcagttgtcttttctgctatttttcggctttatcctcatagaaacgtatgtaggatcccacctcctattctgcattagagatccatccaaagcagcgtgcaatgatcactttcacttgctatattgtaaaactcaaaaaagcgtccaccaccctcaatcaaaggtatcgtggacgctttttgaaaataatgaaggaattcgcttcaaccgaaacttagttgacattttcctaattccctgctcgggtcattacttgttgataataatcatcggatttgtataaataatccattaccgacacaggactattgatgttagctgtagcaaatgtaatcgttgatttattgggaacctgcagggtaaatttcacaagagttggatcttccgcagttccccactgaatactatactgatgctgccaagtcccatttattaatttataatcagaaatttcgctattaccaacttgtcgataatgggtcactcctttgactgctagtataccggcaaaaatggcgtttgaccatggattactagtaccgatccacaagccattcttctgaaccggttgatctttaggaagttccagcatatcactcgttaaaacatagtggggactattattaccaaaattaactaaagaaaaatcaccattatcgccatagcctgaattcaccacaccaacccttggaactggattaatggaaacggttggaattattggtaggcattccaaggaaaccgctgcttgtaaatcaggaaagatatattctttgccaaccaagtaagtaacggtattcagatcactagattcagaggttgatccgggatgtttaattatctccaatatattcttggttacaccagcatctttccaaacaaatgacgcatcactttgagcagttggtctgtcagcatcgtcgtctccatactgcaaagttggtagtttaacaatttggttatcctgcgtctgatatttctccatcacaattctgaaatagtcccaattaccaaacttcgtcttaacatagtttacaatttggttgatgtcatcagttcctgggatttgagcatacttttgcagaacagcagccttgacctccacaaaacttttacttggcgtggcagtcgctggatttggattcacaactggcaaaccatcagtttttactgaatacggaacattagcatacaaaattccctttgctttatcctgatttgtttgactatcagttgaagttagactgctccctgtcgctggcgtagtggttcctgatgaaccgtttttacggactgtggaagattcattgggattgaccccggttgataaatatccccgccaaatatagccggttacttccccattaccactagtaacgtgatagtaaattcgacttttgtatcctgaattcattttaatggctgccgatttataccaggttgttcgagaataattttttaagttatgaagcactcgagtatggtgagcattccaaaggtaaattgagccggccattttagcgtgataggcaacgctgggtgaatacgattttgttttaagccagcgataataatcagcacgaacagttgtcgggttaagggctcccagcagacccgccgcagctaaaccaacggtgagtattacaatacgttttttcaaaatgcaatcctcctaatttgactggtcagtttggccggccttaaataaagccacaacataccggacagcaaacgtcgatgaggaagggacatgccgaaggtcctggttcaaataagcgtgattaatcggcctgctgtcaattccgatttgccaccccttgtagcggttaggattaacaccttgggccttcagatcatttagaacaaattcctttaatggtaactgaccactatcaagtgctttaatttgagcaaccgttgttggctttgccactcgaataaacttaattgcttttgtatcgttggcgtcaagacctctctttttcaaaaaggcttgttttgccttaactgaacttggtgatgaaagatcagttgtattatcattcaaagttgtctcagccaatttggctaaatcccaattctgaagtgtgccgggaaacagtggataaagtgatcgatcctgccaaaacatcgttgcaaaatccatttggccaccatcgtcctcaccattatggtaagtcgcggcaagatcgctgagttcagccggactgggatccggcacgccaaaattattggttgacgtcgacttattcagcatgatcttggtactcaataattgacgttccggtttaacataaccgcgccaaacgtacccgttaatcttggcttttggactgttcacatagtaaaaataacccgtctttttaccgttggtcattgttaatagttccgaagcatacaaatccgcgcgaggataatttgttaaatgatgcagcttcttggttaatgtctgattccataaaaaagctttgctgctttgtccattccacttgaatgcatccccattcaagagcacatttttaataacgtgatacgtcccggcagcttgaaccggttgacttggcgcacctaaaaagccaatcccaacgctggcgataaccccaattgatccccaaagtgctaactttttcttcaaaataccacctgattttctttatagttatcccccttgattgttatcatagggctgggtggacaatttggcaatctgaattgaaacaattaataaggctttgatacccctaatgacaaacgatgaagtaacggttatgattattttgatggtaacataggatttttgttaaatattcaattactaccaactcaaaacaataaaggagattgtttattatgggacagtcagaagcgcaaaagcgagccagaaataattacgtaaagcgtcatccagaacgcatcaaatatcaacattacaaaagcactgctcgcctttttgtgaagatggcatcgcaagaagacttagtagacttaattaattttatccatgcccatcagaaataatttttatcaaacaatttcaaaacaaagacagccagtttcctaattacggaaaatcagctgtcttactttataacccaatgggatattttcagtatcatttaacagtatttgatactgaaaagaagacaatgatcccgaaaacatttactagtaaatggaaaaaagccgatccggtgactactaaccatttggttcccccaacgaatatccagtcagattttgatggtgatattctaagtaactgatttcgatctgatagaatggatgtgaaattaaccaatcttttacaaaaatggatcattcatttgtcaatcccgggcgtatactgaaatcataattaggattattggagggatatcatgaaattaaatagatttactgccgggataataatgactgctttcattggtgcggggatattggtcagttcacagccggttcatgctgccagctggcatagtggcacaccaacggttttacgtggaaaatggcgaaccaaagtacttcatgaatcagggactccctacacgcgacggggttatctcagtgtcaaatcacacagttttaattggcacgcggcttttgttccagatccaagctttggagcccacgctaaatatcagcgcttaagtaagggtaactacatcattgctggtcgaaatgatgctaatgcgcctgctggtggcgttgttttgagctatcacgttcgcttgtataatcgacataagttgtattttaaaggtcttggtactgaaaaattctggcccggtcacgtctattacaaatattaaatttcattagaatctcaataagtcataaaagaagaagcccatttttgataggtcttcttttttattattctaattgggctaaaattctaggcttaaaatgcataataagaatctcgtcagaggggtttcctctcattaaaacaaccccaacgactaaccaagatcacatatcatgtacctcggaaacacacttttacgccttgcatcgaggagaaaaatatttatcataacaaccgcaaatttaagttttagatcatttcaatattcgaattaaaatactgctccataaagttgactcgatctttaatctgttttttggtaaacatttcttcaggcgttgttgccacccacttttcctctacatcatcttctcgatggataatggcaataactttaccctcaaagacagaaattggctgggtaataaagttcgaaataatataaacatcttgcaattcaccatcaccgccaataaccccaggaataaaaccatagttaattggatatggcacatgatgagttaaatcggtataaccaattggacgatcaattttaacgtgaatcattttagatctcacctttgctaacctccaattatcattcatatatttcagaatcatggtggcagtataaacggtatctgtaattagtcccaaacgattagttcacatctggtgcttagtaaaaaatataatcccttgaaaaattgtcggaattacttgtccagtcaaaataaggcaggaaagagatcatatttctaacaacttttttccacttcctgaatcttacatttggtacagttataaattaatcaactgctgaacggctgactcaccagcaattcgcccagaattccatgcaaatgcacaactgatcccttccagtgttgggtatgaggtgtcatacatgccagttgcgttattaccagccacatatgccccggaaattgattttaagtttgccgtcaaaacttgcatcttagaattggtttttacaccaccaattgttcccaaagatgttgaatttgctctaaccgcataaaatggaccttgagatacaggaaactgtaaatattttgcaggcttataaaactgagtatcctcattagttttcactatttgattatatccatccaaattagctttaagtatgtgataaggtatatttaactttgtggcaagacctttcaatccattatccttccaagcaacatgttgttcaaccgcctcattcagatcagattcgattcttggaaatgggccgaccttgtgagtaactggttgattctgaaggcttttaaatgtgcgttcaaaagaatcagtccaatttaatgtctggtttttcaaataatcgaccgtattttgatcaatgataaagtaataataaccacccattgtataagtaatattaccccaaagtgcaaagtcatagcaaatagcttcattgacaaaccggttgccttcacgattgatccacagaaagggcagattagtaagcgtaaaaatagtggcattgtgccatttcggattctggaaagatactactgacgcagcatggttttcaaaagttccaagatgtttaacatcggccccaatttcagctaacattcgaataccatctccggtcgctttccgctcacccatactatacaaatttgaactatcaatgcctaaatttgcttttaccatttcggaattaccaatataaccgccatcagcaacaataacagcctgacacttgataatatctgtctgttggtttcgtctaatctcgacaccgctaatgatacctttttcattaatcagcttgctggcagtggtctttgtgagtaaacgaccaccactattcttaaaataattaaccatataatcaaaggccgcaaatttgtcaatatactgatgatataccttgggatgatcttgatgaacctcctgcgtattattaaccaattccgttttaagaccatgttgcccaagccaattaatcgtttcagcagatttttctaaaatagcttttgtaatcgtgggatctgaacgataatgagtatagttcatcagttcggaataagcatcttttacagtaaatgaactcccatcagctttttgttgacaactttcaactgcgaacaatccttgcgccccaaacagaccagcaccaccaactttatcccccttttcaagtaagataaccttttttccagcatctacacaagttaaggcggcaccaaaaccagctgcccccgctccaattacaacaacctctgtctgatatgacatcataaatacctcttttacgtattttgacaatataaattctgcaaataaattttgtgcacgctaaccgtgatcaacagaatgacggtcaccaatttgatactgatcggcatgctcaaacaaatactgaatattctttggctgacgacccgttaaagtcaaaaagtcatttgaataagtcgccattttccccaatcgaattgctttaccaaaagttaccatcccatcagaagagaacggagcactagaacctttcttgaaattaccatccgttgtccgtggaacacccattttgtcaaaaatagcataatcctcatcatcactgactgacttgtaggtaacctcattcccagtaatttgattaccaatttcaactaaacgagcaatcgtcgtaagttcagggccattgatatttaatatttcacgatgcaggtatggattggctactgcatatgcggccgcatgagcacaatcttcacgggaaatgtaagccatctttccctcagcctggttattggctagaacaccgtttttcccaactgcaaagtaattagaaatcattgcttcggtatattgagaatttcgtagaaagagatagtctaaagttgtattttctacatacgattctgtccaagcatgatcaatcttttcaatacttggattagtcggatccgtggcgttgactaaagatgtataaataatttgtttcacatttccggcaacacaggcatcaacaacatttttatgagctgctcggcgcttttccccaacaaacggcatagaaatcaataataatttatcggcatttttgaagattctagttaactcttgagcatcgttaaaattggcaaccgctgttttaattccctgttcttcaaacttctttaacctttcaccagtaggtgcggtaaataacaagtcctgctttgggacaagtgtttgaatcttctcagctacgatacttccaaaattcccatcaacacctgttacaatatattttgacattttaatgtcctccttgataattatttcacaattaattataacagcgttttcattacgattagctggctacttggttagcctccccataaaaaagttaaagccaaaggagatataaaccatgattgatgacaaattactttactttttatttgcagctgaaaattcaagtttctcgaaaactgcggcacatttttttatctcatcaactgccgttagtaaagcgatcgcaaacttagaagctcgaattggcgttcaactatttttacgacataaaaattctattgagttaacagctcaaggtcgcgcattttatgaaaacgccaaatttattgcttcagactatcaaaatgcaattgaagcggctaaaaaagccgggggtatacaaaaaaagcctataaaaataggcttttcaagtatatatgaagctagactaatcacacctgtaattaacaagtttctaaaaaaatacccaaagataaaagtaacttttactcatcgtagtgttgaacaattgctgcaagccattgatgaaggttccatagatattggactaacctttgaaaaatcgaaagtttcaccttcaatcacagctgtttctctgtatgaatcagactatctcattggattgtctaaagaaaatcaacttgcaaacaagcagatcctaacctcaaaggatctcctttcagaaacatgtggctattatagccaatacaattctgcattagccagacaactattactagactcagctagtcaaaatggattccaaatcaatcaattaaaacaatatgaaacatacgaaactttactaatttccgttgctactaatcagtgttttgcattcttcccaaaactatttgccattccaaattggtttccagatatcacatttgttcctgccgaaaaaacatttagctcttaccaattagttgcactgcaaaagaagacagctagtcgtgattctgagtcctctttattaattgattttttaaaacgagaaattctaaattctattggaattaatctttgaattaatctttgcggtcgtggtcactaacaggatcattgagcggttaaatttcacaacaggaatcagcggataacaacggcccgctggtggcgggactgataatttttcataaattgcgtggttctgatccaataaactttattgggccaggattttttcatatacggatcagctaatttaagtaggcgtgccgatacccgactagagttaagacatggtaccggcccgattacattcgccaagcaccggcaaagataaccgggttacgatgtttaatttcattaatcaactgattcttattggccccggaaatattagttgcctgcggatcgtattgacgagcatatttagccagcggttgcggataaatcgtccaaacaacgccgaagggactttcccattatgggttaccggtaaacccttgattaggattttttgagcggggcatacggcagataattgtttttatactgggatgccaaacagactttttcgcacttaagaccatttttaagctggcggcttcacaagcattctgcgcatatagtgggtaaagttggctggtatattgaaaatgaagcacgtaagttttaaatgctttaaccggagctgattgaatgattaagatacttgcaaacgctacactggtcattaaggctaaaaatagttttttaatcacaaaatcttctcttatcacttgtaataagtggttccctgcattttaagatgatgagcagtcgccgttactttcagggtgccgccaagtttggtattaacggcatacctatgttggccaaggtacttatatttagcaggcgatgaacccagtttgggaccatagtttaaactggttttaccgattttcattttatagccggctttagttttccaagtcccctgcatagctttgggtgtgcctttatgccaggaagctgcattaacattttgagaagtccccattacaccaacacttgcaaatgaaagtgcaattaaagacgtggcaatcttttttgaaactgatttaatcataatgaatcaccctccaataatttgttcaatgagtatgcataaaactcattaaagtaattataatcctgacaagtaacatattacataatcatttataaaacaggtttcataaaattttcattgcctatactaatccttttatcgttggtgtaaggacagtgttaaagtattcttgagaatattagcaagttggtccatgaaaaaggaaaaaagcttggtttaacaattgaaagctcgtcacaattggcgatcagaatgttctttaaacctactcaacaaaaaagcgacgaacaaaaattcgtcactttttcaatcaatccattattataaatttatttaaccatgattattaataattaccagcaatgattaacttcttatttgctgtgacataatgtccgtcactcaattgataacgagtcgttaaattatgcttaaccagcttcttaacggtcaaacgaacacctttcttgtaatgtttagctttaccagttaagttagctgacttataagtgttgatgccctttttagcaattactgtgatcttcttggactttggaacactagcgtaataaaccggtacgacatatttacggctggcagtaatataaccagtcttgccggcagtcttacgaccgtggtttacatcacgaactttatatctcaaagtgccgttaccagtgcgtttataaccagtgactacaaacattgaacggttaatccgcttttgtttaggataccaagcaatgcggttagctttggtaaaattggtattcttatataaagcaatctttttggtagcataaacagcttcacccttaacagcaatgttaggacctactgaagtagaaggtttcgttgtcgtggttggtgtagaactacttgaaccaattgttgctgatgaggaagacgaattagttggtacattagtagctggtgtcagagttgctgctggaacagtagtagttccggttccagtattaccaccggttgagccgccgccagttccgtcaccattagtaactgttaatgtaaaggttgtatctccatagccatcggcagttagtgtaacgttataagttccagcattcttcgaagcaaaatcttgcgtcaccgtttgtcctttatcatcagttatcttagaaattgtcgctgttgaaggagtaggattaaacattgaagccataatgggtgtattaatagaaacactcgcattcctgccagtaacattacttgcaaaggttccaacgttcaaataaccaccatcatacccctttttattccaactggcataatacagtggatatagggcaccgtcttttacagaatcgagattggaaatatataccggaattttaagtgtaaagtgttgaccaggtttaagtgtcccccaaataccaacggcattaactttttgctgatcagtaagcgtaccatctggtttaaaattataattactgtttgcccctgaattaaatgctaagccatctgatccataagaaccgtctccagcccagacatcggtagatgaaggaattctaagttgtgctggcgttagtaagtaattcggactagttgcgctctcaccgattttgaagactggtctgttttcctgtcctggtactgctggtgcatctgctagaactacagcctcattcagataaacttcttgattactcagattttttataggaatattaatcgataaatttttaactcctttggaaatataagttgttgcaaacccagtagaagtcgtaccagaacctgcataaacactatctgcaccatcggctgtaaggtacattgcactttgaatttgtggattggaagggtcactcggagtaataagtggtgtcatactaccatttacatttttaacagagcttgtaactccatccgcctttgccacaatctgaatgcccaacttgtttccagtaaaatgattattttggattccaacagcgccagctaaccccagtgaggttagtaacgtcataaacatgacttgtgatttcttcataaaaatccccctataattttaaactttatacattacctacatgccaaccaagtctcttaataattacctgcaataattaacttcttattggcggtaatgtagttaccattacttaattgataacgagtagtcaagttatgtttaactaacttcttaacagtcaaacgaactcccttcttgtagtgtttagctttaccagttaaatcggttgatttataagcattcacacctttaggagaaataaccgttatcttcttagatttcggcacactagcataataaaccggaaccacatatttacgactagcggtaatatagcccctcttgccagcagtcttacgaccatgattaacatcacgaatcctgtatctcaaagtgccgttactagttcgtttgtaaccagtaaccacaaacattgggcggttaacccgcttttgtttaggataccaagcaatccgcttgctcttggtaaagctggtactcttatataaagcaatcttcttagtagcataaacagcttcacctttaacagcaatgtttggacctactgaactagaaggcttggttgtcgtagttggcgtagaactgcttgaactagttgttgatgaagatgaactggttggtacgttagttgctggtgtaaggggtgttgctggaacagtagtggtaccttgctggaacagtagtggtaccagtacctcccccagttgagccaccgtcattaaccgtcaaataaacggtggtgtcaccataatttgtagcactcaaggtaactttatacttaccagcaacatttaagacttttccggtaacgtcgttaccagcagcatctactacttttgttaccttgacatcgcttggattgggatctttaatgtcaaacattgatggttgcggagtgatacctgtatatgccgtagcattagcagcatcaatatatttatcaaatactttagcccaaagataagtgccttgtgcatagccatctttattacctgtatcttcattgtagtctgggcctgtggcgtaattgtaaaagatatcataaaagccacctaccttaccagctgtgaccgtcttcgcattagagagatatattggaatttttatatcaatcttttgaccagctttaatcgtcccataaaatccaatacctgaaacttctcgctgactgatgggtgaatcctttgtaactggataatcataatcaccattattagggccacgatacctaagaccattatcagttggtttgccatcacttgaaatcttttctgggatccaattaccatctgttagtcctaaatcatttggatctagtatgtaacgatcagtactatcatcaccggttccaatcttgaaaattggactaccatcagactcgtttggtaactcaaagaattccctaaaataaatgggtttctcactcgtgttaattatcggaatgttcaatgtcagatccttaattcccctaaaaacactagtaacagccccatcaccttttggcgtgccaacaacaggtctggaattcacactattcgcaccattacttgagataaacattgcccgttgaattaaatgatcactattaggatcggtgtatggtgtaaataatagctttgaatcaccatttatattagtaatcggacttggaatcccatcagctttcgcaacgattccaatagcaaactgtttaccaataaagtgattattttgaactccaacggcgcaggccaaccctagtgaggttagtagcgtcataaacatgactcgcgatttcttcataaagatccccctaaaatttgttcaatgagtatgtgtaaaactcattaagtcaattataatccaattaggtaaaatattacacatttatacataaaacaggttttataaaatcttcattgcctatactaattcctttatcgttgttgtaaggacaacgttaaagggagggtacgtatgcttggaaatattagcaagttggttcatgaaaaaagaaaaaaacttggtttaacaattgaaagcctttccgaaaaagcaaatgtatctgtcagtttaatctctaagattgaacgtggagatctaaacaatatcagtattaaaaagttgaatgatattgccacctcattgaatcttacacttggtgattttttcattgatactgatatatccgacgtagaaacattagcactgattaaatatttaagcggactgcctaagggtaggcgagaagctatttctaaatatatcctcaaaattttaaccatatgaaaaagacatctactcattttgcgagtagatgtctcttcatttaactggcattaccaataaagttagcctgtgatttaattaactcactttaaaaataacatgcaactagcgaccctatgacattattgcgaattaactcaattaaagaatcattttaaatccctttatgccaagggatttaatcaatgcgtcccccgagaactaaatggcagttcttgtacattcacatagattaacgaactattgacttaacagcattcttcaaaaaccatctattcagaattgaacatattttgaatatagttgccgcaagagtgccgcaaaaatttagcttaaactggcgggcagatacatatgcacttacaattcaaactaaccacaaagtatatttaagcttacaattatctattgttctattattttgctctggactgcaaagcttcttgctttttctttcaagagcaaaacatcatttggatcttgaataatatgcatttttctatggcagttaggacaaatggcaatctcattttcaattacatctttgccaccttgcgaaagccaatcaatatgatgcacttctaaatacggctgaccggtcttatccttaaatggtgccggctccccacatagctgacaaacacctttcgaaaagtacaatgccagatggcggttattcgcattgcgtacatacattgttgtcgttacctcacgacaagatgttttggccgtctttccttgttcatgagtttttactgattcaatcagtttcttaatcggcatttttttgacagcttgctcttgtttgatctcactttggtgaagcacttccttgttcgctatatggactttatctaagtgtttaattggcctaattggaaagatgacaacttgccgcttttccccagagtcgctaacattcgtttgcatatatggtttttgaattagctttacttgtccataaaatatatactgatttacacccatgtacacaaacaaataaaccgtaatcccgttgttgtttgattcgttaagtgtcctattcgctcggaagttaacgtcctgatcacccttttgccccattcccgtgtaatataaagtatctccttcccaacgatctggatagaagttgtctgcctccttagaaattaaaaccaagcatttgttcttttttgagggacgcatacccccttgtgttgacacattaaaaattcccgctaactgatcgtttgtaatagtctttccaacttcaagtgtaatcttcatgatcttctcccatttttaaaaaattgattgtgctcattaattacttttgagtaagtaactccatcagtgttaccaatgtttaattattccgtgcttgtccggcttaccactcatgtgtttcattcctattttgttttttcgtgtaaacaatccggaaagtagaatttaaccatttttgtgtttttcagctcacgcaaattaaattcctgcacgaatttctcagtcctaaagaacgcatcatctgcaaacatatggtaagacccaacagtgagattctctgtacttttatcataagattcaacttcttgctcaatttctttatatccgtctttaactgttttaacgtccagctcatacgagtatgtcggaaaagaaatcttcttattttttctatcttgaattactttatcaatttcgtctttgttcgttttataatacatagtaattgtttcgactatcataccgtgcgtatcaattaataccggcttagtgtcaattccaggaatggtaataatccttcgttccttactttttgaatatgttccatctttctgattgtaaatctgtttgtatccaattatgtcgatgtacatatctcgcggaaacatgccattcagaacttgcaactgcagccaatccattcctattccactaatgttttgaaaacaactccaaattgaatcacctttttcaacctggaacttattcgtgaaaataaagagtggtcgagcattttcaatgactttgctatctgaccatcggtgttctgaattcacttgcatagcaactgctgcaacagcaagaatagttccaatggacccaacccaagtagctgcgtctccacttcttaatgtcatcaaggcgtaccccaaaactattgaactaattagcaaaacaattgaaaaccagccattgatcgtttctaatcttttcaaagatgcattcccccctttttactacattaacttaacaattagaaatgtagcaaaaaatacacattccttgttaatttaatcttatcagacttgattcaatttatttactcgtccttcaaaggcttgataacaatttgtaaacattcgcatagctggataataatttttagttttcgccgctcgttttaaatcaatttaaacagctaacatatcctttggagaaatgttgttaatcaaaatcattgacgagacatcacggcaagaaataatatccacaccttcccctattagcttgtgagcacagtgccgatccttaatgctacctgcgttaaagtggaattcaatgaatctgtttttgcgtggtaaggccacccttaacataaaaaggttccgactgaagaaaaatatttttgtcactggcatagatagttcgttagacttaataatagacgccactgatagcagcaattgagcccaaataacttccccaaaatcctagccaaccattgtttgttgaaaccgtgaatacatgaaaataggttgtgcaccacaataaaaattctagcaataatggaataatcacgatagcaaaaaaggggggtatacagatgcttatcgatcaaattaacgatctttcgatatacgccgttcttttgtttcatgttattaccttcattattaccattaaattttctaaaatcaattacacgtaatttaaacataatgaaaatcccgataatataccaggattacttttatacctgtatttgaaagaagggctgttgataaagaagaaaggatttaataaccctacttaatcaagtcgccatacatacttttatatcgttccccgaaccatttttttaaagctgtccacaattctttctggtcaatcacgctgtcttgtttgggtacagcttggtaggtttttagcttgctctcaataactactcgtttgtttcagtaatttttggtactcataccgtactttaccgctatcgctgaatttttaggaacctcggtcaataattgaaagtcactacagtcaccgaatataaaactaagcaaagcgaaaaaattttcattccagaaccaacgagtgaaattaaaacaaaaaagccgccaatctctcagcgactttccttaccaaactcgattcaattcacttatgcgtcccccgagagtcgaactcggatcatgaggaccgaaatctcatgtgctatccattacactaaggacgccttacgtcatacaattatactggtttcacattaatattacaagataaaaattacctttaactactgtgccacctcatctgcctggtcttccaagtatgtcagtaatttatcagtgtttgccttaaaatcactttcaaacgattcgctcattggctgaatttttttaatcaattgattgtgtaagccaaccacatgaatttcattgccaaccagcttacccgtatcataatgaccgtcttccgcgtaatccaaataggcttgaaaggtgtcttcaattgtttgacgcatgacctgctccttagtcacctttggattatgggcttttttaatcgcaaatttatcctcaaactcacgcatgttttctgggaattccaatgacattctctcacctcatctatttttctactattacagtttaacatctttcgtaaatttggtttatttcttgcaatcaggcagcgtttagtcgaccataggtagtgtaagcaacatttttaagcaatttgagttagctggatgacgccatccagccaacaatcaatggctcgaaaaattgagttactatttttctaagggggaacaaattatgtctgaaacaatttctgttgaagaatcgcgtcaattagataataaaacaatcaatgaaatcggcatcccttccatggttctgatggaacgtgccggtcttaaaatttacgaagatatgattcacaatgatgatttagatttaagcaacacgttaattctcgccggaaccggtaataatggcggtgatggtctggttgtcgcacgtctattatccactcacggctataaagtcagcatcctaaccgttggcaatcctgatcatgccagcgacgatcacaaaaagcaacaacatatttgtgactattatcaaattcccaaagtctttttaaatgaaagattcgataactacacgacattagttgatgccttatttggcagtggtttatcacgaaacgttggtggcgactttgcgactgtcattgacaaagccaacgcctcagatgccaaaattcacgcaattgacattccatccggtttaaacggcgacacgggcgaagtcatggggaccgctatcgaagccacttcaacttcgacaatcgcttacgcaaaggaaggcatggttaaagcagctgctaaaccatatacaggcaaaatcttcgttgatgatattggcatttacaagggattagttgctgaaacgaagtgatttagcactcaagaatcaacaaacttgctataattagattaatgtttatcaaaaatagaaatttgttgtttctaagcgttgcagaagctaccggttgtgattaatcatccagagcaatactgaccccgggacgtttctgtccactttatcaggaggtgccaatatggccagcaaaaaagatcagggatatattaatgttaaagacgtcgaccaagacgttatcgttgacttaaagtatgcaaccagcgataatttcacgcatcaagttgtttacgacttcaaggatgctatttctagaatcgatactgttaagaagttgggcaatgccagtaaagcactcaaggcaaagggctatcgacttaagatctgggatgcctaccgaccaacctacgcacaaagacggttattcgaagtttatccggatccaatctgggttgcccagcccgatccaaactttagccaccaaaaaggcgtgacgttcgacattactctgaccgatcaggccggcaacgacattgaaatgccaaccggcttcgatgattttaccggtgcagctaagcgcagtgcgaaagcgacttggtcccccgaagctcaaaagaactatgatattttaaatgatgccatgacagcagccggatttgtcggctatgagaatgaatggtgggatttccgcgattcagacgctgacgaatttgggccacttgaggtagacccaaaggattattaaaatttaatgatgcccgattagataaaaacgcattgttgtcagcccttcgtgtaagtttctaaacaaacttagtcaaagaggtttttgcaatgccatgcttatcttaacctgggacacctttcagaattaggagtaggaaaatgaaagttggaatcattggtgctgggccaagagggattcttttgacctcacagctatttaatcagtataaatatcgatcagatcaatcagaagaactcgaaattacgctatttgacccttatgggatcggcggtcgggtttggcgaaccgatcagtggtcaggtctgcttatgaacaccccggctgatcaaatcaccttattcacagataaatcagtcaacatgactggtgaagtttacgatggtccgtctttatttgaatgggctgcaagcagtgaggcccataattatttaatgaccaaccaatattcacaagaccttattgaagctgcggctaaattgggcggcagtgactatgccccccggccactttacggtgcctacatcaaatggttctatcaagaacttattaatcagcaaccaactcaatgccacgttgatctggtcgaggacgaagtggttgagctaacagaagcatctacaaatcaagtttcaatcaaaactgccgacaaaaattattctttcgacaaggttgtgatgagtcttggccaacaggacaattatcttaatcaagaggaacagaaattggcaacgtatgcccaggataacaacctcacctacttagcccccactcatcccggtgacgctgacctcagcaacattccttcaagtgaaaccgttattatccgtggcttgggcctgagttttaacgactacgtctctgaactaacgcttggacgcggtggcagttacatgacaaatgatgatggcagtctgtcctatcaaccttccgggcgtgaaccacgaattgttgccggctcccgacgcggcattccatattatccaaaagccgtgagtgaaaagggctatggtgaattggcgcccgcttatttcctcactgacgaaaagatggatgcagcttcggttgacggttacctgccctttcataaattcatcgaactgttacgttcggatatggaattggtttactactcactattaatcaacgatcgctatccaaataaaaatgcaactgagtttaaacagcgatttatcaaaactgatgaccgaaaatccctgctggatcaataccagtttgctgaagaggatattttagattgggattacattcttaatccatttaaagacgttaaagtaattgggaccgaagattaccagggaattttggttaattggttagataacgtcactaaagacgctaaccaaggctctaaaaccggcccggttggatctgctttggaattactgcgggactatcggccaatctttagaaaaatcattgctgatcatcgtttctcaaatgatgattatgttaataaatttctaagatcgtttagttccgacaatagtttcctatctgttggcgcaccttctttacgaagtgaacaattgtctgccttaattcgtagcggcttggtcaggctcttggcaccgggaatggaagtcaagggcgataacggctggtttgtcaccgctgctccgcgccgaaacgctgacaagtttaaagcttctgccctgcttgaagcccgggttccaaaagccaatttagacattaccgccaatccattattggaaagcttggtaaataatcaactggctcgaacaatgaaaatcaacgttaatggtcaaggtgttggcatttcagccgttgatgtcgatgaaagcaccgatcagctccgtaataaagccggctttgctcaaccacgcatttacatttggggcgtcccacttgaaggcttgcgttttacaaccaacgccagtccacgacccggcgttaatgataccagcttacaaacagcggatctaattgcagcagaagtgctgggattgaagactgcccatgatgttgatgttaattaaatttagaaaaaacgtgagaataaggatatctatctctaaagattgcccttcttcccacgttttttggtaacaatcgcaattgacccaaaagtgccctagttaatgacggctgaaaaggcttgtaaattattaaacgtcattctggatgccgtccgatctaattaaccaaacatttacaagaatcaacgtccatgtcagtccgatgagactataatcaaagtatcattaaataatctggaggggatattgaatgaggaaatttatttggggaacagtggcggccttattgttgggcattggcatactttcatcacaatcggttgatgcttcaacttggcatggtggtgttccaagtgcgatcagaaatacaaccttcgaattaaacactaaaaagtcaattggtaccacggcgtatagctttacaaatcatagtgtcaagatctgggcagcaggtatcgcaaccagctcatcaagctaccaccagattcattataagatgactggtcataacgcattttatcttaaaggcggttcaggtcatgaaagggattattggcgaatcaaagtcatcaatccaactcatttatacttgtacgaccatgaaatttatcatcattatgcaccttataaatatgccggaaaagcaaacattaaacgattaccaggcgttccaaaagatgtcacagatccttaatcattttactacgaagcaaccaggatccgatatgagttaagttaaaaaggtcccgtaaaatcagtgctttcaactgattttacgggacctttacttcgcatttaaacacgataattcagtgtttcggttattgtctgctttttacttcttgactttctaataaaaacaatttaaatcagatgcagttgcttttttcaatcaaacagatggcgtctagcaatcacagtcctgtttcacatccttgggaagacaattgcattcaaccatttccggggcagttttagccttctgagccagaatttgctgtaagtttttaatatcatcttgggaaaggtcacggctctcgataacattagcaagcgttgttcccgcctgcatggcacacatatggtcaaacagatcagttgcagcagctgtcatcgagtcttgctcgccaactgccggtgcataactaaatggccggccggtaccaatcttttgaacggcatttttcttgatcagtcgatttaagagtgtttttgtcgtcgattcggaccacccccgcgccttatccattaacccgatcagttcatgactcgtcacccgtttcaaagtccaaattgcacgcataacttcccattctgaatctgaaattgttacttctttggcatcaatcatctggttacctccgctttatttcacagtcgcaaatttcttatactcttagtttacacttgtaaactcataatgcaaggattgtcttgcctgtttcttaactgcgaatggccttgctactttagttaaaacgtgcaaaagccgagcagcttccagccatataaggccctgttttgcttatttcttaactgcgaatcacctttgttacttagccaaaacgtgcaaagaaaccacagcttccggccatataaggtttccagcttggctgggttttaactgcgaatggccttgctaccttagttaaaacgtgcaaaagccgagcagcttcccgccatatacggcactgtcttgcttatttcttaactgcgaatcacctttgttacttagccaaaacgtgcaaaggaaccgcagcttccggccatataagcccaacgaaccaatattccagattcaggaatattggttcgttgggcttatattctggaagctaaccgcggttctttgcactctctactttagcaccttcataaacgaccgatccgggattctaatcaaactgaaccggtctgcttgtctccctgcgtgcagaccaattccattaaagaagtttttcttataggttgtggtcacagtgccaacccacgcatgttgatatcgctgatccagatggttcaaccactccttgttccacttataagcctgcgcctgcacgtttaggttactctcaccagaaacgaccgtcgcattcaaactatcatcctcatatttgcgaccctcaacgtaatatgtataccgctgaatcggcttccggccattgccattcttaaccgtcacataatcagattgatccgcttgatattgaacaatcagcggcttgtaagtgtatgacgtccgcacgttatttttatttaacttgcgaacatcctggaagaatgttgtgtacgacatcccccaaaacaccaacaagaacacaatcaattcggccattgagatgccaaaattttgccaggtaaagcctttcttctgggtaacaatcaaacgcagccgacgaccacgcatgttgtaaatcatccagataaaatagataaatagaatcagccaaaggcccattccaactaggttccacgcggatttcatactatttccccttttacttgttattgccttcagtttacactaaattataggtaagtgcgataatgacaaacaattaaatgaggtgattcttgtgtgtaccagtttaactttaacaactttaaacgaccatactttgctggcacgaaccatggattttccggtacgggcggcctggaaaccagttttaattaatcaggctaattatgaaaccgctttatcaggaattaggccagtcaggtacccctatgttggtggcggtcggattgagggcgataatcatattttggttgccgatggggtcaacaccaaaggcttaacttgtgccgagctcatgttcccactcaaagcccactatcacgacgagccggtcaacaataaactcaatctaaccccgcaagactttttaccgtgggcattaggtgaacacgcgtcaattgccgacgtaaaaaaagagctaacaaccattgccatcattggcaaaaattggttggcaggtaacgaaatcttctcatttcattggatcctaactgataaatcaggccaaaccttagtcattgaaccaaccgttaatggacttgaagtcattgatgattcgattggcgttttaaccaactcgccaacctatcctgatcacatgagacgtttagcaaagaaactgcacgttaactcatctctaagcgaactcaaagcaaagtccgaaaatttgattcgccgccaacacttaccaagtgccaccaatacgccaacaacccgatttctggttgccgctgtcaataaactcggcttgcaacaaagccggacccaggttgatgcccggactcgattatttaacgttttggccgaggtggcaatcccctatcagccagcaatggatcaccatcccaatttcaactacacccattatttgtcaatcctcgactcaacaactcaaagctactatttccggtatcatgactcaaatcagattttggccgtttcattacctgacttgctcaaaagccatcccaaagtcaaccaatttctagcttgattttttccaatcaaagctgattaacctaatagttgatcaatctgtttttgaacgccctgctcattattgtcatgagcggtaaccgcggcaactttgactaacaaatccggtgccgaattcttcatggcataccctaatttagcttcatttaataattcaaaatcattattgttatcgccaaatgccacaacatcatcgaaggttaactgccaagactgtaacaattcatcgacccccgttgatttggttgtcccactgaccacaatatcgaggccaccattaccagaagctgcggcagtcaatcgtcgactgaacttgtggttaaatttggtctggcgctcaagtgggctgccttcttcccaagttgcttcaattttataaattgggtcaaaaatcatcgttaaatccgagattgattgaagatccggatagaaatgttctgattttttaaaccgcttgttatttttggataaattacaataagtcccatctcgaccaactaaaataatcttggcgccaaagaagctcggatctttcagcaagtaatccaaggcactttgcaaaacaggatgatcgataattgtttctgagataatgaccccattttcatcaacgaccagagccccattattgcagacatacgaaattgggccagtgacattatcaaacaatgccaacaagtgttgatactgattgccgcttgctgaaataaagtgcatcccattagccgccatccttttcaattgttcttgaaacgatttctcgtcaaaagtaccttcatcatttaaaaaagtcccgtccatatcacttgcaattacttttaccaaacccaattcctccaatttctaataactcttcactaaaatcatacacttatcgaccaataccacgtcaaggaatcttgcaatctttttcagcttaattgtaaggccgttccgattggataaatttaaatcgttaaactccttaagcggccgactgccggttcccggagacatccaaattaggataccttgtcacgcctacttatttctagtatactattcgtgatcatacaactatctggggtgcctttcggctgagaaaaacccatcgaacctgatctggataataccagcgaagggagcatattccgttgtatccgaatggataaagtgcattagtagatgactttgagcagagcgggacaaaaggcgcttagcttccagagtgtagctgaattatccgaatattctgaacctgaatatttggataattcagctacacggccggaggttgccttttgtcccgcgtttttgcttggtaataatcgagttgacactaacagagaccgtttaaaacgtttattgttccagcctctttttgcgtttgcttggtttttcaaggcagcactcctcgtatgaaaaaaatattgggaggtcttgttatggacaacaaggttgagaatcatcagcaacatcagcgccaaagtgcgtggaatttacgcaatattattttaattgctttaattgctattttttgtgggattattttctggggtgccgggttcctctacaccgccctcaccgttgcactaacaccaatcggcatggcaccggctgccaatgacttactaatggggctttggacaatggctggaccattggctggatttgtgattcggacttacggttctgcttttctgggcgagtttttaggagctgccgttgaagtcttcttaggtggtcaatggggtgccggggcctttatttccggactggttcaaggatttggttccgaacttggttttgcgttgaccggctacaagcattatgactggattgggcttaatgcttcaatcttcacgaccgttgtaatcacctttgcttgggatatctataaaaatggttatggtcactttgcactgccaatgatcatcgggctatttgtcattcgttacatttcaacctttgtttttggtggtttattaaccaaggcaatcgtgaaattattgaaccggagcaacgcatataatctgtaaaacaagaggtttttaaaatgacggacgtttcgattacccacttcacctttcattaccctaagagcgacgttaaggtattaaacgacattaatttaacattccgcagtaaccatttttcattattgtcagggccatccggaagtggcaagtccacgctgctttatttcattgccggcctatatcctcggtttatcggccttgatgcaacgggaaccatcaaatttggtgataccgacattaagcaagttccccgtgatcaagtcagtaaaacggtggcgatgatgtttcaaaatcctaatcaacaatttgcaatggacactgtcattcatgaaatgacctttgtcttggaaaatttacggattgaaccggccaaaatggacaatattattacccatgccttaactttctgtgggattggtaacctcagatcacgcgtgattaatacgttatcgggtggtgaaaaacagcgggttgctttagcctgcatcgtcgcaatggatccaccagtgattgttcttgatgaaccttttgccagtattgatccggattcacgattagacctgctgcacaaactcaaggtattacaaaccgaacacggtaagaccattatcatcgctgaccacgacttggccgattatcagccactcattgatgaattctattatcttgacccggaaagtcaccatattaatttgctggatgacccatccgctcaaaagttttttaataacttcaaatcaacccaaacgatcaacaaacgggtcccgttgcccactgcttcggatcccaccattttgaacattcgtgatttcaagttgaatccgcaccattcagttctcctgaaactagacaatttcaatttttacaagggtaagatgacactgataaccggcgcaaatgggattggaaaatcgactctgttcaacgccttaactaaactattagcttaccaaggcacaatctcctatgacggcaagaacattcaaaaaattcgaccccttaactacgccaaaaacgtgacattactgtttcaggatgctgaaaatcaatttctcaacattaccgttaaagaagagttggatctatccttggcaaacaaattcactgaggcttactcggctgaagatgttcagggaatgttacaggcactcgacctaactgggcgcgatgaccaggttgtttattccttaagtgagggtcagaagaagaaattgcaaatcgtggaaatgttgattatgaacccaccagttttgttacttgatgagccgtttaagggacttgattaccagtcacttcaagtcatcgttggctttctgaacgatgccaaaaataagtttggtcagactcaaattgccatctctcatcaattatccggccttgaagcattaatcgattaccacgccaactttaaaaaccaaaatttgacttaccaggaggttgtgaaatgaatcctggattaaaactgttgctagtcatgttaatcgcgttagaaatttcatttactcagagtttgatcgtcaacgtcatcttaatcgccgtcagtctgatttacattttgtttcatcgaattagtttcaaagcactgtttgccctggtcttttggccgctgtttcccgcattggggctctttgtttcacagtggctgtatggggatgccgggattcatttcgcatggattctgtttactcggatctacgcctatgtcttcttgggggcaactttcaccctcaccagcagtattactgacttggcactcaccttggaacaggattttcggctgccttcaaaattcgcctatggcgttctggcagcgtttaatttgatgccaaaaattacagaagagatcaagattatcaagacttcagcgttaatgcgcggcgaagcacttcatttctggtcgccgaaattgtatttcaaagctattttatcttcgattcagtggtcgcaaaacttggcagaggccatgacctctcatggtttcgttgaagatcaagaccgcacccactataagatcatcaaaatcacaaccttggattgggcactgttaattgtcctatttgcggccgttcaggctatgctctacttcatcagatactaactggcggcccactgattttattagttgttcgcccacttcttccttttttgttttatacttgattctaagaaagaaaagaattggaagaaggcgtctaactatgagagcaaacgtatttgcatttgcattcggaattttcgcactagttgtcggtatcgcagttgatatttggggatttgtgaatcaatttgaaagcttacaaagtgcgcaggtggtcttaattggcagtattattctggcaattgggttggcatttttatcaattcccaatcggattgagcgatatgcgctccaagcaatcatcgcaatcgggctactctattatttttacatccagacaaataacttctggattggtcttgttgtcaccgcgatcctagttgctttaatcgagtatggccttagacatcgttaaattgtgtccgattccacttttattgctataatggaactatagcaatacgatttatcaaacggaggaattaagatggcagaagaatttagtaccctagctgaagaaatcattaattatcaaaagaagcacgatatgccggacacagcattagcatttaatttgcatatttccgttgaacgcctccacgatatcaaatcaatggagtcctccccgacagctgaagagaagaaaacgatcgaatcgttcatccgttaacaatgaaaaataacaagctgaatgaaagccagaatatactaatggcattaagattctttcagcatccgataaaataaaggccctgtaaagttggttaaatgaaaaccaactttacagggcctttattgttaataaattgattaaatttgagattgcttaaccgtcataatggattgttgctaccaccacggtccccagccaccgttgccaccaccgaagtgattactgtcaaaccagccccagaaataaccttcaccaaaattatcatttccagcagtcgaccaatcaatatgcgaaccaggatgggtcaacttacgaatcactaaccaaggaatcaagattgccaagaataaccagaaagtgactttgccccaacccggaccaggcttaatttttgaggttgtggcaacatgcttcgtgataaatggctggtagcggtcaaaatatgccatcacacttgatccatttccttgtttacttggtagtcggaaattcagaagccatgtttgtagatctgaggttgctgtatctacgtcatctgaaggcacaaagatggtgtgtaattgtgacttagccggataaacgataataaacgaaacgtgttgtccatcgcgaccggcttgctgtgcgattgccgtttgccgatcctcattcacatgagctggtacctcgttatgggcatttctttgcaaaacgtcttccgtaaatcctcgaaatgacataaccgcgtcttcattacgcgttccaaaagccggatcattcgttactgcatcaggtaatcttttcaaggtataaacccaaattgccggttgatttctgtcccgctgccaccgttgattggcttcaataattcgctgccgctgtgctgccgataataaatgtcgctgatcctgaatcactggctgcgaacttgtttgtgcatgaacaattgtactcagtccacaaattgtcagcaacgtcgttaaaccaatcagccattgccatgaccttttcttaagcaataccctcatccccaagtgaagttgataccttgattatgacacttttaagtcgtgaaacaatccctggtttcaaattttacttgcgaatcaattttgacagtgtcgattatttcgatctaaaaaacagctttcgccaaaatgactgatggtgtgtcttcgctgaacttttggtttcttcgtgataccgcgccatcccctctcgaaatgggttattcgccattcggttaatcgatggttgcttgggctcagtttgtgccactggtaatcgccgatgacaatgtggacacacaaggtcacccgttttcaatttagcaccacaatatggacaaaatgaaaagtcttcagctgtcattttttattacctcgatttagtctgatgctgctgattacgttggcgacgtttttcagcctcaccctgttgcttagcggcattttgttgacgcagttcgacctgcttttgtttttggcgattctcttcatcaaccaatttctggttagttgccttcaattttgccaccataaagttccaagcaccgattattaaataaacactgacaatcgaataaggaaccgtccaccatggaaaatacgagccgtttttgtacacaagtggccctatcaagttatataaaaccatcaaaacaacaattaaggtggctgtttgtaaggtgtcccttaaccactttggtaaacgagaattggttttctttggcatggtcttctatgtctcccttcttaagtggttatcccaaaaaccgacacattaaataatagctgattagactgaaagcgtttgaaagcccagcagttcccaaccatgtcaaccacccagtctcatatcaacgttcagaatcggactggctacttagccgaaacgtgtgaaaagagggctgatcccggccatgtaaccccaccaatcaaatattcaaaaccagaaataggctggctacctagctgaaacgtgtgaaaccaagcaaaccccagccatataagtacttcaaccagatattctgaaactggagatcttggactggctacctagctgaaacgtgtgaaaccaagcagctcccggccatataagcccaccaatcaaatattcaaaaccagaaataggctggctacctagccgaaacgtgtgaaaccaagcagctcccggccatataagcctctcaacctaatattcagacccagaatattaggttgagaggcttatattctgggagctaaccgcttggtttcccactctttatacattattctccaccaaataagccctaaagtaatcaaaagccatttctctgatagattccacaccgatttttcttgtcaattcttcgtcctgctcatccacatccagcaactccaccgttaccagaccactcgcaaaatcgaaatttgttggataaccaacaaaattatcctggttggtcatttcgaatctaatcaagcgatgatactgaattgcctgcgttaagacatgaaccaggatatcatcagcgttgtcaaatgctcggtctgcatttaataccggtaacgcaaagttcttagccgctttatttaccttaacgaattgatcaataatctttaaataatccgcatccgtaatgaaccgcttaatatcatcataccgaatccaaacatagccaccaaactgaccattcatatcaacaaccatcatcactaattcacgcgaattgctggcgataatttgaccaacataaaaatatcgccgcttgtcattcgtatcaatgatgagccattgaccactcttacgcaatttttcagcttccaccacaaattgatccggatcagtaaccgttacgtcttcaacgtgatttttcggatcaatcagtgaaagcgcgtcttccaataatttcaattcagtgccaccaaattcaataccacggatatcggtatagggaatatcaaaaactggtcgctttgaaaaatcaaatttgtttaaattcaaaaatgttaagtgatccggttgaagttcctggatcaaaccttcgttataggttagcttgccgttttcgatggtaatgaccaaggccacttttgtatcttcatgaagagtttgaaccaccctgtcaaacaacgtgtcactcattttaatcggcagatcaaaggatggattagctgacaggtgatgcacttcatcaaaagaaatccgctcctttatatttgccaaatcataactatccgtttccaccgacttaaccgaactaattttcaaataaacttccccgtcttgaagaccataatcgttataagttaacatgataaaatcagttgaactcaaaaattgaatgatcccagtatagacaatgtcactgtcgttttggaatgcattaattaacaattcatcaatttgggcagttctaagctgatcatacagtgtttccaagggtgcaccttctttctaaatctatcattataaataaaaatgcttacattgttaatagtacttcattggttaattatttagtgaaattatgcttggaatggttgcgaaatgggtgaaactaagtaagctgccaggcatataaacacttagaccagatatttcaaaaccgagaacatctggtcctgggctggctacctagccgaaacgtgtgaatccaagcaactcccggccatataagcctgccaatccaatattccaagcccagaatattggattggcaggcttatattctgggagctaaccgcttggcttcacactctgtttttatgacaccgcgtttctcacaaaatgggctaattcctttccactcttctcatcgcttaatcccaccagcaacttaattcttgctttttggccattcaacccttggcacaggattaagcccattttcttcaattgaatgccgccgccctgatagtaatagatatcctgggccacaccgttataacatcttgaaaccagcacaattgggatctgcctatccaacaacttctggattgccggcaatgtttgcggcggcaaatttcccgctcccagtccttcgataaccaatcccttggtatccgattggttaattgcgtcaaacagggtgccatccattccggcatacgctttaatcaaatagacaccactaaccacatgatcaatgtcggcaacttcggtttgaatcaattcctggaagtatttagccttgtcttgagtcacaatcccaattggcccaaacgttggtgttctaaacgtcgctacgtttgttgtatgcgtcttggttacaaaccgtgccgtatggatttcatcgttcatcaccaccaaaacacctttgccatatgattcatcggtagcagcaactaaaatcgcatttctaaaattgtacaggccatcagacccaatttcatttgatgaccgcattgccccggtcacaacgaccggaattgtatttggcaacgttaagtcaagaaaataagcggtctcttcaagtgtatcagtcccatgagtaatgaccacaccgtcaatcccatcagcaatcgccttgataatccgctgcttaatctttaacatcacctcgggcgttacgtgcggtgaaggtaaattaaacatttcatcggtaattaatttgacctgtccctttaaaattgactgttgttccgcaatcggattttcatcgttaggcacgatttcacccttgtcattttgagacattgaaattgtcccaccagtatgtattgccaaaattgttttcatgatctgtttttaccctccatcatcctgttaatctccattattgtaacgtagaatgtaagtaattgcctaacaccaaaagaaagaagtgagcttatggcaaattctgatagatattatacgcctcaagattcaaaagatgctatgcgtcaaatcgaaaaattatttaataaatataaagatgccccattaactcaggaattagttgattatcatcaaaacttggtgaaccgattaaaaactgatattatgcaagcggccaagaatgaaaacgttgcgtcacgaattgaatcaattgaatccatgatcaacgttatgacccgctggttgcaaatccgcctgtcaggtcaaccctttaacggcaaaatggcgggctttaaatttgttgccgacaacgctaagccgagcttcaaacgacgggttcacaagatcaaaggtggcggcaaccaccgtgccagccgacactagacccacgatcctcatttttagaaacggctcaatgggtttctactatattagtaaaactaaatcttgtacacaacccgttcatctcgttataatatattgttccattatttttacccaactaggaggattgctgcgttgagcaaaacgatcattgaattaaaaaacgtctacaaaaagtacgacgactttaccgcccttaaaaacatcaactttacactaaatgcaggagaattctatacgcttctgggaccttccggatgtggtaagaccacgattcttcaatcaattgccggcttcaccgaagttacaagtggtcaagtcctatttgatggtaagaaaattaacgacatccctgccaatcagcgaccccttaacaccgtttttcaggactacgcgctatttccaaatatgaacgtgtatgataacgttgcttttggcttggtcgtccacaaagtcagcaaagatgaaattgaaaccagagttcacgatgcactcaaattagttcaacttgaacaatatgcgcatcgggaaatttctgagctttccggtggccagcaacaacgaattgccattgctcgggccattatcaatcggcccaaggtgctcttactggatgaacccttatcagctcttgatgccaaactccgtaaagatatgcagtatgaattgcgtgatttacaacaacgtttgggcatcacattcctattcgtcactcacgatcaagaggaagctttggcaatgagtgatcatatctttgtcatgaacaagggtgagattctccaaaaaggatcaccagttgatatttatgacgagccgatcaatcattttgttgccaactttatcggcgagagtaacattattccgggaaaaatggttgccgattaccaggtcgcatttttaggtcaccaatttgaatgtgccgacgccgggatgcgcccaaatgaaccagttgaagtggtgattcgacctgaagacttggtcattacaacgccggaaaagggcaaactccaagttaaagttgatacccaactgtttcgtggcgactattatgaaatcatggcaaccgacaatcaaggcgatgagtggttaattcactcaacgaatgccaccaaggatgacgctgtgattgggctaacctttggtccaactgacatgcatatcatgcgttacaacgaaacggaaaccaagttcaatcaacgcttggaaacctatgaagattagggggcttatcatgagacgaagttttaaaaccatgttttacacgccttacatgctctggttggtcctctttgtgatctcaccggttgccttaattgtctattattcattctttaatattcatcatcagtttaccttctcaaactatcaagaattcttttcatcaggtacttatttaaccatgacggctaattcagttctgtacgcttttttaattacgctattttccattctaatcagttacccaatggcgttggtcatcagtaagctaaagcatcgcgacctctggattctactggttatcctgccaacgtggattaacctgctgttaaaagcgtacgcctttattggtctcttgagtcacgatggtctggttaataacattttccagttttttggcctgccggttcagcacatgttgtttacggacgccagcttcattctggtcgctgcttatattcaaattccatttatgatcctgccgatatataactcgatgaccgatatcagcgagtcatatattaaagccagccgggatttaggggcgacaaattggcaaactttaaccagaattatcattccgctaacgatgccggggattaagtccggtatccaaattgtcttcatcccttccctatcccttttcatgctttccagattgattggtggtaataaagtcattacgctgggaactgccgttgaagagcatttcttaacgaccatgaattggggaatgggatcgacgattggtgtggttctgattatttcaatggtgattgttatgttgctgacaaccactaagcggaacaggaggcgatcataatggccaatcgttcatcaaaattaggaagattgtatattattattgttttcttactgctctatattccaattgtttacctgattctgtattcattcagcaagggtaccaccatgactaattttaacgggtttacgttgacccactatggcgaattatttgctgataaacggatgttggcaatctttctggacaccattctaatcgccctgctgtcatcgactttctcgaccatcattggaacaatgggcgcattggcggtcaacaacactaagcggcggcatcaacgcgaaaccctgttatcgcttaataacatcctgttggtttcaccagacgttatcatcggtgccagctttttgattttctttactgcactgaaggtcccattagggttctggtcagtgctgctaagccacattgcctttgaaattccgattgtcctattaatggtcttaccgagactggatgaaatgagtccatcactcattaacgcggccaacgatcttggtgctacgaccggccaaaccctaagcagaattgttctaccggttattcaaccaggaattattgccggctttttcatggcgattacctattctctggatgattttgccgttaccttctttgtaactgggaacggatttagcaccttgtccgttgaaatttactcacgagcccgccaagggattagtttggaaattaatgccttagccggaattatgtttatcttctcgttaattcttgttgtcgtgtactatttcattgaaaatcacaatgctagtaaattaaagaaacaggataaattggaggtgaccggaaaatgaaaaagtttgcgatggtgtttatcgcgatccttgccatttgtgccggtctcgcctatgggagtaatcaactcaccaaatcaaccggtgattcgggcaataaagttctcaatttatataattggggtgactatattgatcccaaccttctgaccaaatttcaaaaagaaaccggttatcacgtcaatgtggataccttcgatagtaatgaagcaatgtacaccaaggtccagcagggcggcactaactatgatttaaccgtccccagcgattacatggttcaaaagatgaaggctgatcacctgcttgtcccgttggataagtcaaaattgaccggtctcaataactatggggcttcatttatgaataaaagttttgatcctggtaacaaatactcaattccctatttctggggtacactaggtattatctataacgaccaggatgttaaaccgggttctttagaacattggaatcagctctggagtaaaaaatatcgaaatgatattatgctgattgactcagctagggatattatgggcttctcgctcatttccatgggtcattcagtaaacgcaaccaattctcgggaaatgattgctgccaaggataaacttaatcggctgtcaccaaatgtcaaagcggttgtcgccgatgaaattaaaatgtatatggcagaaggtgaagcaccggtagccgttgattggtccggtgaggcgacggaaatgatgtcgcagaacgcacatttgcactatgtggtgccaaccgaaggcagcaatatgtggtttgataacctggttatccccaagacggccaagcattacaaggcaatttatgcgttcctgaacttcatgagcaagccggataacgcggcacaaaacgcgcgttatatcggttactcgaccccaaatacagcagcatttaagctactgccgaaaaaggtccgggaagataagcagttttatccgccgcaaaaggtcattgataaactgcaggtgtatcgcaacctgagtgcccaaaaggttcagcagtataatgatttgtatttggagtttaagatgaacaagtaagagtgcggaaaaaggcgctttgatcccagaatataactaaacaatctcaatgtgcctggttttgggcacattgagattgtttagttatatggccgggatcagccttttggagcacatttcagctcggttaataatccattccaccaatatgcctgattttgggcatattgagattgtttggttatatggccgggagctgctgcttggcgcacatttcggctcggtcaaaattccattccaccaatgttcctgattttggaacattgggatggcttcattgtatggccgggagctgctgcttggcgcacatttcagctcggcacgacgaaaaatccaaaatatccctaactactccaaattccgaataaaattagccaatcccaaccaaaagcattaaactgaatagtgaggtgaaaatataatggcaagaaaaaatagaaagcacgatattatcatcgatatggacgaatttatcgttacatatgcggcgaccctcttggatcccaaaaagaatctttctcaaatcgtttatgatgctgctaaagacgacattacaaaacttgatgatttatttaaagacaatggttttggccgtcagaataaatttttcaacatcggcgaagggtttgtccgtgactatgatggcttggatgcagaagaagctaaaacgcgggcaacccaattagccaacgaagcaattgactatcttggcaagaacaccgcatattttgaaagatggcgcactgactaaaatctgggccaatctaattagatcaacaataaaaatttaaccagcaaaggacccgctatttgaagcctcaatgatacttcaaatagcgggtcctttctcaattgctctgtcgcatgccatcaaatcgcaattcaatctatcagtcgaccgactttcgtgctattctcatagtaacttatcaaacaaattggacggtgatcatgatgagaataatcaaaccggttatcaaatattgctacttcgtgctgagtggtttgttggcattcttcttagtcctgctgttttatggttcaatcacctttccatatctcgtggataaaagtggtgccagcgcgcttcaattccaaatgaattatagccttgtcgatctttacttcttatttaatttgttgattcttctcccgattatcagacattatctgcctcgtctatacagcagcaaatccgtcgcttttgaaacatacaaagataaagcaatgaaacttcatcatcaagatattcagaacaatcataaaggccactcatggacacctgatcacgtcacatccaacccgtgggaatatagtgcttctcaaacacagtcttatggagacgtttcaacctggggctttaacatcttcaaaaactctgtgattaatattctggttatcttggttggcatcttatttctaattcccatcatcattcaccgaggaaaacagacatcaaaagcaacgaaatcgacggttaaatcgccatcatccaaggattaaattttgcacaacaagcttcgtcatttgaaccgccgagcaacattgtcacgaatgactacgccctcatcattagcgattcgaatcacatgattgtgagttgccgtttcccattttgaaattttttcagctagcgttggatcctgagcaagatgttgatcatagtgcggataaattctaatgtctgtcacgtgaaggccactgatatctttatcgtgaaatagattgtcttcaggataaatgacttgatataatccaagatcaggccccaaaacaatcgcaccggcactgatgccatatgtcggcactccttttaaaataagtgttctgagcacctgatccatcccggattccttcagactatgcaacagaaagaattcataacccccatttaaaatgatagctgccgcctgctttaacactgcaacatcatcatgataaacatcaaacaagattggccgcgaaacacctttttggattaaggtgttttttagtgcgatcattttaggatgctgttttccttccttaactgaattaacaataatgacaaccggccgatttttgtttccatccgccattaactcaaaaaaggtgtgcgtaatatgatcagtaataaatgctcttgaagataataaaatgctagtcattgcataacctccgatacctgttctgctcacaagtttattgctcattatatcactcgaagcttagccgttgagcatgtttatccaagcaaaattcattagttttctcccaacttgcgtataatgaagctgaattaattgcataaaatctttatcgtatctgaggggggaaaacaacatgacgaagaaaacaccaactacccaaacaaccacgcaaaaaaatggttggtggattttagtttcaattgggacgttcgcgtttatgtcaaatttggatgctagtattgttaatattgcaatgccgattatgtccaagcaactacacgtgccaatgaatgaaatcgaatgggtggtttccgcatatttgattatcttaagtgccctactgctgttttttggtaaactgggcgatttatatggcaaaatcaaagtctttcggattggaaccgttgtgttcatcgccggttcgtttatttccggtttacaaattaattttccatggttactcgttggccgagccgttcaggggattggtgcagcaatgaccctgtcaaacacttatgggatcacaacttcgacttttggcgtgaaagaacgtggccgggcaatggggtttgttggaacgtttgtggcattgggagccatcgccggaccgggattaggcggcctgatcctatcgcaattatcctggggatatattttctgggtcaacttaccgttcggcatttttgcaatcattctgggcgctgttgtgatgcccaaaaactatcaaacaactgggaagggaatcgactggttcggatttcttaacttttcgttattaattttcggcctgtttcttggcgtcttcctggggcaggagattggttacacagccccactaccactgattctattcgcgattgcaattatcacattctggggctttattcgcacggaaaagcgggccaagaacccactaatgccgctatccttgttcaaaattaaaccgtttacgtatggtttaggagcagctgtcctgatttttctgtccaacttctttaccgtggtcatcatcccattttacctggaagatgcgcggggactaagtgctgggcaagccggcgcactactcattatttttccggtcattatggtctttgccggtccacttggtggttggtttgctgatcattactctcaagccaaagttgcgacgattggtctggcaattgtggctttcgcccaagcgctctactacttcctaagtttgaccagtccaatctgggtctacgttgtgattacggtgattatggcaatcgggactgggctcttccagtcaccaaacagtgatatcgtgatgtctgtcgttccaaaggatcaactgggaagtgccggcagcctgaatgcactggcccgaaacattggcatgatttccggaaccgcgttatcaaccagtacccttttcgttggcatgagccttaaagccggcttccatatcacgacttatctgccgagccaaccagagacgtttatcttcgggatgcacattgcgttcgccgtctctctggtaattatcattggggctttcgtgctttcagtcatgcaaggcaaagcggtaaacccggctgatttgaaataatcgctgataaaatcggctaactcattgaattgttcttgggtctctcaaatctgaatccactgcaaaattaaaaatgttaaaccaccagcttattgataaataactgtataattaagttggaactgtggatcaggccttgcaaaagggggtcgatcatgatgaaattcaacaaaaatttttataagacctacgttttttggcttggaattattggtgtcgcactgagcttcctggttgtctttgactcgacaccgccaatgttcagtactcgctggtggatcgccttaattgttgggattgcagccttactgggaattatttttgttggaccacgggcagtaagcgaggctaataaaaataaaaagctttaaatatcatgatatgtatcaaaaaagctgagacaaaatttatctcagcttttttgatgcttgaatttacactttaagtgcaacactaattaaataaagaatggcccatggccaaatttctgtaaaatgatgtttgcgaaaacaatcatgaaaggaatttagccatggaccactacaagcatattacatagatgacgcggaaactatcttttaatgaggaatcatggaaactcacttcgtgagatggccagcatatcagaaaatactcaaccatttctcgaataagccgtaattctactggtaatcctattcaccttcgaaggctcaggagaagtacaaacagccaaaggcaacctgtggcagagtctctcttataatctccgcggtgtttgaaggggtgagagaacacttctgcgaagaccttggtctccggaggaaatctcgaatcgcttggcatcgaaaagtaatccggtgcagatcagtaccacgactatatttaccgtgggattttcaatggcttatttgatatttgtttaatctggcagctctagtgccgtgcgcatctatggcatcacgcaagatctcgccacaagaagcttatgcaggaaaaacgaggcacgattccaatccccaacaagattcatgatcgtccgcagaagctgacaaccgtgtagaattggtcactggaaggtgataccgtgttaggcaaaggcggaaatggctttggtcgttacattggttaaccgaaatctcgttacctgcttattgtaagctgctaaagaacttcagaagcagtcacggatactttgagcgacttaatgaagctatgtacgggtagattcgtttaacgataccccggtagagggggtaagagtttgccaaagttcaatgtttaactgataagttggtacgccccttctactactttcccgatcctcactctccttggcaacgaggactaacgaaaatactaacggcttgcttcggcgaatatttgccaaaaggaactgaccttgattcaatgaaaccaattactgaccgccggatacaagcatatgcagaacaaatgaataatcgtccccgtaaatgtctcggatggaaaacgccttatgaaatattctttaatgtagtgttgcacttaatttgacaattcaagtgcaattagccgatttgaataaatgcttattccagattttcaaacaaacttcataaaaacttgttagaatgtcttcaaaacatttaaggagattgactaattgatatgaatgacaattataaagaacgtcgactcagccgaattaaacaccagattacatggtggattgtctttctggccttgtttcaactattctggaaattattatttttaatctttcgaaattttattgaacaacttagttccgtcaattacttttccctgggcggcttaccgttgcttttcttgattctgatcattatcgcaattccaacactcatactgacccattggttactgggaaagctggattggtaaccaaattaatcagcacctatgacgtccaaaaatacaaggagggaaaaatgtttcgaccatggtcatcatctcagttagcatgtcttggcttttcattttttgtgattggcggtggcagattatttttgttttataatgagatgaccaattttgcacgaacgctatgcacaatcctcatcatttgcagcattgtattgttaaccgtttcattaaaaaaataccataacaaaaagaaccaataatcagccctgaagtaaaaaattgatttcataatttaaggagggcgataactaatggcaccaattttaattctaatccgcggtaattccgccagtggcaaaactgtattagctaggaaactgcaagcccatttcggctacccaaactgtctcctgcttcaacaagatgtcctgcgtagaaatctgttacatgcgaatgatcatcccggtactcccgccattagtctgatcgaaagcttagtcacttggggtcaaaatcattatccaatcatcattttggagggtattttgcgaaaagacgtctatggacaaatgttacaacaaattagtcagcaattcggtcaccatgcattcatttattacctcaatatttcttttgagcaaactttaaaacataacgccaaaaagccacagccattttcatcaaaactacttcaaaaatggtggttacccaatgattacttatcaccggatgaccgacttctcgcaaacggcaatacagatatctttctcaaaaaaatcattacagatgtaaatagcttataattaacaataagttagaaaacattctgattaatttagacattattggcgctttacccaagaaagaaagtcctcattatgattaaactcaccaaacaacagctattaagactgccatttactcaccatctgacctatggatccactcatatccaatccactgacagtgccacttttaaactggatccacaaattctggcagtcatcgattcatccggaaaaattaccccgctgcgacatactgaaggagctgaaagtaaccagcttttacaaaccactcctcatcatccgactcttgttaatgacgaaaagaacgaacgcttggatttaaccaaggagacaagaaaacgctccgaggcaccacaaagcgctggctcttcacaattatcaagcaattattctccacaagataatacggtcgatgacggcaatccactatttgatatcgtcggcgggtatttgtttggtgtttgggcggccggcggttttgaccacgataacgcaatcaccgattttcttttcaatgacgtggacgactttacaaagcacgatctggaaacccgctttgacgataacgaccatgagtcactcactcacgctgatccatttgataacgatcagggttttgattctgacgatcaacccaacgatgaaaatgactttagaagcgattacgataccgatgacggtcaatttgaccacgatgatcctgatgacaccgatacttataatagcgactttgataatgacgattttgataatgatgatcagtttaatgacgatgatgaccacaatgatggggatagcgatgatttcaacgatacgcttgatgattctttagatgatgacgatggggatgattatgatggtaatggtgacggcgacaataattggtaataatctttttctaagatatttaataatcggtatcgtagtcgttctttggagttggtgggacttaaaaaagaccaaacggattcgacaaactcctcacaaaaccatcgctaatcaatcaaccccaccagtaaaaggaccacaaatcaacaaagagccgccaaagatgacacttcctaccttaacagacgccgcagccaaccaacgggctcaactaattggttatttacaagacgcgcccaaaatttatcggtatgtcagcgaatggttattttttgacagccagcgctattacgatatgcccagtcaattgttccaacaaatttgtttattcggatccgagtcactcaccggcacttctatttatcaagatcccttagtagccgtcaaaatttacgaaaacgatcctaacagtattcgcaccttggtcaaattgaccaaggatggcaaactccaaactcattctcaggcgctggtcaacttgaatccccaaaatacagatgcggaaaacaagcggatcttaggtacatttacctatgaattgattgctgaaaaattattaactgacggactcgacatcccaattgcaaattatcaaaggagtaaaattggctgaaagatactaaaacatttgagctaaccattttagcaaagtagcaagaaaacacacttgaagtcggctgttgcaatctattttcactttggttacgtttagaaaaaaatagtgggaccaaaggctgcactctagaagccaactttggtcccacgtctttttccgttccgtgatttatccaaaagagctgagacaacattaccgtcgtcccagcccttttaatctgttaacataacaattcccaaaataaagtgcataacaaaactcgtttgctcagtcttgttgacgaatcttagttgcctgccccttcttcttccgatactgaattcgcagcaatttaataatttccgttacaaccagaacaacgaaaccacagatgattggaatccaccaaccataatagaagttaacgttcgccgtgtggaaaatctcctgcataaacggtacataaatcaagaaggcctgtaaagcaatcaagataccaataatgccaaacgccatcttattttcaaagaaatgcttggaaatgattggatacgagttacgaatattaaacagatagaaaatcttaccaaagataatgatgttaacggccatcgtactacccaaaattggattgatcaggttagcatcaacaaatcgatcaaaggtaaagattcccagcgaggatatcagaattgagacatagacaatctccacgacatccatcttacccagaattcccttcatcacatctcggggccctctgaccatgattgattcttcagctggctcaaagataaacgcaaactggatggttaacgctgaaaccgtgttgatccacagcaattgagttgggtataaaggtaactcttgtcccataatcatactaattaggacaaccagcccttctgcaaagctagtcggcagtaggaaacgaattgtcttttgaatgttatcaaagacatgccgaccttccgataccgcatcaacaattgttgtaaaactatcattaaccaaaaccatgtcggcggcttccttagcaacgtcggttcctttaattcccatcgcaatcccaatgttggcctgcttaagcgcggcagcatcgttaaccccatcaccagtcatcgcaacaattttggcattggcctgctgggctttaacaattcgcagcttattagctggcgttgtccgagcgaaaacattgtaacggccaatgtttttaaccaactcttcatcggacatttcgtcaacttccggcccggtaatcgcgtgaatactttcatccaagtccaatttacgggcaatggcggatgcggtatcgggatgatcaccagtaatcatgttaactttaactccggcgcgacgaagatgttgaatggcaggaatgacttcctcacgtgggggatcaataatgccaacaattccgcttagcttaatgccctgtgaaattttatcctgatcaatctcatcacgatcacccgcgactgacttggatcccaaagcgaccactcgtaaaccatgttcggttaaatcagtcaccttttcaaaccaggcatcttcgtcaaaactcggatcgctttgtttaaccatatcaaaaatcgtgccgggtgcacctttaaccatcaattcattgtggtcggttcctttaaccagccttgcgctatagcggtacgcggaatcaaatggcagtgtatccagttcgtcaacttccggttcgtggccaattaacttatgataaagcgtggtcaacgcaccatccgttggctcaccggttaagctccactcgccgtctgtattgaccaactcggcatcagtggttgtcccggcaatcgtcactaatttagcgaattgagaatccgattgccagtcgaacttcttgtcgttgagcatcacatcaccgtcgacacccttggcattgttaacgaacccgattccggtcacttgataatggtgacgatccgtaatgacatcagtgaccgtcatttcgtttttagttaacgttccggtcttatcggtatcgacgatgtcaactgcccccaacgtttcaaccgctggcaacgttttaacaatggcaccctttttagtcatcacttgaacgcctcgtgccaatacaaccgaggttgaagcaggcagtccttcaggaattgaaccaaccaccatcgtaataatggcaatcgtcagcactggcaaactatagattttagtatatagccccatgaagaacaacaagaatgcaatcacaacgataaagaccgataaattaacacctagcttgtttaagttcttcatcaatggtgttacctgggtcttaacgtccgagacactttgctgaatggtaccaatctccgtatttgaaccggttgcggtgacaattccaattcctgatccttgggtaaccgcggtcgacgcgtaagccatattggagcgttcggctaatggaactgaatccttggttagtggatcctcagttttttcaaccgaattactttcaccagtcagcgttgactcctgaattcgcagattatccgcggaaatcaggcgcatatcggcaggaactgcatccccagcctccaaattaaccaagtcgccgaccaccagctcacgtgccggtacttcgattttttgcccattacgaatcacgtaattttgactaaccaacaattctttaatcttggtcaacgcattatcagcttgaatctcttgaaagaatccaataaacgcgttggcaataataacgattccaattactgatgaatcagaatagtgatgaagcagcaacgtaataaccgccgcagcaatcaaaatgtaaatgatgctgttgttaaactgtgcaatgaatttgaccaacttgctcttcttcttaaccgtcaactcgttgtaaccatcacgcttaagccgttgagcagcgacttgttcgcctaatccatcctcggcattggtctggtactgctgaaccaagtccgcggtactacgctgccacagtctctgatcgggaggaacctcattatttttatctgccatgtaactatcacccttcttttcataaaaattagttttgttctaacaacattataatatattggttggcgctttggcgaatgaaaaacattagagtgtgacagaagacgctttgatcccagagtggaagaagattaaccgaatattctggtttttagaatatttggttaatctttttccacggccgggatcagtcttctgtcacacgtttcagccaagtagccagttcaaatacatatttcgaatttaaatcttagctttattaggacacctatatgactggaagctacttctcagagccccttttcctagcaactttctacttcctagtcttcaagagctacttatctaacgtggcacaaaatccgaatttgtccgtctccaagtactaccaaaaaaagtccagttagaagccgacatttatcagtttctaactggacttatttatattgcaaccacaaagattactaaagaaacgaaggacaacagaggtaacttccagtcgtatatgagaacaattcaaatcatccgaaccagaataaatgaatcattcatttacatcttgaaagcggactgcactttgtccacttctcattattaaaccaaattaatgattatctgggccaagatatggattgtccggtacccgaaccaaatcgtcggcaaccagtcgttcagcaatctgaacggtgttccaagcggcacctttaagcaggttatcagaaaccacccacatatgatagctgccctcattttcgtaatctggtcgaacccgaccaacaaacgtatcccgcttaccttcagctaaaattggttgtggataaatttgatgagctgtatcgtcttgaaggacgacaccggatgcggccgctaatgtttccttgatttgatcagttgtagcactcttgtcagcgacttcaaagtaaactgtttcgccatgagcaattcgaattggtacccgcacgcaagtagccgttaccttaatgtctttggcatccatgtcatcaagcataattttcttggtctcatgaatcattttccactcttcatgagtgtaataaccatcctgctcaaaaacatcgatttgaggtaacaggttaaaagcttgttggtaatgtttcttgtcacccttggttggtaaaatcttaggatcggttttttcaccgtttaagacttgttgggactcttccattaattcattgagtgctgattggccggcaccggaaacagcttggtaagttgaaacaatcacttgcttcaagccaaactttcgatataccggatccaaacagataaccatttgaatggttgaacagttagggttggaaataatcccgcgatgatcataaagtgccttttcatttacttctggaataacaagtgggacttccggttccatccgaaacgcacttgtattgtcaacacacacggcaccacgtttaacagcttccggtaagaatttcttagaaacagaaccaccagctgaagctaatactaaatcaacaccttcaaatgattctggcgtcgtttcttcaacagtgacgtcttcacctttaaactgtagcacttttccagcagagcgagccgaagctaacagtttaacattcttaactggaatggttgactgctccaactgttggatcattcgtgttccgactgcaccagtagcacctaaaattgcaacattaaattctttcatctcaacatttctccctcgtaacctattctgcaacgcttaataaatactcgctcattcgattcattgccaattgaatatcttcatcagaggcggcatatgataaccggacatagccttcaccgccgggtccaaatgcagaaccgggcgtcacaccaactttagcttccctagccaaagttgtcgcaaattcaactgatgtttcgtctattgtatcaggaattttggcaaaaatgtaaaaagcgccttggggcattgcgattgccatccccattttttctaaccgatcagcaatataatcacgtcgcttttcataagcttgacgcatcggaattgcatcatccaaaccattatttaatgcttcggccgccgcatactgagccggatttgatggtgccgttacgacaaacgcgtgcattttagaagcttcggtgacaaaatcctttggagcagcaatataaccaacccggtagccggtcatggcatgggactttgacaggccattcaccaaaatcgtttggccaggcaacatgctggcaatcgaataatgcttaacgccatacgttagctcacaataaatttcgtcagctagaacgaacatttgatgttgagaaataatgtcagctaacgcttggagttgttccttggagtattcaaccccagttggattagtcggatagtttagaataattgctttgacactgtcgccattttcatcaagcgccgcctgtaatttttcaggggttaaaacaaagccgtcatcagaagtatcaatagtgattaattccgcgcctgcaaccttaataattgggaaatacagcgcgaatgccggcgttggaacaatgaccttatcacccggattcaacattgaagttaatgctgaaaagatggcttcggttgcgccaacggtaacaatgatttctgattcaggatcataatcaaccccggttcgttttttcagatagttggcaatgccactccgtaattcaggtatccctttttgcgctgaataatgggacttgttttcctcaatacttttaatcgctgcttgtttgacatgttccggcacgtcaaaatccggttcaccaatcgtcaatttaacaattcctggaattgaggagattttttggtcaaacgctctaattccagaaggcgctactgaatcaatattttcgttaacaacttctgaaagtctactatctaactgtggcattacgcatcctccatttatttgtttatcttataaaatattttccaagccaacaatcaatttagttgctttggctgcggctggaacggcaattttaacgccgttcataaatgagccacggtcaaatgaatcttggcggatcgttaatgcttcacccttaccaccaaacagcacctgttcatgggcaatatagccgggtaaacgaactgaatgaatcttgataccattgtaatcaccaccgcgaacacccgataatgtttcatcagatttaggcgttggatgattgccgcggacctcatcaatcattttagcggttgataaggctgttccagacggcgcatccagcttatcagcatgatgcatttcaataatttcgacgtccggcatatacttagcggcttccttggcaaacttcatcaaaagaacggcagataagccaaagttaggggcaataatcccgccaacgcctttatcagcagctaatttttgcagctcactgacttggtcgtcgctcatccctgaagtcccaacaactggatggataccatgttcgatggcaaatttaacattctcaaaagcggcagctggaatcgtaaaatcaatccagacatccgcatccgtttgaatatccttcaaatcaccaaataatttaacgttatcattcagccccatcccttgcatatgcgcaacatcaacattgggactataggcaccaactaattcaaagttgtcattctcattgaccatggagacagtcttttgacccatcgaccccataaatccggcaactaacactttaatcataagaaatctccttgtattcagagtgtgacagaagacgctttgatcccagagtgtaaggagattaaccgaatattctggtttttagaatatttggttaattttcttacacggcagggatcagtcttctggcacacgtttcagctaagtttccactccaattatctgaatattccggtcttagaatatttagataattaatttacatggccgggagctgccttctgccacacgtttcggctaagctcaaattccgacacacggcagggatcagtcttctggcacacgtttcagctaagtttccactccaatcatctgaatattctggtcttggaatatttagataattcacttacatggccgggagctgccttttgtcacacgttttaactaagttcaaattccgacacacggcagggatcagtcttctggcacacgtttcaacaaaatccaaattccaccacgcacaagaaatcagcattcggtgacccagcgtaaccaatttccaacggtaaacaatttataccctggccttgcttgacaacaaagcgtccttttccatcccaagatgcatggccaacgtctgcttttcttccttatttaaggaaagaattggcaaacggcaatcgccaacatggtaaccctgggcatttaaaacggctttaacaggtgatggtgatgggtacatgaataatgcttggatctttggggttaaaaaccgcatcagatcaccggctgacttaacatcgccagcatccaaatcatcatacattttacgaatttccttaccatagatatggctggcaactgaaatgacgccgcggccaccaactgctttagctgccaaagcctgagcatcttcacccgtaaagacattgaaatcatcattggtattttggacaacgtattcaaagtcttccattgatgtacattgcttaacaccggcaatattcgggttcttcgacagctcaacaatggtatcgttagccattgttacgccggttcgaccagggatgttataaataataattggaatcggtgattgttcggcaactgctgtaaagtgagcaatcattccccgttggtttggcttgttatagtatggcacaactactagtgcgtaatcaataccggatattcgaccaacctcagcggtaaatcgtgcggtttctcgagtgttattgctgccagttcctgcaataatcacgccccgaccagctacgatttgagcaaaacgcgtatatagttcaattttttcatcatgggtcaaagttggtgtttcacccgtggtgccaccaataacaaagccgcggctgcctgtttccaaacaatgatttgttagtcgttccaaagcgtcaaaattaatcgtgccatcgtcaccaaacggggtaataattgctgtcatgatatctgcattaatcataaaaatccctactttctttaatttgtttgtctgttaactatccattacttttatctgcaaattacacttgattttaaataattagttacgctcctgctgtcgatattccaaaaaatcaacaattgaatgaatccctttggcaattgatgattcctttggatttaatgttgacgcgtgaagttgtgacttcggatcgtcaactcccagccaaaacatggttccgggaatcttagataataggtagccaaaatcttcgccagtcatggctggttccgtttcaacgaattcagttgccggatcctgtttggcaaattcaatgaatcgcttggttaatgccgaattgttttcaaccggtaagtaaccgccctgattaaactggatattgacttgcgcaccgtaacttatcgccaccccattggcgatctgtttaagtcgggccacgatatgttcaatcatcttttgggttaatccacgaatcgtcccttcaattctcgcttgaccggcaatcacattccgaatggtaccggcgtccagtttgccgaacgtgatcacgccgccttcaattgggtcaacgcttcgagaaataattgtttggacttggccaataaattctgcagcggcaaccaccatatcgttggcagcttgcggataagccgcatgaccactcttgccaatcaaatcaacgttcacttcagtcgttccggcaaacaaggttcccatccgacaaccaatcgcgccggctggcaaatgaggattgtcatgcaacccgtaaaactcatcgggtaaccatttacctttaaaagtcccttgttcataagcaaccttaccgccattttcactttcttcagcgggctgaaagaagaagatcaagttatcttttggctggtgttcactaaaccaattaaggacacccaacgcaacggtcatgtgaacatcatggccgcaagcatgcataataccggtattttttgaagaaaatggtaatccggtctcttcggtaactggtaatgcatcgatgtctgtccgataaccaatcgttcgcttaggatcactaccctggatataaaccaacaatgccgttggtaaatcgggtaattcacggatttccaaatttttctgattaaacgtctggatcgtatttaataggaagtcatgggtcttaaattcatgcattgccaactctggatactcatgtagatggcgcctaatatcaattaattgttcagttgttaattgtgccatctaatcacagctttcttaaatcatcttcaagacccgtcttcgattccgttttggcatccacatctttaattttacgggccggcatgccggcaaccatggtatgtggggcaacgtcttcggtgacaactgcacctgcagcaacaaccgcaccctcacccacgtgaacgccttcgatgacaaccgcattggcaccaatcaagacattgtcatcaatttgaaccggcttggcggatgctggttcaatcacaccagccaaaactgcgccggccccaatgtgtgaatgcttcccaaccatggctcggccgcccatgacaacgcccatatcgatcatactgtcatcaccaatttcagcgccaatattgataatcgcacccatcatgatgacagcgttattaccaattgtcacgtgatcgcgaatcacagcccccggctcaatccgagcattaatgttttttacatttaacaatggaacagctgaattgcgagaacctgcttcaatttcggtatcgctgatcatcgccagattttgttttaagaagggttcaacatccttccaatcaccaaacaagattgccgtgtgggcttcaacaaaagctttgattgtgtcaggaatggtcacttctgataacgatcccttcacataaactttcaccggtgtctttttttcagcgtttccaatataatcaatgatttctcgtgcgtttagttgtgccattatctttctcccttattattagtaattaatttttaatcaacatccgtttttataattcgttaatctgataaattaaatggttcgtctaaatgaaccaaatcttcaaaactttcacgtttaattgcgacttgtgaatgcccattttcgacaaacacaacggctggccgcggattacgattgtaattagacgccattgcgtagccgtacgcgccggtggctaacattgccagtacatcacccggttgagttgcgggcagatcctgcttttgaattaaaatatcgccggattcacaatatttaccggcaacccgaaccgtttctttaatgggagctttaggattcttggctaaaactgcttcatatttcgcctggtacaatgccggtcgaatattatcacccattccaccatcaacagtaacgtaagatctaattccaggaacatctttgcggctgccgacggtatacaagttgtagcctgccggaccggcaattgagcgacccggttcgatccaaacggccggcattggtaatcccaactcatgggtccgctttttgatggccttaacgatcgcgtcaacaaacatttccggagcaatcggatcatccgcttgcgtataacgaattccaaagccaccgccaacgttcacgaccttcgccgtataaccgatttcttcgtgccaatcccccagagtatcaaccagcgttgtagccgccatctcaaatcctttgacttcaaagatttgtgatccgatgtgagcgtgaattcccaacatcgtcatccttggatcggccaaaacttgatccaatgcttggcgagcttgaccacttttgaggtcaaaaccaaatttgctgtcaacctgaccggtctgatcatattcatgggtatgggcagaaactcccggagtcacccgcagcatcacattaatatggctgttgcgctcttccaatacttgcttaagaaggtcaatttcatgaaagttatccaacatgatgacaccaatttgatgatcaactgccatttccaactcttcacgagatttattattaccgtgaaaactaacgtggtccattggaaaaccggcttggattgccgtgtaaagctctccaccagacacaacatcaatgtggccgtgttcctgattaattagttgaaacatggcgatgcaggcaaaagctttgctggcatagctgacggcataatcaacatcgttatcttcaaacaccttttgaaaatgatggatttgatcgcgaatcgatttaacatcgtagacaaccagcggagtgccgtattcctttgctaaatccaaagtgtcacagccaccgatctctaaatgtcccgcttgattcgttgttagttggtcaatctgattactcattattcttcctccaaaggtgttgccgtttattttgtataaaaaaatctctttgttcagccgaagatgctcgcactaaacaaagagatttcagaatttttattgaactgatattctttatcaattgtcgttagcgccccgcagccgacatgttagctgcgacagtccaaagcctattaagccaagtcccagcgcgccaagccctacttcacttggtgcttcggcaaccgccccttttgccagcttcaaagttcaagtaggaactccactggttactgatgttggttgcaacctctaatgatttaattgacatcattctataatgtctctcataaatagtcaacctttgattgccatgagcatgtgagtgaattgctaatgagcccgtctgatgtgatgttgccagccgcaagaaaatatttggtgttgaaaaaaatcacaaagatgctaaaattcgacttaacgaaatctaactgaattttaaattaatgggaagacccagggagagaattgataaaatgaaagtcgtaaaatttgggggtagttcattagcagacgcagcccacgttgaaaaagtcattcacattgttcaagcagattcacaacgcaaggtcgttgtcacctctgcacccggcaaacgatttactggcgacatcaaagtaactgatttgctgatcaaatacgccaatgccactttgaatgacgaggccaacaactatgccgatcaaatatttgatcgttaccaggaaatcggacatggttttaatgtgcctgacgatgtcttaactgacatctatcgcaaacttaaggcgttacccacccgatcctatccaaataacgactatttaatggctgctttcaaagctcatggcgaacgattaaatgccgaactatttgcggcctgtcttaatcgtttaggaactaaagcccgcttcgttgatcccagtgaagccggtattttattgagcgacgatcccaattcggcatcagtgctggaagaaacgtatgatcatctccaacatctgtcgtatggtgacgaaaaattagttttcccaggtttctttggtttcaccgctgatggcaacatcgctacctttgcccgtggtggttccgatattaccggttcaattttggctcgcggacttcacgcatcactctacgagaattttaccgacgttgacgcaatcttcgctgccaatcccaaagtcgttaagaaccctgccccaattgccaaaatgacttttcgtgagatgcgtgaattatcatatgcaggcttttcagtttttaatgatgaagccatcattccggcgatccaaggtcaggttcccattaacgttaagaatacgaataatcctgacttgcctgggacgctgattgttccggaaaactcatttaaaccaactaaatcagttaccggaattaccggatcaaatcgcttcgctgccctttatctgcatcgttatctgctgaataaggaagttggtttcactttaaagattctcaagattttatacaaatatggggtttcttacgagcatatgccctctgggattgatgacctcaccatcatttttgatcgaaatcaactagataatgaaaccatccataagatgtgtgcagacatcaaagcaaccgtcaaacctgatacactggaatggattgatgactacgccattatcatggtagtaggcgaaggaatgcgggcacgggttggtacgattgaaaatatcatccgaccacttgccgaacacgacatcgctgttcatatgattaatcaaggggcttctcggatttcaattatgctgggcacacgtgaatccgatgctgacgaagctgttcgaaggatttatcaacacttcttttcacaagcgagcagtcaatcggtgactccttcgaagaatgcggtatactcggaataacagagcgggccggaagctgcgtttggaccgcattttcactcagtaatagtcgtaatgacacaaaacaggactggatattttattatcccagtctctcaatttaaaaacttggaggaatagagatatggttcaattattgaaagttcatggctcacaaaataagttctttattctcgatcaaactgaattagccaatcagttgagtcaagacgaactggtcgaactggccaaacatattactgatccccaaagtggcctattagacggggctgacggtttattggtcatcgatagttcggaccatcccgacgttcttggcagtatgcaagttattaatacggatggcagcattgcttccatgtgtggcaatggtctacgaacggtctcccgttacttgtcagataagtaccaccaagatgcctttaaggttcagacccaagacagtgatttagatgtccaccgggaaactgaattagcaccaaacatcccgacctttagcgttgaaatttcaccagtcacgtttaacaaagaatccctaccatttcaaaacttaggaaccgatactttaattgatcaagaagttccccaatttgcaaagggactgaagttcactgccatcgcggtacccaatccccatttaatcagctttgtgactgatgatgtgatgcggtcagacacgttgggcaacttgggaactatgcttaatcgtcctaacgattactttacagatggtgttaacgttagttttgctcagattttagacaagaacagcttgtttgtccggacctttgaacggggggttggctttaccaatgcctgcggtactgggatgtctgctaccagtcttgccttttgcttaaatcatcctcaaatggccgattttgagcaaactatctcagtctataatcctggcgggatggtcaaaacccgggttcacgataacgacgggacataccagattgatttaattggcaatgccactttcactcataaagttgatctcacagaagccgacttacacgataacgatttaagtcacgcacaaattagcgacactggcgaacaagccgcctatctggattttgttaagggactgcagaatcagaatgtataggtcactttgaaagaacagctccttcgttaagggttaaattagtacgatattgaaaaatacgagagtgggacgaaaggcggttaacttccagagcgtaatcggattatccgaatattccggacttgaatgtttggataattcggttacgtggcaggaagttgccttttggcgcacgttttcactcggtaataatcgtgattacacaaaaggggctgggacaaaagtaattttgtcccagccccggtattttttataactagctcttgagtttcaaatgaactgcaatttccaaaatgtaaggtcctgtctgggctggtttttaactgcgaatggccttgctatttggtcaaaacgtgcaaaagccgagcagcttccggccatataaagttccggctgggctgatttttaaccgcgaatcaccaatctcatttatctaaaacgtgcaaaagccgagcagcttccggccatataaggcacttaaacccagattcaaaacaggaatctgggtttaagtgccttatattctggaagctaagcgctcggttttgcactctccctcatccacacctcatgcaccacctgcgtttccaacaccttacaaattaggccaatcaattgatcctgcatataggttttggcatcgaaatccaccttgttgccattaattgccgttattcgcatctcctcggtcttgacctcaatattgtatttggcaaaagttgccacaattgcttgtaacttcgcttcattcaacattcttattgtcctcccaatcgtaactttggccgccactcgtcttggcgtgcctgactttcctttaacctcagatccatgtatggtgtcaccgataacaagaaatccttcacgtcctcataatgagtcttgctggaaaaatagtgattcgccttacgctgcgataacttatcgattttagcttgcaactgttccaaataatccgtaaccaactgaatcgtattttcccgtaaactggcaacataggcaatcttttcatccttgggatcctcaatttccagttcggcctttacttgaaacttctcaagctgctcagaatcagtgtttaataacatcaaatcattattttcaatggcctgaccaaacgttttcaggtttgttttatccaaatagtccggtaattggctctccggcactcgaaccaatagctgggcttctcgggtaatgccggcaccaaatttaatatgaatcacaaaatttttcttgccaatataattaacgttatccaaaatcaattgcggattattggtcactacccgccccaacgcaaaatagtgatcgtgctttgccgcaacaatctgaccaaaatgtggctgcatgttaaccatcccatctttatttcgacttattaatgttttaattgtatacgccgatttctgaaagtacaacttcaaccgggtaacggatcattcaaaaattcggtataatgtaaggcgtgcaaattttgaatgcggggagggtgttaaaaatggcagaacatcaaattgggatccgggaattagtcgagtttttacgtcgcagtggcgatcttagtccggccaccagcagtgaaaacaccgcccgcgaaggtagtcggattcaccgaaagctacaacatcatcgtcctgaaacctatcaatcggaagtcgccttgaaaacatcgtttgactatctcgatgatagctatgtcatcagtggccgggcggatggaatcgatcttggcaatgacaaagtcctaattgaagaaatcaaaacgtccgacttagcctttgacacccttccagaatcaacgctaaagctatactgggctcaggttaaggtttattcatatatctatatgcaagacaaaagcattgacacgattgatatgcagcttacctatgtccagacccccgacgaacaaattacaatccggaagcaaccgattgacttaaccgaagcaactaaattttttgacgcattgatcaaagaataccaagagtggatcaagctgcgccacgaactggatgagcgacggattaaatcagcccggcacctcaaatttccgtttagcaactatcgggccggccagcatcaacttgctgccaacgtctacaaaacgattgcgctcgaaaaacatctatttgtggaagcgccaaccgggactggcaaaaccatttcaaccctctttccggcaatcaaatcaatgggtgaagctttaatcaatcggatcttttattttactgccaaacaatcgacccaccacgttgctgagaatacaattgggattatggcggataaaggattgactattgaaagcatcaccctgacagccaaagataaaatcatctttgatcaggaacgtgatcttgcccccgaagagaatccatatatggtcggctactacgatcgaattcgaccagccattaaggatattattcaaaacgaggatcaaatcaccaaaccacttattcaaaaatatgcccaaaaacaccaagttgacccgttcgaattttcattagatgtcagcttattttgtgacgtgattatttgcgattataattatttatttgacccgcaagttcacctgcaacggtttttctcagttcccgataaacaaaactgctttcttgttgatgaagttcataatctggtgcagcgctcccgggaaatgtattcggcaactctaactgcgagtcccattgatccgcttgtttcgcaattggcaaagaagaaggcggcaaatagcaaagtcatcaaaagcttacaatcgctgaaacgatcttttagacgatacagcaaaccagcagcgacaactgatgatcagcaaattgcccagttggcgccgctggataatttcaacaatacgttaggtgacctcattgaagttatccatgaatggttagccacccagaaacccagtgagacggttgatgccgttgtcgactactatttgcaatgtcggagttactatctcatcagccaattttacgatgacacctaccgcacccgaatcattatcgacgaccacaccattatttttcgccaattctgtatggatcccagcaagcaaatccaagcgagtttaaatttaggccgcgccgccattctattttcagcaaccttgagtccgattacttactaccaacgggtattaggcaacgaacccgatagcttgtgcatgatttcagcttcttctttcccccaacagaattgccaggtaatcattgccaacaatattaatacgctttatgccaatcgcaacaatagcatcaaaccaatttgtgacaccattttaaccctcatttcccagaaagccggccattacatgatcttctttccatcaatggcctatttgacaatggtccgagaccaatttggccaacaacatcccgatgcccaaatcctatcacaacaagccgaaatggataatacggccagaattgatttcttgaacgaattccgaacagatccccaacaaaccaaggtcggttttgcgttattgggcggtatcttttcagaaggcattgatttaaaaaacgatcaattaattggcgtgggtattgtcagcgtcggcctacccgggatgaacaaagaatccgatttaattcgcgactactttgaccaactaaacggtcaaggcttttcatacgcttaccaactccccgggttcaacaacgtcagtcaggctgccggccgggtcattcgcactgacgaggacaaaggcgtgattgtactaatggatcaacgatttaatcaaacccgataccgtcaaatttttccaaaacattggaccaacatcgaagtttcaaataatcagacgcaactaaaaaaggaattgaacaacttttggaaaaatggcaatcgataacagtgatattagtacaatcttatcatttgggtgtatactaatatcgctgttcgttaattgaattaagccaggagggtttgaaatgaaattagcaatgtacaacaaaaagccaacgtttgtggcggcccaaaacgatcagctttggggggttgcaatcactggctatgactcaatcgacgatattttacatgattggcagtcgtttctttcaaaagttttgatcgatatttctgacgaaaaaattattaatgacgatcgcgctgagttgcttgatgccaacaaattcgagcaacccgtccaacatccacgccaattaccggcgatcggcttcaattatctcgatcatatgaaagaaatggatacgccaaagcccaagcgccccaatgttttcaacaagtttgtcagttcattggccggcccatttaacaccattcatttaagtagtgataccgtagattgggaatcagaactaatcattgtcattggtcgtggcggccgaaacattagccgtgaagacgcggaagatgccattgccggttacatggttggccaggacatttccgaccggacgatgcagtcaattgatggtcccagcacccaattcgatctcggaaagtcatttcggaattactcaccggttggcccatatattacaacaatcgccgataccgatgacattatttcaaagaaagtcaccactaaagttaacggtgaaatcatgcaacaagctactgttggccaaatgatttttgatatccagacattaatttcctatatttccggtgtaatcgaactctatcccggcgacctgatttttactggcacccctagtgggaccggagttggcagagatccacaggttttcctaaagtctggtgatgtctttgccagcaatattgatggattagggacgattgagaccaaagtgaattaacgtactactatcggcaacgataaccaaaatttgacacgtggaaaagctgggacaacagtcctttttatagctatagattcaaaaaatcaggcctcacatttcgttcattcagaaatgtgaggcctgattttttggacactttatttttttgagccaaaatcgccacttatcaggccaacttctttagatttccagccaacaaaccaatacggatttcattagtggccgctgataatccccggactgctaatcttttgagctccaaattagccttcaagttattctttagtcggattgtggttttggaatatcaggatcaacctcaacattattcaaataagttttagagtaggaatttcgaaaacttgtcggcgtcacggaggtcagttgtttaaacacgcgtaaaaaatacttttcattactaaagcttaaatcgaaagcaatttcttttaccgatttatcagttgttaacaataattcttgagcctgttgtatcttaacgccattgataaagtgaatggtcgttgtcttctcattagcttgaaacagttgagttaagtagactggcgttatttgaaattcagtagcaacttgttcaactgatagcttttcatgactatgaattcgaatccaatttttaatgagttcaaagcgggaagttgattttcgcggttcattaatcgacacaatgaattgatgggaaagttcaattaagatgctcgaaatataataatttgctgccaatttagttgcacttgagtcattagcactatctaaaagttgccgaatgagaatggtgagccgttcaaaattaataacactgaataattgggggatttctatttcagaagatttcccaactaaggtcgtatcgtaggatgtcgttacggtaccactcggaaaaaagtgcatccagtaatattccgttccatttggggaacctttaaatccaaaatggcgaatatgtggtggaatcaaaagacaatcatattttccaagcgtgtactgttcagaaccaatttgaatgtaggccgaaccagacaacataataaagagttcataatcgccatcgttaataatattcttatgctgccaaccttcatttgcaaaatattgaccggctttaaaaaactgaacgggttcgtataataaaaatttgtatacttttttattcaaaatagacacctctactttcgatatgtatacctttatatgaattttattagtttttaaatgagttgtaaaggattattattaatactcgtaagcgcttactaaagcaccatttaagacaatgaattgctagtttaatagcaactaactcacaaatgttcatcgtaataattaacgcacttattgctatagaaaaatcgtacctattctgccaagtaggtacataaaccaaaggagtcgttgaaatgatttatgaagacgaaaattgtctctatctaagaaatggaaatgaacttttagaagtcagaccctggggaacaaacagtttgcgtattcgtagtagcaaatatgctcactatacggaacgtaataatgcactaaccgaaccgatcgatggtaaccatgcaattgtttcggtgaacgaaaatcaaaggaaaggcgaaattactaatggtaatttaactgcaaaaattgatgctttcaaaaatctgagtttttataatcaacgcgggaagttactgctaaaaggatttcaacgtaatcgtattgatgatatgtctgccggtattgatacagataaggttaatcattttaatagcgcattgaatatcgattcacgtgaatttaagtcaaatctcggtggtgactttgaattgaaagttcgttttgaatcagatccgcaagaaaaactatttggtatgggtcaatatcaacaggattttcttaacttaaaaaatgctaaattagaattagcccacagaaattctcaggcaagtgtgccttttgtattgtcgaataaaggttacggtatgttgtggaacaatcccgcaattggcgatgttaattttgctaaaaacgtgaccgaatggcattcgctttcaacaaaggaaatggattattggattacctgtggcgatacaccaagcgagattgaagaacaatatgctaatgtgactgggaaagtgccgatgatgcccgatttcgcaatggggtattggcaatgtaaactgcgttaccgaacacaggatgagttgttagcagctgctcgagagtttaaggcacgtaatttaccaattagtgtcatcgtcattgattattttcactggcccaaatcaggtgaatacatgtttgacaaaaagtactggccagaaccagaaaaaatgattgaagagcttcacagtctgggtattaagctgatggtctctgtttggccaacggttgacgaggaaagttccaactataaggatatgagcgaaaaaggatatcttgttcaaacagaacgtggtgttccgatcactatgaattttttagggaataatggttttgttgattttactaatccagatgcgcaggattatttatggcaattactgaagaaaaattatgcggataagggtgtcgatcttttttggttggatgaagcggagccggagtatacggtctatgactttgacaactatcggtattacgacggtactaacctacaagttggtaatgcttatcccattgggtattctaagtcaatttatgatggacaaactaaggacggaaatgaaaacgttatcaatcttgttcgttgcgcctgggctggtagccagaaatatggtgcactcgtatggtcgggtgacattgattccagttttcaatctctgcgtaatcaactcgcaattgggttaaatatgggaatcgcaggtattccatggtggacgactgatattggtggttttcatggcggtgtagatgatgatgatcactttagagagctagtcacacgttggtttgaatttgcaactttctgccccgtcatgcggatgcatggcgatcgtgaaccgcatactgaaccattaagcaatgaaggcggcggcaaaatgccatcaggcggcgcaacagaaccttgggcatacggtgaaagagcgtatgacattatgaagaagtacatggtccttcgtgaaaatttgaaagattatattcgcgatcaaatgacgaatgcccatgaaaagggaactcctgttattcgaccgttgttctataactttagtgatgattcccatgcttgggatgtggaagatgagttcttatttggaaatgatattctgattgcacctgttttgtatgaaggagaaaccaaaaggaatgtttaccttcctgctggaactaactgggttaacgcgtttaatggtggcgttgagactggaggaaaaacgattattgtcgagaccccaattcaacaaattcctatttatatacgtcaaagtgaatttgatgttttacagtcggcttttgaagtcttgaaataagtagcgactcaaatcacgcatgcgggaggaagaatgacgatgaacgttctcacgaaacattttgcgagccagtcaattttatcctggtttttccaattattgttaattagcttggcttggttggtagctgacaatctgttacaaaataatgcagttactattctcggggctggaattttgacggtcttgatatacgtcagttttgcccttgataatcgtcatcatggtgaaaaatgatattacaaaaaatagaacgctttaaacgtggaggttaatgattatgggttcaaattcggagcatgttgatcataacgttgaagctgcgcaggcgatgcttgccagtgataaattaccatttcatagaaaactaacctatggtttcacagatatggcgggaaatctgttgtatacattggttggctcctatatgttgtatttttttactaatgtttttggattagatgttgggatagctgggtcacttttgctgttaggccggtttattgatgctttaggtgcaccagtcatgggcgtcttggtcgatcatacccatagtaaatacgggaaaaatcgaccatggttcctctggatggctttgccctttaccatctcaatttggttattgttcacaacgccatcacttagcggcacaatgaaagtcgtttacgccggtgcgatgtacatcattgccgagttagcatacacggcattatcaacaccaattacatccgtattgcccaatttatctgcaaattcagacgaacggacatctgcaaattcgattcggatggttttagggaatgtcgggaatttcttcgctgtaacctttgttatgcccttggcttcattgcttggtgatggtaatgatcagcgtggctggtcgttagcagttggtttgtatgcgatcattgcgtttatcattattatcattgcatttttggatatgcgcgaaaaaaacattgatgaagagaaaattattaccattcgtgaaagtatcagagcaactaagagtaattggccttgggtgctgattgtagctgccaacttactattgtggaccgcctactcggctcgaaatgctgcactaccttattattttcagtacaatttgaatgataaagggttgatttcactttttaatggcttttctatcattcaaataattgggatggccgcagttccgtttgtcgttagatatctcaataagtggggaacaactatctttatgctaggcatgacgatggttggccaagtatggatcggatttgcaggcaacaacgtgacttctggcttgattggctggtgtctcgcatgtatcggttctggttccgctatgaccatgttcttctcaatggtcggtgacaccgttgactttggtgaatggaaaactggtattcgtgcaaacggatttttaactgccatgggtgcttctttctgtattcaaatgggttcagggattggatcgttcattgctgctcgaattttggccacatttggttttacagcagctaaaacagttcagtcggctggcagtttgtcagctatcagttttacgtttatctgggtacctgtcattatctatgcattcagcgctatctgtatgattttctaccgcaagtgggagaagcatgagccaattgttaatgaagagttggctgaacgtagagcggctgaaaaagagactgtaactgattagtacaaagttagttgaataaatacttgtacaatagtttgtttattattagccaagattcaatcagttcatagaatgtctcaatttttcctgttttaggatctgatacatgccatttttatgcaactaaattttttcttgttcatatttagttataattgtttcgtcctcgaattttgcgtaacttttcatcttttcacctttaaagattagatacgtaacgacggtcaggcatcgcgtgagcctcaataatttccacattttcaagttcacatagccgctgagtgatccagccaatgtcttgttttaaaccaccacaaatattttttcttaagtacttcaggatgaaaacaatatgtttgtgctaagcttctatcgtctttagacaaaaagactcccccttcgtttacagtttggttgatagtcaaaactagttataacgaaagggagtttttcatgctaaagctttttcaccctcacaagtaaaacttatggtttattcgcggatactaaataaaaaacagacctaaatcaaaaattcgcttaaattttgacttgggtctgttttattttgaggacttatgccacagccccttttggtaccatcatgattattatctcgctcttatttcaatcttcaacattgccaccacgaaacacgtaccgaagagtcgctgccaaagctgtcaagcctgcacaaaccgcaaacaatccccaactgtatttagtgccttgtttacctatattcgcaattgttaaaaagaccacatcgccaactggtgcccctaacataaacaacatccccaaaaagctcatcgcagcccccaactggtcatcgggaattactttgacaaacaaggcagtcgttcgcggattcaacttgcctagtaagtatccggttatcaataccatcgcgataatcagcagaattgatctccctgcccaaaatgcaaatgctaaaaatacgaatgccacatttgttaagataatcagacccataatctttgttttggccaaaaagtcattttgatagacagcgcccaaaatactcccgagagaaaatgaaatattgaccaatgcaacactattgccaaaactgccaatccaaagcacagggttgtttaaaataccaagattgataagcccatccgccggagcggcatacaggttaatcaaaaatccgaatctcacaattgccattaaccgtttatttgagtaaattaatttaccggttactaatagacttgctatcatcggtttacgtttttgagcgatttgattcacctttagatgaggttcaattgacataaaagtttgtcgatattgccaaacaatcacagctgctattaaaaaggtcaccgcattaatgaaaccaacaagactgtaattatcattcagccaaacaatcagcgtcgctccaacaccctgaaaagccattcgaatcgtcgatgtcacccctgattcaaggccaatcgcgttatttaactcgtcgttggcaactaaatgtcgaagtagcggtaatgataaactatcggcaaataatcccaaagaatcgctaatcatattaattgtcagaagaacgataaaaataggcaacgagcgcttcaaaccaattagtccggccaatccgacaaataagccaaactggctaatccgtgaaaaaatcattccaagatatttatgatggacattatccgcccagtaccctgaaaagacgtcgatgatactggggatatcgtttgtgaacgatactaaactgacagcaagcgttttaaaggacaaatttcccgcgtaaataatgaaaacgatattaaataaactgctaccgatcgcattaaagattgccgcattaacaagcgctcggaatccgtggttagtcaaatatgaatgcataagcaagacctcaattcttgcctacattctataaaagaattaaacttgattttaataaattccgatatattggaattgttagaaggcaaagaaatgcaagaaattggtaaactattccggaagctacgaacggaccgtcacctcacacttaaacaagtcgcagacaagcagaacagtctttcatttatcagctcatttgaaaatgggcagtctcagatcagctttaatcggctgatctacctgcttgacaaaatcaacgtgtcggttgaagaattcctttatcttcgtggaaaagatactttcattccactaagcatcgcttattcagatcataattctgtctttttaacaagtacttttatgcaccaattaggtcgcttctcaaatcaattatttaattctaaagaccacacgaaggctgaaagaattcaggaaagaacccagctaatcacaatcatcaattccttggaaaagactgatcaggttggctggaatcattacattatcatcctgtaccagattcaactagccgaattaaattgggaaattgaccacacttcctcattatcagtgcttaatcgaactcgggagaaactatgtcgaccgcttgtcagctacctctacaacattgaaaactggagcacatttgaagtgattttattcggcttcagtcaacccgcaatgccaattcaaaccgttcatcaacttcaatcaattgcaattaaacgaactgcccaaagtgacggtttcccgattctgcaaacaatgcggtttaacttactgttcagtttattcgccacctatattaacgccagaaaattgcagtgggcaagtgatgtgctggccttaatcaaacaattgattgctgaacgggaagatagttcctacgcgatcgaataccatttctatcaaggatggtatgaattcattaaatttaatggcaccgccggcgaaaataaaatgaatgaagccattactattttagatctcctgaatgaaccgcaaaccaaagccggattcaaagcagctctgcatattattaagcaaaaccaagcgatgccggaaaaatggcatttgttcattttataaccaaatcatttattgataagttaatattactaaataattttattttataattagcccaccttgtcaacaggtagtttttcctcttacagcgcttataatattttttataaaattaataacaaaatccagtgctatcataatgccaacaaacaagttggaggatattatcaatgcagaaacgaatcggatttttagcacttattatctgtgccggcagtttattggtcgctggaaccaaaaactctgtcaaccaaactgccgcagcagaccagtcgacaatttatacagccctacccagttctgatgacacctactatcatccttttaataaagcactccatcattttgacaatcaattagccagactggacccgggaaacgtcgtcacaattacccaagaggcactatctcatcgaaccagcaacttcacctatgacgacatttggcttcgagatgtcgcgccggtaattaccaccaaaatgataaagtttcgttaccacccaagttatctcaaaagagcagacagtcactatttagatcaacgttttcgaagttggctcaaccgggaaaaattcaattatcaaaccagcaacctggtcttggatggtggtaatctgatttggaataacagtgataccgttatcttaacgacccacgtctttgccgataacccagattggtcccggaaggaaattatagcggaattaaaaacaaaattagctgtccatcatgtcatcttcatcccaactgaacctggagacgtattgggacacgccgatgggatggttaagttcatcagcgcccggaaactatttattagtgatttctctgggaaccaaaaattggtcagaaaggtgcaacgactcattaaagcccaacttcctgatgccaaatttgtcctcctaccctctgcctatacatcaaagggccaatatgatgccaaaattgcttcagctaagggattatatattaacatgctggaaacgccgaacaccatttacgtcccacattatggtctccgaacggatgctcaagcactaagaattgttaaacaacaaactactaaaaaagtcgtgcccgttgatgtcgctcgaatctcaaccactggtggttctgtccattgtttgacctgggatgttcccacaaaattttttccgaaaaatagttgacggtcagactcgcaaccgtcagggttctggggttttagtagcccaatcgtactcaagaagcgccttttgtcccaattcgtttggtcggccaacatattcgactcacgaaaccccgcttttattccttaaaaaagctgaagctgggacaatagtcgtttcacccagtctctgttagtgtaaacatgattgttaccaagcaaaaacgcgggacaaaaggcaacttccggccatgtaaccgaattatccaactattccgttcagaatattcggacaatccgattacactatggaagttaagcgccttttatcccgctctcagcttttaatttttagaaaacaatcacctgttattaaacaaccagtttactttttacgtaagatgctgacaccttccggaacggcaaagtccttctggatcatcgttagcttcccgctctcagcatcacgcgtatacaacgttgcgttatctgaattttgattgaggcaaataacaaacgattcatcgtcactaaagttgaaatctcttggaaaatcgccttcagttgaaattcgttgcactaattgaacatcaccgttatcatctgaactaaagacggcgattgaattattaccccggttagaaacgtagacaaaacgaccatcttttgaaacccgaactgcggcagcaccattgtgttctgtccaatcatcgggaatcgttgatgaaatcgtccggactttcaattcacctttggttgaatcatagtccaaaacagctaaattactactcaattcgccaactaggtaagcaacatgcttcttttggtcaaaggcaatgtgtcgaggaccgtacccatcttccatttgcaactcactgtgtggtgtcaatttaccggcatcgtttaagtcatagagataaaccttatcaacacctaaatcgacggcaactacccgattatccggtgttaaattaacaaaatggggatgtggcccatcctgttgttcggcacgaaaaccgagggtgcctttgtccattactcggtcggccaacgaaattgtcccatcttcgccgatcttataagtgcagacaataccagcatgataattagctgtaaaaacaaggcgccgggcttcatcaacagcaatgtaagctggtgatgtttcttgatcatgcaccgtgtcaattggttttaatggaaaatcatcccggttgccatcccattcatggaagccgccagtcacgccgcccttatcatccttaaccttggtaatcgcataaatgcgcttacggctggactcggcaacataagttggatcaatggcgctgccaacaaaggttaagttttgcaacttctgattatcggtatctaattcaagttgatagacacccttactgattcgtctggtatatgttccaattaaatatttttcgatcatatttttcctccagaattagtttatagttacattatgccacagaacgaacttaaccaaaatagctttgaaagctttttcacgaaaggattaaaaatcatgacatcatttgaaaaattccacccagttctcacttcccactatacgcttgattggttgacccaaacaccagtcaaacaagtcgataatctctataccaatccaaacatctcaactgttgccgccgaaaagctaccaacccaaattctggatactgtcaaacgaattaaccacattatgcagaaggttatgaacgacaaacaattaacttggggcgtcaccgattcaaacaaccaaacttttgttggaatcatcacaatttccggtttcgaccaccctaaccaaatcggtgagttggattttattgttgatcaagcacactcagaagccctcggtgaaattgttcgtcgatcaattcaatttgtagccgatcattttaacttcaatcaattccaggttaatttatcagttcctaatgatgtcgttcaaaaaagcctgattgaaaaccagtttaagaccaacgaccaaaagcattttattttagacttgtgactatttggactaattttaaggtattttaagattatcccattaattatgccaatatcattgaatatttcgttaaactatattagaattattctaaagtaagaaccagttatttttaataagcaccagattttcaactgtggttggattagacacttttctttcctgaggaggaaatcattaatgaccagtacagcactcaaacagtcacttgctcagctcaaaaagcaaggaattcgaataacgcctcaacgtgaaattatcttggattatctcattacccaccataatcatccctccgttgacaccattcgtgacggcattgaaaccaagctgcccaatttaagtgtggccacaatttataatacattaaaattactcgtggacaatggactagtcatcgaactgccaaataatgacggcggaattcgttacgactattttggaatgccccattaccacgcaatttgcgaaaactgtggaaaaatcatcgatatttttgatgatgagtatcccgagttggttaaacatgtccaaagctttacccgggacaaaactggttatctgatcacaggcactcagcttgaaattaccggaatctgccctgaatgccaacaaaagttacacattgccaagctatcccaaaaatgaattattacagtcgcaaacacatgccccatcagtgtttgacgtatttcttaagccttttgtcaacaactcttaatatgattgataactagttcgacaaagcccgcaatagtgcgttaattcgctatttgcgggcttttttgcggcttgaaacgactagtcgttatcgtttatattaaacagcgtacaagttaaccgatgtaaatatttaacatacaacgttattggtgtcggtggaatttaaccaccgctcagttaagtaaaaacgtaacgaacgccaaccaaccgttttgcatcagcgttaaattctaaaatcttaaaaaataaaccattaaaatcgaaacttagacaatcacattcacacatctgaaggggaaactattttgaaaaaacgaagtctactagcagcagtctgctctctgtcattcgcggtcattggcatgttctcattttccggatcacacgcctctgccagcagtgttaacagctatatctccagtaatgatattggccatgccagtgtcacctcctcaatttggaatggctttccaaagaataaatatcggaatggcgttggcaaacccgagggcgttgtggttcacgaaaccgcaaaccccaactcaaccatctacaacgaaattgcctacatgaaaaagaactacagtgccgctttcgttcacactttcgttgatgccagccgaattatcaatatcgcaaacacaaactatcttgcttggggagccggatatccggctaacgcaagatttgtccagtttgaacaagttcgcgttcacagtaagtccgcgtttgcccacgaaattgccaatgctgcgtattacaccgcttatactttggatgaatatgggttaaagcccaacgatgctgcctatgatggcaaggggacggtctggtctcataaggctgtttcaaaatttctgggaggctctgatcatactgatccaaacggttattattcctcgatgggtaaagcctatttcggcggcgcctataccatggctcaattttatcaactagtcaaaaccaactatgataatttgagtgacgacagcaccagcggttccattacagcaaatgtaaaaaagaaaaaggcttacgatgaagtcacctacaaatcagttgaccaaaacgcgttattaggagacacgtacaagtcatacaaattgtacaaccacgtgaaaaatacgcgggcaaatgttaaatcttattcatgggcatcagtaggtgcaactgttggcaagaaagtttatattgacaacgacagcactaaagaaaacggccatcactggtaccgaatccgcttcagcagcgactccggcgccacgaaatattgggtctacgaaaaggctcttaatttggaataagaaccatttcagttgacaagttgatagtaagtaatatatgattacggtgttttagaagatcaagtagtggcaattaagagaattcgccaaaagctgaaaggcgttttagtccatgaatcctaccttcgaataaaattgtcttaatctgacacggatatttccgttaacaatgtaaaagtgtgaagcctcgctttgaatgagaatggtaccgcccgcaattgggtgtctcaactcattcaaagtggggctttttttaatatcctaattttcaagcatgacgattcagtatctgtttctcctttcgcaatcataataaacatcaggtgatctctatggaaaatcgaattattactgcaaatcgaattgttgtcaaagttggtaccagtagcttaatctatcccaacggcgccatcaattttgaaacattcgaccagctggcttacactttaagcgctctgaacaatcagggaaaggaactgattttagtttcttccggcgcaattggcgttggcctaaataaaatgcatcttaaaaaacggccaactgaaattggtgctcaacaggctctggctgccattggccaatcagaactcatgaccttgttcacccaacgatttaatcattacatgacaaacattgcccaagtcttattaacccacgatgtttttgactaccccaaaagcgatcagtttgtcatgaacactttcaattgtttgcttaacgacaatgtgatcccgattgtcaacgaaaatgacaccgtcgctaccgacgagctggaccataaaacaacctttggtgataacgatcaattgtcagcaattgtcgccagccacgtcaatgccgatttactggtcgtcctgtcagacattaacggcttttacgaccgaaatcctaagaaatttacgaatgccaatctaattaaccaggtatctaaaattgacgatgaagacttttcagtcgccggtggcacaggcagccggtttggtaccggcgggatgcggactaaattattagccgcaaaacgcatgttggatgaagaccggcaaatggtgctggccaacggaaaggatccacgggtcatccttgatatcttggctggcaaacaagttggcaccttattttccaagactaccccacaattaaaggagggcgttactcatgaatgaacaacttattcaaattggtaaaaatgccaaggcagctgcttataaaatgaatttactggacaccgtcactaaaaatctaattttaaatgaatttgccgataatttagtcctgcatacggctgatattttaaccgccaaccaaaaggatttggctaatgcttctgacatgccggctaaatttactgatcgattaaaattaactgagcagcgcgtcgctgatatggccgctggcttacgtcaagttgcggccctgccggatccaattggtaatattgaaaagggttggcaaaacgatgccggccttcagattgagcagaaacgggtgccacttggcgtcattgcgatgatttttgaagctcgaccaaacgtcacggtcgatgcctccgcactcacatttaagagtggtaacgccattattcttcgaggtggtaaagaagctctcaacagtaatttggcactggctcaagttctgcgagacgttttaattgccaacgatcttgacgaaaatgtcattcagattctgcatggtgccagtcatgaaacggccaatgatttaatgcatctcaatcaattcgttgatgtcttaatcccccgtggtggctcaggtttaatccaggcagttgtcaaaaacgcaacggtcccggtcattgaaaccggcgccggcaattgccacatctatgttgaccaatttgctgaaaaacaaatggcgattgatatcattgttaacgccaaagtgcaacgaccttcagtttgtaacgctgccgaaaaattattaattcaccaagatgtcgctgaaaccttattaccagatatcgccaaggcacttcaggatcacggcgttgaattacggggtgatgatcggagccggcaaattgtttcttcaatcaaaccagctaccgaggacgattggtcgactgaatacaacgatttgattatggcaattaaggtagttgataacgagcaagctgcaattgatcatatcaatcaatattcaaccggtcactctgaagtcatcatttccgacaactatcaaaatggtcaagcctttttagataaaattgattccgcgtgtgtttatgtcaatgcctcaacccgattcaccgatggctttcaatttggctttggtgccgagattggcattagtacgcagaaactccacgcccgtggtccgatgggacttaacgaattaacaacgactaaatatgtgattcgcggcaatggccaaattcgtgaataatctgattcattgcctacctgtttcttatttgaagcttttatcaaaactgaaaagcccgtgatctaatcgccttttaccaaatgattaaatcatgggctttttaatttacctagtcgttttgggcgccttatcagcatccaacttaagtcgactcaactgtcttagtcccgcaataatagtttgtttggaaagcattccatccggacgattggaacgattagatgaattcaactgatcatagaaccaatttcctaatttgacaaaatcttgatctgccatggtccgctggtattttaaaagtcgttccgctgcctgagcatactgatgctgatcaattaattgttgcaactcgttttgatgtggcaatttttgacgctgatcctgtggaaaaacaatctcagtccgtccagtcgactttccatgacccagtatataagccatcccttcagcagctgcccgaatttgtcgaataataaagtcattatcttccagcatggttaccactcactttcaatttccgttttaaagcatttgccctgcttcatttttagcataggccaattcacgctggcttgccgtcaaaatcccctgacaattgggaatgtcaaagcattttgacaggatgatttgtgggtaatagtgattactttggcacttattcatcaaaatcatagtaatgatctcttgacataatgtaacgggttcgttaccataatttacaaatagatttgcattggattgaatgaggaggattgctgttgattaaaaatcgaatcaaagtactccgggctgaacgcgactggacacaagccatgctcgccaaaaaagttggcatttccagacaagcaattatttcaattgaaaagtataagtacacaccatccctggaattggcgtttgatattgcagcggcgtttgacgtttctatcactgacatcttttataaagcggaggtatagccatggatcaaattatcatcgtatgtttagttctagtttcactcttcttcaccctttatcttgcaaaatataaggcagaccaagggataaagtatcaaaatgacgagcgctggaattacgttttggcaaaatcaaatacgataactcaaaaatacaatgactttttactattgattgtctcaattatcggaattatgagcgtcttcattcccattcactttacgtttagcaccacacgagttttaatcattctttatctctgcctgtcgtatcgaaatgtcgtcggaaccttaacgttaaaatattatgatcaacgtgtgtaacgtgtaaaaagggacagtttccggccatataagcccccgcaaacaatattcccaaaccagggtattgtttgccgactgcgaatcacccttgttacttaaccaaaacgtgcaaaagccgtgcaacttccggccatataaggcttcgttttgagctttttaactgtaaatctccctgttatctagttgaaacgtgcaaagcaaccgcagcttccggccatataagcccccgcaaacaatattcccaaaccaggaatattgtttgctgactgcgaatcacccttgttacttagccaaaacgtgcaaaagccgagcagcttccggccatataaggcacttaaacccagattcaaaacaggaatctgggtttaagtgccttatattctggaagctaaacgctcggttttgcactctacgccgtgaaattcacccccatatcctccaaagtcgtcatatttttcaatactgactggatatcgtcaatcaaagccaacgttaccactgctccactgccttctccggttgccattcccagattaaacattggtgtgactcccagcttcttcaaaattgctttggttcctgcctgccgtgttgcgtgcgatgcaatcacatacctttgaattcccggacacattgcttcagccaaagccaaggcagcgtatgaaataaagccatccataatgagtgggacatgatgcgccgccgcacaaatcattgcgccagcctttgcaccaatttcaaaaccgccaactttacttaaaacgtctaaaccatcagttggatccggctgccattttgccaaccctttttcaaccacatcgattttatgagccagccgcttatcggaaatcacagaaccacggcccaccacatcagcaaccggcagtgaaagcaacgacgcaatcattgctgaagacaccgtggtattggcaatgccaagttcaccaacgcatagaatctggttaccctcatgaattgcctgagccgccacgtcataacctgcttggacatctcgaatcgcttcatcacgggtcattgccggtttctcgataaaattattggttcccttacgaatcttcaaattgatgaccgcctgatccaaaatatcagcgtcaattccgacatcaatcactttaacctcacaatgattcgcctttgccagcgctgccacgcttgaatggcccgctgccatattaacggcttgcattgctgtgactcgccgtggggttgccgaaacgccttcccgttcaacaccatgatcaccacaaaaaactaaacaacaacgtttttcagtttgtaactcaacccgttgctcaatcccggcaagatcaactgctaacacttccaaattgcccaaaccgccaactggttttgctaaattgtcaattttttctcgcatggcttttcttgctgcttgagaaatcggttcgatagttggttttaatttagtttcattattttgcataatcgtcatcctcactttacgaagcaaatttatcttaagcgtacaccctttcttgaatccgcttacgtcatttactaaaaactgacaataatttattgttcaaccgcttcaatggccgttatttgtcgtgaatgttgcagaatcttgttaatatttgaaaatgttttccgacaaatgttttccgatctcaaaagattttgccgcgacagccaaccactgctacaattaacctaaactacgaaaagaggctcactattttgaaagtcatcacccgtttaagtttaggactgaccgccggattaacatttctgattggatccgttcttttaggaaccacaactgcagacgctaaagtcatccaaaacagctttttaacaacccagcgaaccattcatactactaacagcaagaaacaagttcagctctccctgccaaagggaaccactgttcaagccgctaaggttaaaaatcaggctggtcgaaaatatatttacattaatgccgagcaactcagttaccgtttgcgcaaaccgctgctaagttcaaaagccaccagcaattttagtcgctggattccagtaactaaagccaactttaaacaaatcaagactcccgtttatctatcctattacaatactaatgttcgcaagaaacgcattaataatcgatatttcagtaccaacagtaatttatggcagggtgatgcccttcccgctgactatccttcacaaagtggtacccggttgcgggtaactaccgatggctacctggaatattttgccaagtccccctttgtctaccgggtctctaaaaaaccaacggcgactttaaaggttcaaagtgccactcatcccggcggtagtggtaaagatattatgaccttcaaatcatcattttcacctttaccatttcaaaagaccgcagatggtgcttacacattgacaatccgttggctcagtgcggcaactgttaccgccattcccaacgaaaataacgtgaaagaattgactcaccaatatgtttcaaaaattggtgaacaggattggtaccaccggacaagtaccacaaaattttaagaaggatgattaaaattgataaaatttaaaatgatttttacttgctgcttagcgagtgccatcgcgttagtcagcacgctcacattgaccaccacggcatcagctcaaacccggtttctttcaaacgttgccaatcaggacttcttgatgaccaaccgaacaattcacaccaccaatagttatttcaatgacgttaacatcaccattcccaaaggaaccgtttttcaagtaagcggcctttccaagggtgctaaaaccagttatccctatgtcagcattgatacgaatcaattacgctggtcacttagaaaaccgtttatcacttccaaacatgaccaacagctgactgccggcatctgggcaacgactaagaactttaaaaaggtgaccgtacctaattacttgcggtattattcgccaaatcaaatggcttggtccatcaattatggatttatttggcagggatttaagtatcccaccagcaatcagattgtgaaggctaaagaaaacgcagttcgggttaccagcgatggttacttggaatttctcaaagatcaaccggcaatcggcagcagtaaaattagtcaaccattcagcacggccaaggttcaaaaatcaacgaccaaaggaaatatcacatatctgtatacgacgactaaaattgccggtttgccaagcacgcatatcaacgccagtggtcgctatcaataccgcttaaaagtcatcaacaccaaccatcatttagtcacaatcaacccaagaaataacaattccaattccaagtacgttgattctgcagtcatcgtcagtcgttgttacattggcaacacaaaaacaaattactataagctgaatcaattcgctttttaatgaatcgtaacttgcactgactactgtaaactttaaactaaaaacattgcgccatcacatctgcagtaatacacaaaacgggactggacaaaagtaattttgtccagtcccgttttgtgtaatcactattattaccgagtgggaacgtgtgccaaaaggcaactttctgcggcgtaaccgccttctcttttatgcaatcacaacgattacaaagcaaacatgaaacaaaaaatgactcatttagctgcggtcttccgtttcaacttcaaactcataatccatgttgtaatcggaattgttgtcaccaccccaatcagcgacacgacaatggcaatcaactctgctgcgaacaccttatcgtttaagatttcaccaaacgaatagtttaaactgtaaaaccaaataaacaagcccagtgaactgccgaagaagccaaagaacagggtattaaccgcggtacctataatctgcttgccaatgacaatcccgtccacatatagctgttcactccgaatcaattggtgttgggtgataatttcatccaaaccggaggcaatcgcaattgcggcctcggcaatggcacccagtgagcttagaatggccgtggcaatcgcaattttagtgaaatcaatgcccacgtacgttgataagccttccaattcttcgctgtcctctaaaccaaagccacccacctgagcccaatattcaatcgggataataatggcaattaacaaaattaaaataatgaccgaagcttcgaatgccgtgaccgatgcattgtcactcgcatcgctccaaaaaatcgtaatagctaataaaatggcgcttgccacaacggccacgaggattggcggcatatgaaacgcaatcaggacaatactgaaaaataaaattccaaaattgacaaccatgctcaaaaatgatgtgatgccttgtttgccgccaacaatcatcatcaaaatcaataagacaatccctaacgctgtgatagctcccattagcgatcatctcccttaatccataaacccgcaaacaaacttgatagaatcaccgttagcacgatgccaatcccactaatcaagctcgacgtcattcctagcgacatattcattgaaaatgagtactgccagctattcccattcttcaaatataacaatgtcattggtaaggtttccgccataaagataaagaataagacattaatcagtggtcccataatcgatttaccaatttggcgaccagaattaaagagttgcattttagtcaactgcggtcgttcgtgttttaaagttgccaacgatgcgataatgtcggttgcttcatccatgaccgcccccagaacgccaatcagtacttccgcaataaacagtggcttgggcaattgagtcacgtactgcatcgactcataataaacaccccgctcatgagtccccataaagactagcagggtaagcaaaattgtcgttgcggtcgcgccaaggactgccgctaaagttaccaacattttgcgattccatcccattacgagaaacaaggtcacaaaacaaaagacaacagctaacacgctaaatataagaatcaccgccgcgccatcattgttatgatcaattttaattgcgatccagaataaaatcgtattaatgacaatactggaaatgacagtaattcctcgtaactttaaaattagaaataacaaactaattgcaagggcaaacaagagagcaattggtgcatcccgcttcaagtcttttaccgtggcgtgaagcctgggagttgtatgtaaggtaataaataatttttggcctttcaaataatggtgatccatcgcgtgagaatccgaatacgcattattaattgacagttttctccccgcgtatttgccgtttgtgattttcccataaagggtctgcacatgatagtgatcgacattatgaaactcgtcagtcattcgagtcgtcttaccactttttacactggttacctgataaatcggctgggcatacaagccatcattgtgattaattaagaataccgcaaataagcaaaaaacaattgccgcaacgatttgaacccaagtcattttactcgttagttttgtgtccatgcctacacatcttttcaaatcaatttaggcctattctaacattcaagacaatcatattagttgttccaacgacaatttaacagaatcgtgaaatttcgcgatcatcatcgcatcgtttgaatttttttcgaaagatcgataagatagtttccaaattgatgatgctgttaaattttgtgggacggcaaacttaaaggtctctatccaatataaaatttagtaattaacgaatacgtaaaagaaatcaaagcaaggccttctttttgtatcttcattacatcacgacacataattcctatctagctaaagcaacccacccacataataagagcttttgattcagataaaagtcagaccttatttgccaaagtcaaaaaagttcatcgactaaaggttcccttatttgcgagtactaaaaatagaaaaagtggtgcaatcagatctgataagatttgattgcaccacaaagtttagactgttttgcacggatacttgaacatcatatctaaaaatcgagcaagattattttactctttgccacaataaagttggtattaaattatcattgtggtgtttaatatatcccttaacttgtcgcactgacttcaaagcaatcggtttcttattgccagtaagttgattagcctcttcgccggctttagttaagtcattacgataagcttttagatcagctgcctgataattcgttgtaaaaggatacttagtgttgatacttccaacaacctttcgttcttgatagataattggttgtaattgcttatcaagactgtatttgttgtagataaagtggtcatcaatccaaccacgatattgaccagaccttgaagtaactttatattgcatgccatttttataatgccaaactcggtaaattttaaaattcacgtgatttttaattattttgtgaatggttttgatacttgttaaatcacgtttgttttgtccaaatggttggctccacaaaccaccatccgctttatccattccatccaagcgaaatacatatccttctttggctaattgtgaactgcgaatcatgtcattatgatctgtttgaacattatggctgtctcgccttgcgtaaaccgttggtgctgctaatgtcactagtgataaaactgctattccagctaatacaatattctttagtttcatttagaccaccctctaatctaatcagtaccaaccatatgcttcccaatgtgctttagcagacgtccaagaaccgtaccgattacttacatatttatcagctgtacgctcttgattctccacactataatcaccatttaaatacgatgaggttaattggaagcgaccaatgtattgaccatttctagctgaataactgaaaccagattcgtgcttagcaatccaaatcttagcgtctcgattagccttactataactttcatagaattcttcccattgtgattctgataatcctgatttggcagaagtggcatcttctgcatccaaagaattagcacttgcaatttggttctgtggtagataaattggcgtcccatcaggtagtggctgattaggatcaacgttaccattaagtgattccaaagtactcaaatcaacattgttattgttagcaacttgctacaacgtattgttatcctcgttagcaactggggcaatcccctgttgatctatttgcggatctgtacctgtagtatcgttagaatcattagtcgttgtaacaacggtcggcgttacattggccttaactgttggattatcaagcgtaaccatcactagtccgcttaaaactaagctagacaacaaaacaattcctgtttttgatagtttcatatcgataatctccttacaaactttatttttgattcacctccactgtagttcttggctttcaaaatacaaacaatgttccgtcaggatgaccatcttaataatttgttaaccttatgaaggatttaaccttttacaatgagcccaaaaccacttagcatacatttcaatatgatgcccctttgataaaagctttgttaatttgggtggtatctctttattaaatgatactcgtcaccattgcttttctcggccttacgtaaatcaatgtcattttgtaaatttaaaaagtaccgatcagatacaccaaatattctgcccagtctaactgatgtatctactgttatcttacgtcgactatgcaaaatatcttggactcttgatgtcggaactttaatctgctttgcaagcgcataggctgaaagattcaatggtttcataaattctttctctaaaatttcactaattttgggtgttggaatttcattcatatcaatttctcctatcttcaatggtaatcaacaatttctacatgcgtgaaatcgtttgagctttcaacctaaaagcagattcgatattgatcattaatcttgatgctaaactgtcctttttgttcaccactcaatcgttctaaatgatttactggtggaatccttaaatcatttatatttgtggcgttgtcaatcatcagcattttctgtaaagctaccagacgactcagaagaaaacctgcagtactaattcttctaaccttccgaggttatcgcttcttctcacacgctagtcaaaacgtggtatattatttttatgagaaaaaaagaaaccattattttaataatttcaagcattgttcttggattggttgttgggctgagctcactatttttaggattattactaaattttgttgagcatctttttctacactttgaagaaaccgcccgttatccgatgggcattgatgttgcccccagtacccggttatgggccgttttcgctggtgggattatttcagccattatttggtggattttaagaaccaaagtgaaacctcccgttaccattaaagccggcttgggtggtcaaaacatgccagcacttcaaacagcgattcacgtcatcacccaaatcttttacgtgggaaccggtggctcggttggtcgcgagttggcgccacgagaagctggggcaatgatcgcccaaaaatggaacgatctgttgcttaaatatcacctggctgttttatctaaagatgatgttaaacttttaatggccgctgctgctggtgcgggctttgccggcgtttataacgcaccgattaccgggatgttcttttgtatcgaaattctactaaaaaagatcagttttcgaacagttggtgtcagcctcagcatgtcaatcatcgccatgttggtgagctcaagtgtcaggggcactgaaccttattacctggttggtcacacaagctttgatacaacttttttgccctttgtcatcgtcatcgcagccctatgtgggattgccggtggcctattcagaaaatcattcacttgggcagaaaagcatcagaccaaaagcaatcatattctatggcagctgcctttaatggcactggtaactggtatgacactcacacaactcccacaaatcatgggaaatggtcgaccactcgctcaaatggcaatcagcacaacgagtaaccacttcattctattattacttttaagtggtttgatcaaaggactggtaacggtcttaacaatccgctcaggggctgccggcggtactttaacgccttcaattgcgatcggtgcagtcatcggaacaattgccgggatgattgtcgctccaataaccactatcccggtctggcaattttcggtattagggggctgtagtttgttagctgcctcgcaacaagcaccattaatggctttatttatgatcattgaagtcagtcatttaaattattctgctttaattccgctggggttgggggtcattatctcaaccggagttgccaaaatcgttttaaaaataaccatcaagtcgaatcccctctaaaaaattcaagatcaaatcgcaaatggattgtacaattccattcaacctgctagttcatcttgtaatgaggatttattaaataaatggggctgggacgaaagtaattttgtcccagtcccgttttgtgtaatcacgattattaccaagtgaaaacgtgcgccaaaaggcaacttcctgccgcctaaccggattatccaaacattcaagcccggaatattcggataatccgattatgctctggaagttaaccgcctttcgtcccactctcattcatttttgcacatttagtcaattgttcttttgattttcgacagttcgattctaattgttcccaattactcggcaatattgacaataccaactttgctgcgaggaccatgatgctcgtcgttcacaatccgtttcgtttttaacagacgcagaccattcaaaataacaagcaatgtacttccttcatgcataaaaacacctaagccaatcgtcatcaatccaaaaaagtttagaccaatcaggctaataaccactaatattgcaaaaataatattctgccaaacaattcggtttaaccgtttcgccatttgatatgactctataaattttgacaactcattttccatcaaaacaacatcggcaacatcaatagccacgtcagtgccaccacccattgcgacaccaacatcggccgtcaccaaagccggcgcgtcattcacaccatccccaaccattccggtcattttcccggcggctttctgctggcgaatcacgttaactttttcttcaggcagcacattcgtgatcacttcgtcgattcctaattcattgccaatcgcctcaccagtttgtctggaatctccggtgatcatcacggtatgaattcgctggtcctttaaaaattgaattgtcgccttcgcgtttttactgggcgtgtccattaacgcaatcaaaccaataacaacattgtttttagcaagatagacaaccgttctgccttgattagccagcgctaactgttttgctttgattgcttcaggaacctgcttaaacaaagttggctttttaattgaataatcatcttccaaataggttgctgttgcgcccttaccaaccttgttgttaactgaaagctgccacttctcggtcggtcttaaataattggtaatcgccatggctaagggatgattgatctggctttcaatggcatagataacattaatgacatcgtctttttgactttcatcttccaaataaaaatgagtaacttgtggagtcccattggttaaagtccctgttttatcgaacgccaccgtctctaattcagcaagattagccaggtacgaaccacccttaaacaggacaccccttctggctaaattggaaatagcggatagtgtggcaggaattgccgcggcagcaaaagcacagggagaagccgaaataaggaacacaatacttcgataaagactaacactcatcccccagtctgcaataagatatccaaataagaagaacagtggtactaaacttaaaacggcaatgacatatttcggttctaaccgtttgatctttgttgccgttttactcaaatcattttgcgactgttcgaccaactgcaggattctagccaataccgtgtcatcttttgttttagttgcttccataacaaacgggcgactgccattgactgttccagcaaataccggatctcccggccccttttcccgcggcatactctcaccattgatcgtggcttcattaatatcactttgaccatcaacaatttcaccgtcaatgggaatttggtcaccattttgaacttgtaaatgatcaccaagtttaacctcatcaatgacaatctcacgaatattgccaaaagcatcaatccgtttggctttaactggtgtcatttctaacagtgccttaatctctcgcttgcttttcccttcagcatacccctctagaaaatgggcgccagcgaaaatcaaaataagtaatgccgcttcctcatagttgccaataataatcgcaccaagtgcacctaacgacatcaacaaatgaatgtttggcataaaccgacgtgccttcctggtatcaacaatggttttttcaaagccttcccagataatatggtagcccgaaaaaagcgttgctgccaaatacagaagattaaccgccagtgttccactctttgcaaaattaattgtcaatccaattaaataaagaattaatcctaatccatacagcttagttgccactcttttgattttcatgccagctcctcctcgtatttggctaatcaagttgattgcattttatatgcttaccttttcatatgagtatccattcatatgagtatgatatcatacgaggccaatcttaacaagtaactatccgtcggcttgacattttttccaataatccatacagttaaaaaaacagcagtatctatgggggcaacaatttgaccgagcaagatcataaacaaacctacgcaaaaatgaaaaataacggtattccattagctgacaaagtcgacacagtgaccaacgtctttaaaataattgccgatccaacccgtgcccgaattctgctggcactagccgaaacatcattaagcgttaacgaaatcgtcgctattcttggaatgagtcaatcaagtatttctcaccaactccgagttttaaaagataatcgactcgtcagtggcacccgcattggtaaacagattcattatcaactgacagatcgccacattgttcaaatattcaatcaaatgattgaccatattgacgaagaatagacgacaaaaaatgctttaaccgctttgttaacagcaatcaggttaaagcattttttatgagttgaattaatgaccaatttctatttgatcactttatcaaattacgttttactagaaatcatcagttaaaatcagctaatcgggtttaggctgctacctgctgtgcatcatggtcgccagcaattttagtcttatttaacatcaacgacgacgtcacaaccgaaactgatgagaaagccattgccaatccagctaattcaggacttaattgtaagccaatgccaactaagattcccgctgaaattggaattccaatcaaattgtaaataaatgcccaaaagagattcagcttgattcggttaaatgtctttttagaaatatcaagtgcccgaacgacacctaaaagatcattttgaattaagataatttctccggattcaatcgcaatgtcagtcccggaacccatggcaatcccaacatcggcgactgttaaggctggtgcgtcattgataccatcacctacaaaggcaactttaccagactgctgcaaggctttgacatggtcagctttttcattcggtaaaacgccagcaattacttgatcaatgccaacctgcttgccaattgcctgagcgacccgttgattatcaccagtcaacatcaccgttttaagcccacgtgatcgtaactcggcgattgctttggcagcggtcttcttaggcgtatcttggatggcaaccaagccaatgatttttcctgacaaaccgaccagcacaacggttttagcatcattttgcaactgcgccatttttgttttcatctgatccgatatttgatagtcttcaagtaatttgtcactaccaatagaggctttttcgccattaacaacggctttgacccctttgccctcaatatttttgaaatcccgggcttttggatatgcaacctttgcatcactcactttagccattacagcattggctaacgggtgttctgaagattcttccaaacttgcggcaacttgaagaactttggtttggtcgccaacaacatcggtaacaaccggtttaccagccgtgattgtccccgttttatcaaagaccaccgttttaaccgtgttaacttcttctaacgcttggccatttttaattaaaacgcccattttagccgatcggccggtacccaccattaaagcagtgggggttgccagccccaacgcacatggacaagcgatcacaatgactgacacagcgaataacatcgcttgaaccgccggtgccccgagaaagacaaaccaaatgacataggttgaaatagctgcaatcagcacagctggtacaaaaataccggaaagtttatcagtcaggttttgaatcggtgcatgactggtttgagcctttttaaccaattcaacgatttgtgccaacgccgtatctttaccaactttagtagcgcggaaaataatcatcccgtcagcgttaatcgtcgaaccgataacggcatcaccagcttttttagtcacgggcatactctcgccagttaccattgactcgttaatgttggtggcgccttcggttacaacaccgtcaaccggcaccttttcacccggccgaacccgaatcaagtcgccaacctgcaccttctcaagtggtactttaatgtattgaccgtcagataaaacctccgcttccttaacttgcaaatttaaaagtttccccaaggcatttgaagcgctgttgtgcattcgttcttccaacgcgtcgcccagaagaacgaaaaccgttaccaaggcagcactttcaaaataaacttcccgtccggtaaccatcgcaaacaatgagtaaaagtaggccaccgacgttccaaccgcaaccaacgtattcatgtttgcgttatgatgcttaaaggctgcccaggcactcttccaataaggtgctgcggcaaccaacataatgatcgttgtggtaataaaggccacccaattataagcaggcatcatccaatgaaacggcatcataatcatttgaagaagcattggaatcgctaagatcaaggaaatccaaaacttctgcatattcgacaatttcatcagttgataaccacccttccatgaaacatgttcatcccacaagcgaaattaaactcaccggattgatcagtattaatcggaatttcaacatcttgattcagcggtaaggcttcatcaaacgccaaatcttgtgattgcactttcgacaaacacattgcatcattggttcgatgaaaaacaagtttggctggaacgccctgtttaatggttacttcactgggttcgtatcctcgattaacatcaatcttaataagctgttcaccattagtattctggttgcttttaccgttaaaaaagttttttaaattcattttaatttcccgctttctttaattagtttttaacaatgactttaccgtggaacatattcatcccacatgcaaagtcaaattcctcggctctgtcagttggaatttcaatttgagtcatcttttgcttcgtcaaatccttatcaatccctaacttttcaaaaacaacgtgtgatagacaagccgttgaatcattcatttgaaaattaattttggctggcacacctttttttaaaaccaaggtacttggtgaatagccaccatcaaccacaacggtcgtctcttgttgattgttggcaatttgagcatcttcggtttgttcctcatgtttgccgaaaaaccaccaaataataaaggcgattaaaagaattgccactcccagcgttaccatctgcatcattgtttgaccactcctttacgttatcttgtgtctcttattttcaactaaatggctaagtatttaattaacttggcctgcatattctgcctgctaagtttacgtctgtaacctcaattaatagaataaccccaaagtttacatttgtaaacagaaagagtgatatttttttaggctcttcagaaatatctttgagccaaggccgtttagttcatttatatgtctatgattaatcccaactcaaggcttaattcaaggccagattttaagcataaaaagaggataaaacagccaaacacaaatttcatctgttttatcctttagttttaggaacttggtctactaactaatacaatatggaataatcaatacctcggtttaatataaggtacccgtttaatcgttgccccaactgaactctcactgatccaagaacgatttctcagcgccttgaaactttcacttttacccgtcaaaatgacgccggcgaatttggcttgccttaaagatgggtactttttagcatactgagttgcgtatttactaagtgaaaattgattgaattgacctaaatttcccttttttgcagcttttaagttcttccaaaaactgtgataacttaaatcggtaattttaccgccaactgatcgaatgcccatcaaattattatcttgaagtgttggatccgcttgaccgccaacaccaatccagaaccagttagcccgaatattcttcggtaatttagctaaaatttgttgataagtcatcggttgatcaaagctgaccgcaacttcagcaacatagttgtgcatgctggaaacagccgtcaactcattagctttcttgatggccggattggtgacctgattattgtaaaacattggaatcttctcctgcgtcacccgattgtaagcagccgttcgagtcgtatccacaaaattatcattattgatttcactatatagccaattatatgtgccattcgcgcttccccacggaatatgataaccgtcaatatctttgtattcatggctggaaacttcgccaccgcccaagccactattgctaatgtacaaatcactggattgaatattgggagccatgacttcttgcctaatcgtaaattgagtcattaatttttcagtctgcgtactcgataaattctgtgtaaatttatatccaattcccgccataactggtaccacaataactatcaaaagaatagtcattaaccaccgttttagtttaactcgtaacgccaatctttcaaatttcttattgtcgtccattttgtttatcacctaatacccttcttaacctgtgtttaatccgataaagaatcatcttaactgccgcctgactcttccccatgacttctgcaacttgtttcaccgaatactgatctaagtatttcatcttcaaaatctgtttatctcgatcagataattgattcagcagattgccaatcctctcgtcagacggggtcagaactggaggttgattctctttaacttgtggaattaaatagcgttctaagatctgataaaatcgcttttttcgtcgatagtagtcaatgtacttcctttttgccatttggtacatataaggcctgattttattcggtggcaaaattaaatccatttcaagaactttaacgaaaacgtcctgaacaacatcttgggcaacttcacggttggcgccctgctgaaccaaataattaactaattcagttgatatctgtttaagtattttttcgtacccatcaagtctcatgacaaccccctttcactctatacaacgaattagattagagaaagtaacgaaatgacgtcatttttctcaatttcgaataaaaacgcattacaaatttacagttactggttcaataatggcataaaagatcagactaggaagaaaggtagttaactttctacccacattttcacttgataataatcgtgattatgcaaaaaaggggttgggacaatagtcattttccccaatctctgttagtgtcaatacaattattaccaagcaaaaacgcgggacaaaaggcgcttaacttccggccgcgtaaccgaattatccgattacactctggaagttaagcgccttttgtcccgctctgcacattggacgtattcaattcgaggataatcattggctaacctaaagatgatcatctatcttaatcatctttgggataatcaaccaccataacgttaaccgttgagtgtctaacaacgtaagcagtggtcgatcccaagatagctctggaaagaccgttaacccctgatttacccatcacgatcaatgatgccccatacttctcgggtaaaaccttggcaatttgaatcttaggaatcccaacgacaaaatgaatttcagctttaactcccgctttttcagcttcatcctgagcatcatccaggatttcctcaccacggtctctaaatgattccatcacatcctgccccaaagtgacaccatactgaacatagcgctgatcactcgcaaccgaaacgatctgcaaagttgatccgaattttttagcaagaactgctgcttcttgaacggctcgttgtgaattttcactgccatcaactggaactaaaattgtgtcatacattattaaacacctccataatatttgtatccacttaaagtttagcattttctccgcaaatcaccacaggtaacgctttcattttgcttgaaaaaatttaatgcttttccaaatgagcaagaattgatttattaacttgcagctctgcttgacgcttcttcaaacgttccgaataagttgcaacaagatacttctcttcggtagtttcagcaacaagttccggaaaatcaatttcatttagcggattagtaacaattaaactacaaaaggcgataaaagccggcgtaatttcacgagttagtttgtcttgcttctcaaacttggtaaagacttcaattgctcgtcgatttgcaccagtgacataggaagtacacttaacaatttcattttgtttaagtggtgataagaactgaacatgatcatagccagctgttacaaacgataaattgctcggggcaaatttaacaccagcgattcccgcattggcatccaatatttccagcgttcggccgccaaattggatttggccattattgaggtcccttggaaacacatagctttcatgaattgcgtacgtttcggcacaagttatttttttgatatgaaaatcccccttgtatctaaataaagtccacgtagttattttacctgttccattgaccggctgacaaatatttttaaagattaagaatgcattccagcaaattatcatttactaaaatttactaaatgtgagtgagatgttatactcaaaccagttctgaaagcactgtaccgaatgaggaggaaaaaacatgtatcaagcaaacgaacaacgctatgacaaaatggtttacaagcgagttggtaaaagcggtctcaaactttctgctttgagtttgggcctctggcataattttgggagcgttgattcatatgagaatcaaaaggcaattattcatcgtgcatttgacctcggaatcacctattttgatttagcaaataattatggccccattcccggaagtgccgaggagaactttggccacattatggcagaagatatgaagccctaccgtgatgaaatgatcatctccagcaaagccggttatcgcatgtgggacggcccttatggtgaatggggatcacgcaagaatatcattgccagcgccaatcaaagtttaaagcggactggtctggactactttgatattttttacagccatcgtcctgatccagatacgccgttcgaggaaacagcattagcacttgatcaattagttcgcgaaggaaaagccctgtacgttgggatttcaaattatagcggtgcccaaacacgtgaaatcaccaaaatattcaatgagctgcatacaccgtttgtgatccatcaacctcgttacaatatgtttgaccgccatattgaaagcgacttattcccagtcctcaaagcagaaggtaaggctgctgtcagcttcagttcccttgcccaaggactcttgacagatcgatatttaaatggcattcctgctgattcacgggctcataaatcaaccagtccatttttacatgaagatcaagttgaagcaacaattagtacagttaagcaattaaaccaagtcgcaaaaagccgtggccaatcattagccgaaatggcattagcttggaatttacgtgaaccggaaattgcttccgttttaattggtgccagtcgccctgaccaattggatgataacgttaaagcattggatcatttggacttttctgatgaagaactcgccaaaattgatcagattttgggtaaataagttggctgtttgctaatttagctccaatatttgatattacaatttgattgaaaaaataactattctttaacagattaatggtggcgagcttggggtaagaatcattttccccaggctcttttgctgtgatcactattattgctgagcttaaacgtgggttaaaaacagtagacaaattagtatcatatgttaaaatcatcatatgagataaatatcatattaattttgctatttcgaaaggaccaaaccacatgcaaagtcacgcaaccacaagttcattagttagtcgaagcctccacacagaatatttttcaaccgggtggatggcctttgaatttttagtcggtttcagttcaggccttcaagctggatccattctcttgatcgcctttggtttagacagctttttagaaatcatttcgggtagtaccctcatttggcgccttcgcaaggaagctaacggtgctcccaaagcagaaattgaacaagctgagcggaagtcttccctcatcgttggcagtgttctgctcttattatcagtctatgtcatcggcgtttcactttacaatctcttaaatcaccaagcagctgacaccagtattcccgggatctcaattgcgattgcttcagttatcctgatgccaatcctaactctcaagaaacggtcattgggtaaagcacttcattcagatgcgttggtggaagatggcatgtgtaacatcacctgcgcttacatggccgcaacggttttagttggtgctttgctgacagcactatttaactggtggtgggcagattcagtcgccgcactaatcttagtttactttattgccagtgagggctgggaatcattccaagagggtcgcaaaggctagtttggtattccgcgtcaaagtgaagtacaatcccaaataatataaacggccacttcctttcatgttaggaagtggccgttttgcgctagaaaattcacaagtctttttccatcgaaatatccgttggttgaaaaccacttttttcgtaaacatgaattgcccgtttattatgaccgaaaacatgtaaccccaatgatttgaaccccagtgcttttgcttgagtggcgatcagctttagtgcctgagtcccgaacccctgattttgaaaatctgggtagatttgaatgtcataaataaaggccttatcggagttctcatgatattgagccagccaaaccatcccaatcggttgcgtattattttgaatcatataaaagtaattatttttgctcgaaaagccgtccggaagcagcgattgaaaggctaattgagacctttgaagggcctcgtctttttgccaagtcccagctttgaccttttcggccgcataagccttaacggccgttgcttgatactttttaaacatctcggctgtcattttaactaatttaagcacgatgtcacctccaccatgtaaaattcacaacgttcaaatcaattgctcaaattatgctatcatttcaataatcaaaactattgtaaagagatgatctttcgtgactaacaatcggattaaaattcgtccactcagaccatatgagctagaagcattttggcagcttgcctttagtaatcctaatgctgaatggacaaaatggaacggtccttattttcatgaccaactgccaaccaaaattgattttttgacaaacattggtcccagcgactggctaaataacgactaccgctgggtcatcaccattgatcagcaacttgtcggtgcgctatttgcctactttgatgacggtaatttaaaacgctggttggatattggtatcaccatctacccgaatgacgcttggggaaatcatattggatcaactgctctgaaactttggatagatcatctattcacggatgtcacacagttaccacacattggattcaccacttggtcaggcaacaaacgaatgatggcacttggagatcgaatcggaatgaaattggagggccaaattcgccaggtccgatattggcaaggtcagtactatgactcaattaagtatggcatcttaaaagaagaatggaagaagatggcttctaacgaaaagtaatgtcatcgtaattagtggtgtcaccgccagcggtaaaaccacactcattaatcaacttaatcaaatatatccaagcagccgggttatttcgttcgacgactatgatattgatcaactctcaaccacaccagatatcaatgttcccttaaaagacgcgattaatcaatacgatattagcacgatgatgactgattttttatcagtttatggcaccacgccattggtgcttgttgatttcccattcggttatcggcacaaaactttacgcccatacattgacaaagttatttaccttcaaattcccttggacatcgcatttgcccgccaaatcattcgtgacgacacccataaatcaacggcagaaattatcagttgggctcagcaatatttaaacagtgcccgtccctactttgtcgaaaatcaacgttatgtctcagaaaatgccgatttgattttggatggcactttaccactaaaagacaaggttgccaaactgataaaactaattcaatcactgcaaaagaaaagatgagggataacagtgagtgagatagaacacagtctacttattatgtcgcaaattaaccgttttccatcccgttttattctcacattccaaaccccaatcgcaatatagctaatgaaacgaccccaacaatcacaattattaatagatttttcgacacaactgcactgattaacgtgggcacggaagcaattagattaggccaattaattgagggcaaatgccccagatgttgaataaacaagttttcaaaccataacgcagacatgatcacaatcggcacaaatccaagaaattcaataactcggggtgacaaattgaatcttttcaggataaggaaaggcgaaactcgtcctaaccaagtaagcaaaccgcttccaataatggttagaagaacaaaattaaaagaaggcatgtttcatcaccaccccaaaaaagcaagctatcaacgtaaccattaaaatcagcatgttgcttggaatgaatatcaggccaacaaacactagaattagcacaacacctaccacaatcaattgtaaactaaatgcaattgaacgatcactgataagttgtaaataagcaagtccaataaacattgcgacaattgcaaaatccaatccatatttatctggatcgccaattacattgcctagtaatgcaccggcgagggttgcaatattccaagccgcatatgccatcaagttaacggtgttaaaccaggaaaaattcaacgttttatttgtataatttaatttattcattcctaacgcaaagctttcatctgtcacaataccaccaatcaaaatattttttaataaactgtctcgtttaaaatatggcgctaaggtagtcgtcatcagaatcattcttgaattcactaaaaacaccgaaaaaataatggacagtagcggactgtgagctgaaagcatactaatggccacaaactgagacgctccaccatatgtaatcattgacatcaataagcataacatcgggcttaagccggccgatctaccgacaattccaaatgccatcgcaattcctatataaccaaatactgttggtagcgtttctttcatagcactggatacagttaattcgtcattcacgcaaatgtcccctcgattctttcaatatttttcagaaaataacattgaaatgttacattggttattaatcaaattctaatctggacgccatttgttgtcaacgttaattaactggataaaaaagcaaaaagcttttcctacttttctttaccaaaatttaatctaaaagaaacgccttcagacttgttttttaagccaaaattttataatatatgtgttcacgttaaattagtttgttaattaacgtgaagtttcattgatatgtgttgagccaacgaattctgaaacaattgttattatcgtttatcacactcatattttgaaatggaggcattgcgatgattcaaagcaaaactaggattcaccttgtcggaaccactgatactgaacgtgaaaacggcttatttgcaccgaattatccagcagcaaaccgcaaacgatacttggaagtgaaacgagtagcggatcgaaacccgtttgatgctgatgcagaatttgacttggctattgaagacaaactacgaattgatgccttgatgacttattaccataagactgaaagaaaaaaagaaaaagcaagttaatcgacctcacaaaactaaaaaagggcgacccacgccgagccaacaatggctgtgggtcgccctttcattttaatgattaaactatgctttcaaaaacagcataattccaaaaataattaacagcccataaatgtatttcaccatctgatttggatcaatatgatccaccaaccagttaccagtcggaatcacaattagcaaaagtggcacaatccataataacagttccccaacttccaagctccaaaaaccagcaattgcttgactggcaacaacaatgatgccaacacatagaaaatgggcctgcaaaatgccacgaagttccatgacctgccattttttcaacgtaccatacacaacaatcggcaccccatggctattataggcactgcccatgattccagaaatcagaccagccaagtaatcccaaccatttgcctgaaaccgaggctgactcttttgatgccgatagattcgaatcaaacaatagctgccgtaaacaactaaaaagacagctaggattcgcataatcaaggttgcgtcaacaaatttaattagtaaaatccccactggaactcccagaatggatccggttaccagtcgcctaacaacggcaaaattaatatgaactcgataacgaattgccccgggtagtgcaacaattaatcccaaggcaccaattaaagccaccgacgtcttcaaatcaaatgacaccaaagccagtaatggcattgtcaccaaagcttcgccaaaaccaaaaacagtgcgcaccaacgccccaaataacgcgatcataataactattccaaataacatctaacatccgccccaatttagttttataggactagtatacctgatattcagatcgttaaatttccctggatacaagtcaccgcatgaccgccaaccaatacctgaccattggcagaaaagcgaatttcaatacggccgtcacgtcccagacacgcgccttgactcgcaagataagttgcccggttcaaaagatgatggcgtttaaccagaattgccacgcaaccatttccgcttccacaaaccggatcttcatcaacgccttcagtcggcgcaaatgatcggacttccatatccgttggttcagaatcggatgtcagcccaaagaccgtcacgccggttactcccgctggaatgagtggctttagttttgaattatcgaccttaagtcgcaatacctcactggcatcggtcagctgtagcgtgaaccaggtcgcgccaacatcaacaatggcattaatcttaatgtggctggtgggaatccccaacgagtcagctaaaccactcaattgtttctcagaaattgtgtcgatttttggggtgggcatcgttaaaaaccgttgattaccatccaaatatattttaattaatccttccccacactcttgaaccaagtaattagcatgtttctgtcgaatgccgtgttttagcactgcctcagctgagccaatcgttgggtgtccggcaaaaggcaactcgctggcaggcgtgaaaattcgtaaacgataatcagcttctggatttgttggccgacagacaaaggttgtctctgacaggtgagtccagttggcaatggtttgcatttcacgatcacgcaatccattaccgtctaaaataaccgcaacgggattccccttgaatggtttttgggtaaaaacatctacttgctgaaatgggatttgttgactcattgtttcgccctctcttaatctctatttgataacgagtataatcattggcctgtttaaaataaaccgtttcttggaaaaatatgctacaaaaattttgaaaatgattacttaggcgattgttattaaactagaaaacgagcagatctcggccatatagcctgcttaaccccatattccaaaacctggaatatggggttaagcaggctatattctgagatctaagcgctcgttttcacactctattttaattttcttatttacttttcatctgacatctgataagataccatcaacttagaaaaagagggactcaattatgaaaaccaatactacttttaacgcaaataccattattgtccgcgtcgtcgtcattatttagaccgcgggcacacttttgcatgcccgcaagacgcgggcaggattggttttttaagccaagaactgtcaattcagttcttggctttttttatcctcaactagcttgaaaggtggtgatttttggaaaattgatattgctattatttatatgattgattagttaccccgtttttggcagtttattatgattgattttgaattgccgccgagtgaaattattgttgcttattacttagatgaaaacgtgcaaggaaaaggctgatcccggccgtgtaagcgagcaacccgaatattccaaaagcagaatatccggattgctcgcctacactctgggatcaaaacgcccttccttgcactctacgaaagagagctgacctacatggaagaaacaccacaaacatacagtcccacagccaaatccaccgttacccttcaacgagaccccgttaaaactgttattttggcctcaatgattgggacagccattgaattctttgatttctacgcttacggtaccgccgcagctacatactttcccaacgtctttttcccatctgtaaccccgactattgccatgatcctaagcctattaaccttcggggttgccttcattgcccggccacttggctcactgttatttggtcacttcggtgataaacttggtcgaaaacgcgcgcttgttgtgtccttattgctaatgggggtttccaccgttttaatcggggttttacctggttacaagacccttgggataaccgctatcctgctcctttgtttagcccggttcattcaaggaattggactaggcggcgaatggtccggcgctgttctggttgccactgaaaacgcgccaaagggcaaacgggccttatacggtgccttcccagaacttggtgcgccaatcggcttcttcttgagcaatggtttgttctttatcttagaatcaatgttaacgccagctcaaatggcttcatttggttggcgagttccattccttgcctcagccgttttggttatcgttggcctctgggttcgtcgaaagatgcaggaaacaccattattccgattagctcaacagaagaataccgttgaaaaagcacccctcgttgaagttttccggaagagctggcgtcaagtactccaaggtactttaaccatgggcgtttcctacacgttctttttcctactatcaacctggtcattaagttacgcaacaaccgcacttggatttaataacaaagaatggttgttactcctaatggcagccatcgttgtcttcgcggcaatgattctttactcatcaatcttagctgataaagttggccgcaaaaaagtgctcattaccgggacgatcctaatcattgttttcgccacgatctttccgttcttcttccaagggcaacacaacttacttggaagcctgttcttcctattcgttggcttcctaacaatgggggttatctacggacccatcggcgcattgctgccagaactatttccaaccagtacccgttactccggtgccggtatcgcttataacatgtccgccattgttggcgcagcatttgccccaaccatcgcttcatttcttgttgataaatggggcattcacgccgttggaatttatctcgccatcatgtcgaccgtttcattgatcgcactgctgacaactaaagaaaccaagtcaattgactatacgaaatagcgatcagtaactagttggaacaatctaataaacttcatgatcaccaaataaaataagtcgaaaattccttaattccagtcttgtaagttaaacgcctacgttgattggactcaaacttaagaagttttcggcttatttattttccaattctgatctgataggtttagagttcatcggaataaatcaaaccatcgatgactaaacttagtctgataaacgaaatttcctttaaccaaaattcgctttgattcaccaatgctggctgtcaaacaggtcattaacgtgagagttctttcatgcggcatggctttaagatacccaacctgatacttactgattacccttttggactgaacctgataaacgtaaaggcgtttgttgtccgtcaaataaacacgctgtccccgttggacacggaccaaaggcgaaaataatatttgagggtctgccatgtggtgacctgcaagtgcataatttcctccgcccatctgctcatttgctcgcattgtaccagcgcccttaagaagattttcattatttagaccgtcatatattggcaatttcaatcgcaccgacggaatggcaatttccccaattccagccgtgtttgactgccaagctttaagtgtattcttccaattacccggtttaacactcgaaaaatcaaaattcgaaccattttttgggctatggttacccctgaaatggattgtttgtgcgatgtctatccgacccattctggtaatcaacaggctctttaacggttcattaatcaccagtaagaatcccaacacgcccaaagtactcatgcaaactgttgcccatttacgaggtgtcatctgtttttaaaccgtttcaaaacaaatatcccacaagcaaggagtaaaacaaagccaatcagcatcaaataattgggagattcgcccgtttgtggtaaaacactagaagtccgtgttggcgtctgattagtggcattcgacgctgatgaagaatcagccgtgggtcggcttgaatttcccgctattgctggtacctgattttgactactgctgcttgcggatttagttgctgaatcaccagaagacattgagttgtcaccatttcgattgttgataacggtacccacactattaccaccattgttagcactactctgattcgtgttaactgttgatccgcaagtcgagccagatgttgattgaccgcaaccgggatttaacggataaaccgtctgaggtgttactggacaaaccggttttgttggcgtcgaattggttggtttattttgaactgtaaccgtactagcttggctttgagcaattgcaaccgtaactggatactgaacatcattattcaactgataacccattggcgctttagtttcaacgaaatagtagtcaccagtttgcaaattatcaactgtaatcagaccatttgaatcagttattaggcctgtcttgataactgttgaaacaggtccttgacgtcgataaagatcgaaaacggctccggacaatggttgatgagtgctttgatcagttttgattagtttaacagatccaggcgtttcctcatcactagcggttaacgtcactggttcagtttgggaaccaattttgatagtaaacgataactggcgattgtttaattgatagccagcaggtgctttggtttcaacaaagtaataacttcccggcattaagttgtcgtaaagaatttgtccttgattattcgttaccaaatcatttttaaccaaggtgccatcttgcttatataaagcaaagcttgcccctgataaagcctgattagtctgtttatcaactttggtcagttgaacagatccaggtgtttgactatcggtcacattaacagctgcaggagcctgctgattaaactcgactgtaactggatattgttgatctttatcgagttgatagccatctggtgctttggtttcaacaaaatagtagtctcccggtgctaaatcactaaccgttaattgaccattggcatttgttatcaagccttgtttaacaatcgagccatccttactgtataaatcaaattcagcattagccaacttttgcttggtttgctgatcagtctttgttaaaacaactgaaccagtggcttcactatcgttaacggtaactttggcagccgtcgtttgattaaatatgattttaaaaggatactgctgatctttgtttaattgataaccagctggtgcttgggtctcaacaaaatagtaatcaccaggttggagaccactaactgttatttgaccgttactatccgttttcaaattagattgaaccaatttagcaactgaattttgttgttgatatagatcaaacgttgcatcaccaagcgctttaccggtattggtgtcttgcttgattaattgaactgatcctggtgtcttttcatcagtcgcagtgacagatactggttgagtttgttgaccaactgcaacggtaaatgaatactgatggttatccaattgataaccaactggtgactgtgtttcaacaaaatagtaatcgccgggctttaaattgtcatacgaaatcctacccaaactatccgttaccagaccggctttaattaatgtcccatctttttggaacaatgagaaggttgcgctagctagcttttgtccatcatcacgatcaactttggttaacgtaactgccccagctttttccgaattggtaacagcaagtgtttgattaatatggctgccatcaatcgcgaatgcgtatgttttattcttatcaaagttgtacccatctggagcgtcagtctcaactaaataataactaccggcatttaaaccagtatatgtcacttgaccatcttgattagtcgttaaacctgacttaattaacgtcccgttttcttggtatagtgagaatacagctccttgcaaaggctgattggtgtcaaaatccgttttagtaacagtgacgctccctttctcatttggaacagtatcattgatggtattagtattatcttgactgctggtaatggtgacttttttaccttgagcgtattcagttggaataacatagccatcggctgccttggtttcaaagagcaaatagtcgccagattttaaattttgccaattaagtttaccgtctttatcggtcgttccgcttcttaacaattgtcctttttgtccattattatcggcatataattcaaagctaacccccgaaatggaacttttagtcgattgatcaactttagtaatcgtcaaatttgaatttttgccagttgctgatccaccgctattaacaactttagtttgtgtcgttttactctgagttacggttttttcaccgtttccagttacagtaactgcattcgttaaagtatcatttgccaaagatgaattaatgagcgccttatagtgaatggcataagcagaggtaatcggattcttaaaatcaatttttaatgcctgtttgccagcattgtccgtcgtcaaatcaacgttataatcggagccggcctttaaaggattggcagtatcttcagtgaaactgccattttgagcaaccttggttggataaatgataatcgttgagggatcaataatttgattatctgatggcgtatcattaacggtcacatcttttaaactggactgttccttattaacccaaatattccacaacgcatatgatgcatctgttggatcttgttgcccactcttttcagccagattaccactattaggcactgttactgctgctgttagttgactactttgatcgttgttttgatacgttgctgtgttgttgtaagtttcttgatcaattactttaccagctaaacttgtttgataggttaatacatatgctttagtgctattatccggtaatttggccgttaatcgttggttttgagaatcataaccgatattagcattatcaacttcagctcctggtttataggaaccatccgaattgatcgttgcctcagttaattttgcactcttagcaacataatcttgatcaccttgaatattatcaacaatttgggcatcttttaatgttcgttgattataattggcaacaaccgtccaagtaatggtcttatcgactggattatagctgcctgatttactaccatcatttggaaattcaaccttaggtgtaaaatcagcttgcgcattattggtatggggtgaacctgattggtccgtccaagttgcctttgcttgattggcccatttcaaagaatgtgccaatttagacgtatcaaaactcgtcttgtaagctaaaacaagccaatctttagcgtgttttttcaaattacccaacaatattactttaaaaccggtagatgttggcaccacctgataatctgtgccattaaccaattcttttcctgtgtctttatcggttaatccaaacgacttggtatcaacggtcaatccatctggaaccgaatcagtcatggaccaatctgacatgtcttggcgagccatattaatatctaagcgccactgaaccgttttggcattgtaatcaacacctgcaattgatttggacaatccttgttggttaacttgttgatcaccggcagacacagtttggccgttgctggaagcagtattgctaattgtatcctgatcatcatttggacccgtcaactgagactgataggcaacttttacacctcgatcaagcccttttggaaatgtaataatcatctgagttttatcatcattgtaggtgattttatattgatcgtcagtaaccgttgtcccatcttcataagttaatttaggatcaccactaaacacttggcctttagacaatgtatccgttaattgagtgttagccgaaagtgatttctcaccaaagttataattaacatgccaattatatttttgactaccattattatcttgaccatcaaattttttctctaagaatttcccataattaacagttaccgacgcactagcaggataatccttaccattattgctgagggtagctatattatcaaatttaaccggtccaccagcatctggaacggcactactaccaatatccgttgtgtattcgatcttaaaagcttgatttgtttcagcatatttgccaattagctgcaccgtgccatctttgtcaaccgtataatcagtaccggcaatcaaaggatccccagtggagataacggcaccttttaagttaactgataccggataaaccaccgttttgtccaaagtagtccccttaggcatcgggtcctttatttgtgcatccttcaatgcatttgtatcagtgttaactaagacatcccaagtaatttgtttattatccttggacaccgtccccgttttagcgatatcgtttccacccgtcggattaacaataatgctggtcgttttaaccccatctgtagtcggaatatcaattgtttggctgccagcggttgttttagaatctattttctgggtgtacgtaaattcaccgctaatcgtatcgtgattttcaacattactattaaacgtgaacgtcactttaccatctgttgtgatactataagttccataatccccaagctgaccagttcttgcactgtatgtaatattcttaggcagctgaaaagtataataatcaccactcttcaattgatagttattctttagcttatttggaattgaccaatcataatgtaacgaaatattagtatctggcgtaatctgatttgaattcgacggctgattgttctgatcagtaaatgaaacatccgcattatcaataatgctgtggttggcagaatccggtaaaacagtgctaatatctgtcgtatctgccccgtatgctgttacctgaaaaaatggtgtaattagttgaaatgctaatatcatcgtcattagaacagtgtaaattcgcttcaagaagttttctctttgcatctttttctcatcccttcaataattgctttcgattaacgatcaatcttaatgcccctctaaggttcacatgtgcaattattgatgtgcgcaacatagtatgtcaatttagttcgaatacatcagaaaaaaatgtaaaaattgtcattaaaatgacacgttttatatttttgtagccaaaacatttatggaaaagcctttttgtgttataaattaagtaaacaggggccataattactatcataaaaaaggtaatcggttatgcttaatttttccgatcaccatttattgaaaaaagtatgaattttctgtgaatttcatattctaataacgagcacaaaacgggactggacaaaattacttttgtccagtcccgttttgtgtaatcataattattaccgagtgaaaacgaacgccaaaagataacttcctaccacgtaaccgcattatccaaatattcaggctcagaatatctcgctgaacgttttacttggtagaaaacgtggaccagcaagcagaccccggccatataagccccctgacttaatattccaaaatcgggaatatctcattgaactttttacttggttaaaacgtggaccagcaagcagaccccggccatataagccccctaacttaatattccaaaatcgggaatatctcgttggactttttacttggttaaaacgtggaccagcaagcagaccccggccatataagccccctgacttaatattccaaaatcgggaatatctcgttggactttttacttggttaaaacgtggaccagcaagcagaccccggccatataagccccctgacttaatattccaaaatcgggaatatcaagtcagggggcttatatggccggggtctaaacgcttgctggtccactctgttcattaattattataaaattctcattctaatcatcttggggatgcttgtctttaaagtctttccaagcagccaatcccttgtccgttaacccattaacggagtcaccgtcactcttaatatagccagcttcaatcaacggtcgcggattcccgccgatcgcattgtcacagtaatcaacaaagtggttaaccggtgtcccagcgcctactcggccagattgaatggcatttaaaatatcaaaatcagtttgtgtcagttccatgttaaataattccccttttttcctaatattataatcgtcatccaaatgagagtaaacgaaaaggaccttcggctgacagccaactactcgcgatgcgttttttcccactgcttaatttgcgccaatcgctttttaaaccgaccctcgttaccctgttccgttggttcatagtaaacttggccaattagcgaatccggcattgtttgcatcgttgtcagcttagctttagattcgtgcgcatattgataccccttaccatagcccaactcagacattaatttggtaggggcattccgtagctgcaacggtaccggctcgttaattgaatgcttcacatcagcttcagcctttaaagtggccttataaacggcatttgacttgggggcaagtgacaaataaattaccgcttcagttaaatgaacattacattccggcatgccaataaactggcaagcttgaaaaacgttgattgccacattaagggcattggtatctgcaagcccaatatcttcactggcaaaccgaaccaaccgccgggcaatatacaacggatcttcaccgccgcttagcatccgtgacagccaataggtcgcggcatccgcgtcactattacgcattgatttgtgcagtgccgaaatcagattatagtgttcttcaccattcttatcatataagaaagacttagtggccattaattgatgaagatcatcagttgaaacctttgttttatcgccggcttttggactattgttaaccgccatttcaagtgtatttaaggcaactcgggcatccccattcgcaaattccgcaatttggtgaatcgcctcatcatcgatttcgatggtttgtttaaacccgtctggatttttaagcgcgttatgaatcaattgaataatgtcatcggtcgttaatgggtgaagcacaaagactttgcaccgcgataacagtgctgaattaatttcaaacgagggattctcagtagtcgcgccaattaatgtgatgcttccccgctcaacaaacggtaaaaaggcatcttgttgggctttattaaatcggtgaatctcgtcaacaaagacaattgttttaccgcccatatcccggttggcctcagcatctttcatcagattgcgaatatccttgatcccgctggttaccgcactaaatgtcacgaactttgcctgagttttacgggcaatgatttctgctaaggtcgttttcccaacaccgggtggtccccaaaaaataattgagggtaattggtcgctttcaatgatttcacgaagcacttttcccttgccaagcagctgttgttgcccagcaaactccgagagcgttttgggccgcacccgactagctaacggttgattagcctgctgattcccggcaaatagcgattcttgtctcaaattgacaccttctttttagtaatgtcttccaatacgaactaatgttcattatatgaatattttaacattttcatattggcttttctaccagtcatgttcagccttccaccactcatcgatatttcaatctcaaatcgattgaaccgtgctaggatacaatcaataaaggagatgagcaccatgattattcaagcaaccggtctcgctaaagcttaccaaagcaaagttgccgttaaccatatcgatttagctgttgaacgaggtagcttaaccgccctacttggtccaaatggtgcgggaaaaacaactacaatgtcgatgttaaccggcttattaaccccaactgccggaacaattcaaatgacttctgacactaaaatcagcatggtatttcagcaaagcattcttgatgagcagctaaccgtcaaagaaaatctactgatccgtagccgattttatcagcaggctgttcacgagatcgatgcattaattgaaaaggttggcctgaacgactttatcaatcaaaaatatggcagtctctcaggcgggcaacgtcgccgagtcgatattgccagggctttaatcaaccaacccgatgtccttttcctggatgaaccgacaaccggtttggacattcaaacccgctccgcaatctgggatctgcttcattcactgcaacatgacacccatttaaccattatcttgaccacccactacctcgaagaagccgacaacgccgatgaggtttacatcattgatcatggcaaagtcattgccagcggttcggcagcaaaaattaaaaacgattacgcaaccaatcggctaacgattatcaccaacgatgcccagcagttaatgaagctggttccagaaagaattccccatactcaagacaatcaaaaggtgatttgtttacccgcagatacacaagctgctttgaatttattggaaaaataccgacagtatattgttacttttgactaccagaacggcacaatcgacgatgcctttctgaaattaaccggaagggagatgcgttaacatgttcgcattaacaaaacgaaacctactattgtatttccgtaaccacaccggcgttttcttctcactactcggcgcgatgatttcctttgtcctctacgttatttttctaaagatgacaatgatttccagctggcagcaggtccccaactcccgtcagttactagacttttggttgatcggtggtaccttatccgttactgctatcacgacgaccctttcatcacttggtcaactggttagagataaagaacgcggggtaatcaaagatttttacttaactgacatctccagattcaaaatgacagtcagttacatgctaagtgccgccattattggcttcctcatgcagcttatcatgttggccatcatgctgggatactttgctgctaccgataatttagtcatcccctggtcaaaaactcccgccgtattggggttggcatttttaagtgcacttttatcagttgtcattaatatgctctttgtccaatttatcagtcgatttgactcactaggaaccatcgaatcaattttaggtgccgcaagtggttttctggttggcacttacattccaatcggcggcctaccccatttcgcccaattactcatcaaatttactccaggatcttacgtcgccgcgctttatcgccaaatctttatgaatgaccctctcaccaatgcatttcacgggcaacaaggtcacttcgaaaaaataatgggcgttaaaatagcgtggcagcatctcttaactggaaatcaaactatcggactattaattactgccttcataattgggatgttggtacttttactaaccgaattaattagaagtcaaaaaagaaataaagtaactgactttgaatgatagaatataagtaactttaaacatcttctcagagaggttggcaaaccgtatggaaattcactttcacaaaaatgaacagcttaatgatggcgaaatcaatgccacaatttcagccaaccatcaatcggcggaagtggacagcatcattggttatctaaaaaattatcatgcgaacccgccaacacttattccgataaaatcagcggatcacgtcttattggtcaaaccccaagacattatcctaatcgatatttcgggaaccgaattattaatttacacaacggagcaggtcattcccaccaaaggccgactttacgcattttcggaccggctcaagaatcccaacttcattcaaatatcaaaacatgcggtcattaacttggatcacctcttatcattggaagatagttttactggcggaatgaccgcaattctaaccggtaacgtcaaaaccgatatcagtcgaaaatatttaaatgaattggaacatcgacttggtttgtgaaagcgagattaacaatgaaattattaatgaaaaacatgcgatattttgttcgtggcgtgacaattggctcaactctgtacctgctaatcattgcgagtggctatcaatcaacacagccaaccgttaaaaacattctaagtgttatgctgatgagcggcctgattggcttactcagtcaaatatttgaaattgagtcgttgtcctattcagttgtgctaatcggccatttaatcattacgtttaccttagtttcagcaatgatggcatataacggctggttggatcaatggcaaatgccacaattctggatgagctacctattagaattcgtgattgtctatggactggcatgggtcatcatttacctaaccattacgacaaaaattaggcgaattaatcaggcattaaagaaacgaaatctagacaaaaaataacaccagctgccgaaaattactttttcagcagctggtgttattttcatgttaatcactaagcaatcatataagcggcaatgttaaagacctgtggcaacgtcacattcttatcagcgaacttcttatttaaaagcaactggcgaaagtcttcaatcgagatgtgttccacatccttgattggaaaaccggttccggtatatgaacctgttgttagagtgacaaccaatccctttttactatccaaacttacagcatagttttcaaagtaatattgattatcatagtttccctttaactctttatgagccataaaatagtttgtaataaagtcgtgaaaggcttcctttgaatttaatgcaactttccattgttctttagtagcagtcatttcaaaaaactccctttctttgtttcatattgacgaattggactcattaagtctttttgtaaatgaagtctttatttcatttactgattttcattctaaacagatttgcttatagtgcaagtgaaaaacaattgaaaacgttgacattataggatttattcgttcttgcttgtgaaaacgatttcgtctcctccttcattttgaactcaaattcgttatttcgtcactaattgcgacagcgaaatgttacaaaaatgtttcaagcgacttctaagcaaactttatattactattatggcaagcacaaacgttgctacatcagcgtttttactctaaaatgccaatataatttgaaagtcaaaaatgtaacgagcttgttacaaaccaaagcaaaaaacatggtatggtataggtgtcttaagaaattcttaataatataacgagtttggggagatgatttttaatgaagataaagaaacaagtcgctgtcggtttgttttcaatggctagcatttttacattaagccaagttgccgcaagtgctgataccaaagtaactgtcaagtctggtgatacgctttatcgaatcgccaccaagtaccatacgactgttagcacacttgccaaagcaaatcatctaaaggatatcaatacaattgtaacggggtcacaattaacagttccaagcaagacaagtttaacttcttcatcaagcaccaaagctaaaaaatacacaacagggaaaacttatactggggtcaagaaacaaacaaccagtacatatgttagtccaagcaccaaaaataaaaatcagagcagtacgaagtctgttaaaaaggcagctgccaagtcaacatttaccagctcaattaagactgccggcaccactgccaataccactggtgttgtcggtttagcgcaacagctgacgactcaaagtattccttatcaatggggtggcacaaccaccaaaggatttgattgctctgggttagttcaatatgtctataagcaaaatggcgtttcactaccacgaactgccgaggctcaagctgaagcaacgacttacgagtcagtttcagacgcccaaccaggtgatctcttgttctggggaagcaagggtggcgtttatcacagtgctatttatattggcaataaccaatacgtaaatgcaccggaacctggtaagacagttcaaacacaaacaatttcaccatactttgcaccaagttttgctggtgaagttagttaacaattgaaaattattccatggcatctatctaatcgggggtaggtgttttttcttatctaaacagactaaaaacaccaaatactgttcattaacaggacttgatgccttctaatttgaatttcgtttaagctttctgccactaattaatctttggcatgtttccagtggaagataaacaaaccaattgacgcaattaacatgatcccactagagaacatctcctgataaacatacgtcaacccgttattatccggccagatcagttcagcaatgttgtctagaaacacccagctggtaattaagataatcactaaacagattagacaggcgacatacatatacaacgttcttatccaagaacttttcactaagacacttcccctaccctacggtaaatccaggtatgattagcgtatgacaaaccacgtgggattgcaaaatcggcttgacggggttaagcaccagtgttactttgctaaaacgcgcaaaaagccgcagcgcccggccatataagagacttgggtccatattccagaaccaggaatatggacccaagtctcttatattctgggcgctaaccgcggctttttgcgctctctaattcttctccaactgatccaacgcattttcaagctgcgccttgcttgcgtcatccagatccgggtacttcaacggtaattccttcattctccgatcaataatatccgagacacataatcttgaataccacttatcatctgatggaatcacataccatggattttgctttgatgctgtattcttaattgccttttcataagctgcttgataatcatcccagtactgacgctccttaatgtcagctgccgagaacttccaattgtgatccggcatttcaatccgccgcttgaaccgattcttctgctcatccttcgacatatgcaagaagaatttcaagaccataaatccatttctttgcatataatcttccaaaaaattgatatccttgtaacgatctgcgaagaaatcatcgtttacctggtccaactttgaataatcaccaatatgcgcgttcaaaatcagctgcgggtgaaccttactaaccaagacatcttcataatatgaccgattaaaaatgccaatcattccccgagctggcatgtggcgccgaatccgccaaagataatcatggttcaattcaattgacgttggcaccttaaaactagtgacttcacatccttggggattgaccccactcaaaatatggcggatcatactgtccttaccggaaccatccatcccttgaaagacaatcagcattccaaaccggttctgggcatacagctttccctgcaaatcctgcaaggtactgatattactttcaattcttgctttgatatccgtcttgcttaaattttcatcggttgcagcggtcgaccgtttatttagtttaaatttatcatcaccgttgtaacgaaatgacttctcacgatcaaacatttttttatcatccaaaataagaacctccttgcctaccactttaaagatagcacagggaagctcatgtcgtgtcaatcatgtttacttttcgaccaatttatgacgtcagagtcgaaattaacggtcacccttagccaattcatcaactggtgttttaaaatacgtcggctcccctaactgatatttaatcccatttcttctcagaattttggcaagcgtcactgcatacacatcactattaaagctctgcgacatgtctacgaagattttaccgtttgtcgccagcatctcgattgatagtccgtttgtgccactcatataagtgtgcatttcatcaatatacgactcatattttcctagtttagtttggcctgaataacttaggacaaatgtattaagtaaaacatggtcaataaacgccatcatcttttgtttttcggtaaacgttgataaactatctaaacgatcaaataaataggccatcttgttagggtgtgtcttcaaactatttaatcagtaaaaaaatggcaccaatctggataaatgccaaaaaagaagctgccaacttatcaaatctggtcgaaagatggcgaaaatgcttcaatttattaaaa

SEQ ID NO: 676 - DNA, 32621 bp, Unknown
  Metagenome-assembled genome
tttacttcttcgaggtggccgttgcgatttccggttacttgaacgggattaatccattcaaccaaccaggtgttgaagcttacaagcaaaatatgtttgctttattgggcaagccgggttatgaagatttaggcgataagttacgtaaaaagctttaaaatttaatgaaataatccagaattaatctgaagtcaggccaagaagtaacctttgtctggcttcatttttttacacgaaaccatgttaaaggaaagcgatacacattacacagtaattattaaaataaaagaaaaatcacaaaaattgtattatttgttatgaaagcgcatacttaagttggatagttatcaataacacttaaatactaaggagtgatttatatgtatgaaaatattttagttccactagatggtagtaagaacgctcaaaaggcattatccgttgctattaagctggcaaagaccttttcatcaaaattaacattgctttcggtgattgataatcgtaacttttcaggcaatcgatcggtcgttaacacggcaccaatcgttaccactgatgagatcaccgaattatcaaaatattctgataatgtgattaatgccggtttacaagtcgttaaagataatggcttagaggccaaaacacttattaaacgtggctatccaaagtcaattattgcgactgacgttccgacagacgaaaatattgacttgatcgtcatgggtaaatcaggaaccggcgctttggatcgactaatcatgggatcaaccactgcttacgttgtccgaaatgctcatgtccaagtattagttgtcaatgatgattaattagtcagccaacttgctgaaaacataaagaaattgttctattgctaaacaaagttaatatcaaaaagaggctgggataaatgactattgtcccagcctctttttgatattaatttgcttgtcataaagatcaatcagtcgttaaaaatagaataagccacgaatagataaagcaaataattttttccatttctaatctaatttgtcaacctgaaatatattagccgtcaactactgatcaacaattactgttggtccggcaaaactaacagccaacaaccaaacgctgattattaggcaaagccattaaggatcgcacagctttttcatttgaactaatcgttgaaaagtcgaatgccaaatagccgggcactcagctgatcaattgctgaaaacttaatattaatcgattgttgctgatcatcagttaccgaaattggaatggtgatttgataaaaaccatcttggtcagcctgatcatttcgctcgaccagaattgtttgatcgagattaaattctttcatggttacttgaagctgcttaccggcatcggcaacgttaaaggtcaaacttagccgtagatcaatcagcggcttggttactggaaattggtagctgaaccagccagttgggtgcgcctgcctaaatcgacgaccacgcagattgcccacttcagaatctgcctgttttaagtgctgattaatctcaaaattgttagcatcaaagttcgttaactcaccaatggtatgctggcgataattggccaagcgtttcagttgatcagctcgctgctgggcttcttgtgaccctgcctgctgccattgaaaataaatgccataacgatgctggtaagtttgataatatggtataaactgaatctgttcatcaacatttggcagtttaaccgagacaagttcacggccttccccaactttgaccacagcctgctgggcaaaattctttcgccaagctgaccaagtctgatgagtggttaacgttgaagtagccgcatcgttatgagtactaatgcgaactaataccccgtttggtcggtcggcagtcagctcataattgtctaattgtccagctaacacgtatggcccataactaaatgcaagataatggggattgtcttcggtggccaaaattgataatgccataggcaagtgcatgttaagttttgcaccggcgctcaaactttcaacatgccagaagtcaacggtctggttaatttcaaccggatgatcattgagaaccagggcagcattgcccttaacccattccgggcgccgaagtgctaaggaaatcgaaactgtcggcttgctcgaatcaatggcttcaattgtaattgccacgtctccccgtcgacgatcgacatcgaccgtcattgttaaattatgggttaccagtcgcaactgatttgaaaagtataaattgacagtcaagtaacgatcgtccataaagtagtcactatcacccaatttagtgaaattctcaattcctgtcccggtacagcaccaaaattcatcaaatggccgattaaatatcttagtgtaaccagctcccattggttgaaagtaagtcatcatcccagtttcaggattttgagagcctagaattgcattacaatatgttcgttcataataatcaagatacttcttctgcccggtcactttaaaaagctcgcgacttagttttaacacattatacgtattgcaagtctcgcaggttgtcgcaccatcttttaaagccgcatcttcgaaaagttgacctggttcatgaaaatgttcactctgactattgccaccagtcacataagtatggtcatcaatcaccatttgccaaaaattctcagcagcggttaaataatgaggtaattgtttggcttcatccgcagttagaaattggtcagctaatttcggttcttgaaaaacttcatatcgtcgaagtgctccaattactttgggaattgttgtattggcatgtttcccggctagcacatctcgacgatgatccaattcatcaaataacgccgtttcgtcgaagtatgttgcggctttcaaatcatgcggattttgcgttaaggcgaataatgcgtagagtccatcgttcatgccaccatactccgtctttaacatttgcgttggatccgttaatttgatcatccgccgataaacatactcgccaaatttttcagcaacttcccgggcctgatcagctaattgagcatcaatcgaagccacattgaccgcaacggcaattagtccagctaaaattttatgcaaatcataccagggaaccagaacattttctttttgattttcaggaactggcttcccttcaacagcatcaagggcaacttctcgaaacgcggatacgtaacctgcactttcgggatgcgccttagcgtattcggtctgggcttttaaaagacccgtaaccgccgtggttaatttagcatgaatcgcagcttgagtgtccaaattcccttctgtgtgaagtgcctgtgacagggctgacaaataatgaccaaaaaaatgaccccgaaagttattacctgttggccgttcccagccttgataaccttgaacattgtttgttttgatgccggctactttgttaaattccactaaaaatcgttctggctccaaagccagtaaatacttaaccgtcaaattatgagcggcaataatctctggatcagttaatgtgattaaagccgaatcgacatctcgaatcatcatttatcctccactgactgcgtttgcttgatcaaataaacatcatgtgaaccaatcgttactgatcgctgaagatcaatggtagctgcagaccaaatttcatgagccccactttgaacaccataatcgactaacttgtcagccgaaatagtaacatcactatccgccacattaaaaactgcaacgtactgattttcttgactagttgccacccaaacaataacccgattgtctcggtataattgatatttttcggtaatttgatcatccatcattaacaagtcgcgattagtcaacaaactttcagtccaacgatctagatccgtgagttcaccacccataattaggggtgactgcataattgtccataacgtcatcatcgttcgctgttcggcttttgtgaatcgtgtttgccgattaccgcctggaccatcaactgagcgaatcccaatatgccccaatggcagcatatcacaatccggccaatttccggaccgagaaattggtgcccactcttcagctcgatcaaacatgttggccaatagtggccactgatcccaaaaatcattggttattcgccacatgttcgcgtttcgctggaaaaatgatccattggcgattggtgccggacctggtgaaagtgacaggacaattggccgaccagtcttggcaatcgccttgtgcaatgcttcaacttccggcttatgcgttccacgataaattggtgagttggctatatcgtcacacttcagaaaatcgacaccccatgacgcgtacaatgccagcaacgaatcatagtagagctggccttccggcattttcatattgacgccatacatatccgagttccaaggacaaatattattcttggcaatatcacgcgcagttttggaagtccctttaatcggcgttacattttgaactgcctgacggggaataccacgcataatatgaattccaaattttagaccgagtttatgaatgtaatccgctaacggtttaaatccctttccgttagctgccgatggaaaacggccaggatccggaattagccgtgagtaatggtccatttttaacgggtagaaatcatgatactgtgatgaattagcagttggctcataccattgaatgtcaaccacaatatattgccagccatattgttttaaatgtttggccatataatctgcgttacgacgaacttcatcctcacgaaccgaggccccatacccgtcccaactattccagccctttggtgggacaggcgcaaattgtcgatgaaaattatgattcaatccgagtcatcctttcatatttactgacatcatttacaatactttaacaacgttaatatagcgcttacacaattagatgtaaatagctttgttaataaaaggaaaaaagtatttgtttatatgagtaaaaacattaacaaccaggattgttttttaccgaattgcagcaaagcgttaacatatatattaactatcaatgaaagtggcttaaatagacttagacacatcagataaattgatcccaatatttgctgattttgacagtgaatcctgggaccacattattgaattactatcgaatcaaaaaataaccatttccgatattttcaacaattgctgaccaccagacatcactgttagcttagaatggtaagagcattaatccatggacaagtccaggcgattctttatatgtaatgaaacaagacgcataagcactttcataagaaaccgaatttaatgatcactaattgtgactactactttttcgtccttcaatccagttatgatttcaattaactattttagcccttaatttagtcatctattttatttgtgggaatattgctttcgtagctatcatagttattttttggcttttaaacggcttggtttgtaaaatgatcggtttaccaattaccaaaagcatttaaaataacttagttaccaaaactgacatattaggatactttttgacattttattttctattcagtcaagagaacgatttcatactatttgctcgaataagtcctttaatatagcgttttcataagtagttttcacttgtattatttttagaagtgtttagaatataatttgtagttgagggaagtaagttgcctgctaatatatcagtaaactatcttccaaatttatgacgaattaacattgacgaaaatatgaatttcaatcaaagggagaattttataatggcagaaacaaactggaaagatgcacttaagtctgaacaggcatttaataattttattactgggtactttaaagatcataaagaattaactggcgattatgaaacatcatcgtattatgaatactataccgttcgccttgatagtaaagaagggttgatcattaccttgacaaccggtgttagtccagctgtcaacaccggaactgccacgattcctttcaaagatattgaaaaactttcagttgaacaattccgtcaattaattttaaacaagaagttcgccgacatgcacacgtcattggcagatgtcttcaagacagttgctggtgtcccaagcgttataaaataacgaactgtgataaaagaagttataagaaatcagagtgaaacaaaaggcggttaacttctagagtacaactggattatccgaatatgctccgggtaaaatagtcggataattcggttgtacggcaggaagttaccttttatctcacgtttcctctcggtaataatcgtgattacacaaatagggactggacaaaattacttttgtctcagcccctttttttgtttatttcttaccgttgacacatttaaaaataacatttcatctattcaaaactgcgcattctatgacgagcctgctttatcttccaaacattttgttattcttaccactctacttcatactcgggtttaattttgatccaaaaaccttgttgctgcttcaacaaacttatcataattttgaaaaatgccgccatgacccgcatcaggataaataatcagctgactgtttggaatccgcttcgccagatcataagagttcagtgtcgggaccattcgatcattgtcgccattaacaattaaagttgattgttgaatttgcgataaatcagctggttccgcaattccccagttctgaatcgcttttaactgtgttcgataccccttcagactaatcgacttatcacgattttcttgccgttcttttaaccgcagcaagaattctttggctttttgctttccgtttttagttcgggtaaaaaataaataggtcttaacatctttaaaggtaacgacagaacgggcaaaatcccaattcgagattttggcaacatcttcgattccttgaccacctcggggtccggtaccggctaaaattaattttctgactaattgtggttctatagccaccagttcctgggcaatcatgccacccattgaaaacgataagacgtcaatcttggctaatcccagcgcatcaataaatttcagcgcgccccgagccatttgttcgatagaatccggaaccgacccattcgaaaaaccgaccccggtattatcaaaagtgatcacccagtggtttcgggcaagaccgtcaacgactcggggatcccaattatctaaggtccctgccaaatggcccaaaaagactactgggagtcctttatgttctccgagttcacggtaagaaaagatggtgccgtcacctgcttgaattgttaaatttggtgcggcatggtaacttttattgatgctcatggcatgcaactccaatcattaaatgatatttcaactaaaatctgatgacggctttcccctttagatgaccatttgtaactaaagccagggcctcattgatatcatcgattccaaattcagttggatcaaccgccgggacaatgtcgttttcttcaataacttttgctagtttttgcaattggctaccactacttctaacaaaaatgaagtggtattcaacgtctttgccggccgcttttttatcaaacttagcgccggccacgccaaacaattgccgttttagccaaggtaaattccggtcaatggcaaaccgcttattaggacccgttctcagcgaaagcaaccggccaccgcttttgatgatcgaaagttcacggtcaaactcatctggtccaagcgtatcaataacataatcaacatttttgaggatttcccagtaattctcggtttgataatctaaatatcggtcggcaccaattgccaacgttcgctcacgagcttgagcattgccactaacaatcacggttagtcccatatctttagcaatcggaacggccatttgaccaaatgaaccagagccccctggaataaacacggtttctccaggctttgctttcaattcttcatgaagtccctgataggctgttagtccggttaacggtgctgcggcaccagtcaccaaccccaagtttttgggaagtttggcaattgctgaacttttaacggccacgtattctgcaaaagcaccgattttttcaattggcagcctggtatagataggatcgccaactttaaactcattgacgtgtcggccgaccctttcaataaccccagttaactcatttcccatagttagtggaaatgaataatcttggattagtttgacacttcctgttccaattaagttttccaacggattgaccgccgcaactttaacctctactaatacttcatcgtcatttatttctggaaccggaatatcgttgacgttcatcttaaaatcttttgaataacccgaaatttgagctgctttcatatttatcctccaatagccgtgactttttagttactttttcaataaaatgtaactttcgagcaaactttatcagtttaagtaacaaatgtcaaaaatcgtaacctccccttttatatgttattattcatgagaattataaatagaaaggagaataataaagaaatggcaaaaattacacaggaaaagataattgaaactgctgaaagtttgattgcagaaacccacgcatctgaagttaccctctcacaaattagtgataaattaggtatcacacacgcagccttgtataagcactttaaaagtaagcagcaactttgggaagcagttgctgacaattggtttaataaaaatattctggaccaaatcaatattgacatttccaactaccacgaccaacgccaattgttacacgattggttatgggaattcgcaaatgcaaagaaaaaagcatataatgacgatccacaaatgttcgcattaaacacacggtacgtggatagccaaccactggttttacaaaatgttctctggagttcctacaaaatcatcgatcaattcatgagttatcacgatacaaattatgaacgggctgaagctattttatccgcttttaccgtgttcaatttgcctacatttgcggccacttggaatttaccaaactatcatgaaagatttgaacaactttggcaattgattgaacatggagtttaaccagttaccatcaaaaaagagtatccaaccaggcaaaacctgattgatactctttttgcataacatgttcaattaaaaataaataaattcttgattatttgtaatgaaacaacctatttttttaggtttatcaagctttcccggattgccgttcccagcaactgtatcaaaaacatctgcttaagattaatattaattaattacttagccatcataaaaaactaatccgcaaatccaaaagcccgtaaataacaatcacacataaattacgtcacgggagtttaatgtaaactttaagtgacactaagtcacacctaaactcgatcaaccacccggtcttcacttgcgttcacgatattcagcaggtgtcatcccataaatttgcttaaagttacgataaaaatgactaatatctgtatagccaacctgatcaacaatttcttcaatgctgatatccgaactgactaaaagcctggcagcctcccgcattttcaaatcccgcaacaaggaagaaaaggagaacccagtttcacgtttaatatatcgacttaaatatccttcactcaactgaaaatgctgagccaccatacttaaattgacgcttgctcgattgttgcgaatatactgaataatatttgaaatatacttttcattgcttttaccagtcagcatcttggcattctcggaatgattacggataagttggccaaataacaacaatacgtaactattcaaaataattctggaaccgtgctgggatgtttgagattcctgatataactttataatcaaatcttcaatttcagcatctccatcacaacgaaacaaaacaatttgagcaaatttcttctgataaagcatctgcaaaaagaattctgaaatatcactttgttccattaataaaggcgaaaatgcatcctgaaacgatgaccgtcgcatgatgatattgaccacaatatcatcatcactattagcgaaaaacgcttgctcaatgtctggcccaacaataatgagatccccttgaatcaagtgatagactttatcattcaaaaaaaactgacaattgccctgaagaacatatgaaaccttcacaaactctaaagtgtgatacataatcggcaaataacgtaaatgcttaaatacaacgatttctgaattcaaatgtggtgggtaaattagcttcccatcagaatgcaagttgtattgctcattctgcgatgaactggcagtaaaaaattgattttcgtaaaaccgagatcgaatatcagaaggcgattgatccggcaatgcaattgagaccttcattttagcttgatattgcttaacaaacgcctgccagctcgccactggatcaaagtgatcgtaaggattcgccaaatataatcttttatactcaatttcagctggttccaaatcggttaatgagtgattcaattttctggtcatgcgactcctcctcttgtccaattaactaccaaaaaatcgaactaagactaatggggttaagtcttaatccgatcctcaataatgatttttgaaaacacagaatcatcaattgctttacataaagaaccaaaggtcagcggccgttcataattgatctgtcaaatcatagtcaataattcactaaagtttaattatttaggccacaaatttgattaaattcaattttttaaacagatttgtacgcaacttgttaaaacttcaggtcgctttccaatgctggttccggttgtcttcctgtttgatgtcagaaatcaaacacacctatattttcagtaattttatgattggtaattaaaggtctcgttatgaacgccatcagttagaattattgtatcatatccaggaatatccaattgggctgaagtgccataaggaaccgttaccctaattgacagttcaccattttcaagtgaccattgtacagctgctttcccatatggagtggtatgagccgccttggccgatgttaatttgccacctggtcttggtgcaaccctgaattgatgccaccccggagtaagtggcgttaaaccaccaatggttgcatgcatccaatcagccaccgatccaagtgaatagtgattaaaggatgtcatcacgccagggttaacagacttgtcaggcaacatggaatcccaacgctcccaagtcgtggtccctcccattttaacttgatacatccaacttggatttttgtcagataagaatagtgaatatgcttcctgcatgtgcccagtttcagttagggccggtaaaatgtatggcgtcccagcaaaaccagtactaaccttaccatgtgaacggcgaactaatagtgctaaccgatggccggcaaattctttcaattcagggtcatcatctaccaagccaaatgtaattgcaagcgcgtaggcacattgtgtatctgacgtcataatccctttatcgttaaagaagcgatgttggaacccaatccgaacgtgacgggctaacttggcgtatttgttttcagtatcttcatcgtgtaactcatgagcaatttgtacaaacaaatcacagctcttcgcataaaacgcggtcgcaaccaaatttttagccgtcattgctttaaccggatcatccgcaggagctgacggatccaaccaatcaccaagttgaccaagaagataaggtggccgacgatcccatacaccgtcatccgaaagatagccttttacttcatcaatccatgcccttgctgctgggaattgttttgccaataactgcttatcgccacttgccatataaataaaccaaggtacccgaactgctgaatctccccaaatggcaatggcttggggttcagtccattcagcaaatggaataaacggtacgtagaatggtactgttccaagtcgcttttgttcgtgagcaacatcttgcaaccaactgcttaagaagccttcaacatcgtaaaagtatgccgctgttggactgaatagtgagatatcacctgtccaccccaatcgttcgtcccgttgtggacaatcggttggtaacgaaacaaagttagaccgcattgaccaaagggcattgtcattcaaacggttaacccgttgattagaactttcaaaccaccccgtttgttccatatccgaaaagtaaacgcggtcttgcaaatcatcagcggtcaactcaccacgccaaccacgaatctctgcatatcgaaaaccgtgtgttgcaaatttggcttcaaaataagcctgcttgccattagacgtgtaacggtcaatttgttggccccttcgtaatggccgggtagataatcgaccatctttttcaagaacttcagcgtgttgtaactcaatcacatcaccatcttttgcgtttgtaatgtgcaacttaattctttgagtacagttctggccaaaatcaatttgccaattggtcttgccatttttttcactaatctttttaatcgaaaccggcttattttctagattagctcgaaccggtggtaagatcggaaattccatcttacgtttgtcatagggaatttctgcaaccggtgaccagtttgaatcgtcaaatcctggtttgtcccaacctagttgttccaagtgtgcatcgtagctttcaccttcacacatatcagattgtgtaattggtcccttgactgctttccattgattatcatcggaattggaaacaatctcgtcagtggtgccatcggcatacacaatttcaagttgcgcgtaaacaccaattttatcgccgtaaacatttaccttaccgcctttaaatccaagacggccacgataccatccgtcaccaagataaaaaccaagggcatttttgccggctgtcagggtggaagttaaatcgtaagtccaacattctaaccgatcatcatagcaggtccaaccaggcgtcaaaatatctttaccaattttctgtccgttaacgtttccttcaaccaatcctaaggcagataaataaagtcgcgcatatactggttgatctttcaaactaaattccgttcgaacgagtggtaaatgccgatgatcacttctaccttcaaaccacgttggacccacaaacttaccgagcaggtcccaatactcaagaatgccaacctcaaatttaagaggttccgaccaatcgaaattaccctcgtcaccagttaagcggacccgcactttaacctgttcacgggaatttaacggttgatcaagcggccagggtaataagacgttattaaccggctcagttttaaccgtttcaacagtttttgattgacctggcatatgatgtgaaatttccaactccacctgctcggagtcagtaatatgatcaggatatttccatgacaatcttggcttattcgtccgaattgccaatgggttaccatgataatgttcaacttgtaaatcatatggtgcctcaatttttacatcttccattagactttgatacgctccttataaataaatttttgaacaattaatcactaacaccgtacttacgttgaagacgaatcataattgtgcctgcaataaagctaacaacgactacccccgcaaagcaccacattgtaatttgaataacacctggtaataccaaggcaggtgttataaatgcaaacaaggcacacacaatccgtgaggttccattaataatcccctgaatggtcgatcgaacctcaatcggaaatgactcctgtgtccaaaccttgtagagcgcttcaccggccattggactacctaagttgtagaaaccaattgcggcaataattgcgattaaattaccaccgccaagggtcattccgaccattgcgaagaacatgatcactgaaccaatcacgaagccgacgtttcgatacttactaccggcaactgaagaaaataggacactaaccaacaatgcaatcacgttaagaacaattccggcaccagttgccaaactttgtgatgcatcagctttaaccatcataaatgtctgaaattgaccccaagtattcgccaacaggttccaaccaatatagaaaatcaagatggcaacaaagaagctaagaaatttcttcttatttgacccaaatagaaccgacataactgaaattttttcggttgcagcagccgttcccttctcttcctcggcatacctggcatctgcttcatcatgcagctttttgaatcgtcctgaaaatgttcgccataaccaagtgataaccgcaaaggcggtcaagattccaaaaacgatccgagcaccagttgccccagccattttggaaaccaagaaagaacaaatatatgaaataaagattcctgcctgccaaaaaatttgagttgatgaaactagtttggcctgcatttgccgatccggcgtatcatgcgaaacgaccgtcaatgaaatggggaggtcagccccagacgcgaccccggtaatgataattccaattaataaaatcataaaatcaggagcaaacacacaaactcctgcaccaattgcataaaacaaattaatccagttaaaaactttaatcaggccaattgattcggcaactttaccaccaaataacgaaccaaaggcaatcgcaaaagttaacgcaccggaaataattccaacctgaccattagtaagatttaatccgttctgccaaactgaaatggtcgcggccaacccaacaatgatccctgatccgagcatcgagccaataccggcagcataggccagtggccgataataatgaatatctttttccataatttttagttctccttactatttaaagacgttgattttcttttttgacagttaattttcgtggattataaaccggatccggaatttgatgatgcgcgataaatcgcataatcaattctgcagaaagccagcataacaccaatgaaccaaccaataaccaaatcaataattctggtgaatatgccataataactggtgtaataaatgaaaaaattgctgtaacagctcgcacaaccgcatacgtgattccagtaacactcgcccgaacatgaactggataaagtgattgactccaaatcttataaagtggttcgccatgaagcatatttgccatgcagtaaacaaaataagaaatggtgaatatcagccacatcccaccataaattgctgaaagaataaacgatccgatgcaaagtaccaacccaatccgggtcataacataccgatacttggtatcagctaatttcatgtaaataccatatagaacaaaagctcccaagatatttgcgaagaaagccgataatgttgaaaactgctgacttcgaccgtcaatggtcactaaaaagtagtttaaaaatgatccccaggtatttgccgggatgttccagaacaggtagaaaccagttaacccaatcattggcacgaagtaacgtggcagtctcattaattttctgaaggggattttttgagcgtcctgttcttctttggttacacccacgctatccgattgaatgaccatctccctttccattttgtgaaatttgggtgacaaagcccggactgcccatgtcgaaaaggcaactaagaataaccaaaagaacaagatttgggtacttctatatcccaaatcagcggtcaaaaatcccaacccctgggaaagtacgattcccgcaagccaaaagatctcggttgaagcaatgactttaccataccggttagcttcagttctctcagatataacagccaatgacgttggcaaatctgctccggatgcaacaccggcaatgaataagcctgcaatcaacatcggcaagttgactgagaaagcaacaattaacgttcccaatgcaacaaacaaaatatcaagattgaacacctttacccggccaaaccgatcggataagtagccgccaattaatgagcctagagcaaccgataatgtaacaattgtgctgatcgcaccaacccaccacgcattgaagccgaagtgcgttttccagagggctaagacaattccagttgttaccagtaaacttgcatcaagataagacgcaatactggcattcatcgtcaacatccactcggattttgaccgtgacttcataaatttctcctcctttttaaattcaaaaccgtcatgacaatttgtgataccgttttcgtaagcgtttacagttacaagaataactttcaattcccagtccaacaatgtttcatgtggttggttttttatgacctttacacgaaactctgtagaaaatcgttaacaaccagagacataataaggattcttgatgtttactatcaatactgattttcacgaaaacactggcaatttgagcgcaaaaaagtgagacaaatggcgattaacttccagaaataatttggtggctgtggctgcacgacaggaagttgccttttgtctcacatttttgatttgtaataagcgtgattacacaaaaacagggctggacaaaatcacttttgcctcagtcctttactgacttaatttatgacgaataattcatcgcactttatgtgatgggatcacatgatcatagctattttgaacaaattacctttttttctgtcggtccccaactgcatgaataatgccccgctgaaccaaatactcatccttacgcctggcaataaacagcggtgttgattcttcgacaacgttactaaattcaagaccgtaccacttgacgggtgaagccgtgatgttctgcagataaatccgcccaccaattaatcgtttgtcgagggcttttaattgatcgctcacgaccaggtcagccggctgttcgttaataataacaaacttaaacccgcccacttttcgattcttcatggttgagtattttggcacttgtggttcaagtaccccttgttcaacaagattatccacaatttgatgcaaataaacaccaacgctctgctcttttcgaaaacccagataaagctgcacattgacaatgttcttagtgcccagcatatcaaccgtatagttactttcgtatggcacgttggtttcgttaaccgttacgaaccagtagactttggcccgcttgggatctttatccaaaattgaatacattgtatttcgtttgatgtgatagttacccttaatcttagtcatataaaccagattggttgtaaacaacgggatctgctcatcagcactcagttccgcgagctgatcgcgatagtccaataatgacacatactcacttgcccgctcatagtgttcgcgacgcttattgccaaagtaccaaacccacatcacatataagattgccaacataatcaaaagggttaaataaccgccgtgaataaacttcaccaaactggcaactagaaaaattatctcgatggcaccaaagaaggtggcaatggttaatgccagcggtcggttcaatttggtcgtcaagaactcagataagaggacggttgtcatcaacatcgttaccgtgatcgctaatccataagctgcttccatgtgttgcgagctttgaaagtaccagacaacgcccaacgtgaccgcacataagatccaattgacattggcaatatagatttgatttttgacattgctgggatgcttgacaaccaaccgtggcaaaaatttaaggccaatcgcttcatcaaccagcgtgtatgatccggtaatcagggcttgggaagcaataattgcagccaaagttgccacaacaattccaaataatcgccagtgaccaggcaacatttcataaaatggattaatatcagacatccgtttgaaagtgtcatcctgagcgtgattaatcacccaggcaccttggcctaaataatttaaaaataatgcaccataaaccagtggccaggttgcgtaaatattctttcggccaacgtggcccatgtcagagtatagtgcctcagcaccagttgttgccaggaaaacactcccaagaataaagatgccaactttattaaccggactaactaacagttcaatcgcatagtacggtgataacgctttaagaaccgccgggtaatgcaataaattgatcaccccaacgaccgctaagaagccaaaccaaagaaccattaccggcccaaatgatttcccaatcgtgcccgttccaaaccgttgaatcatgaataatcccagcaaaaccgccgttgtaatgagcaaaacgtcaaattgagaattactaaacgcaactgatccaaatttttgattttttaaaccttcaattgcggaagtgaccgtcacagccggcgtcaaagtcccgtcagctaataaggcagctccaccgattaaagccgggaagattagccatttcgcgtgttttcgaactaacgcatataaggcaaagatgccgccttcatggttgttgtcagccttcatcgcaattaacacatatttaaaggtggtcacaatcatcagtgtccaaaaaataagtgaaattgacccaataatgtaatccgcggatgtctgccccattgttccggcatccccaatgatcgcattcattacatacaatggcgacgtcccaatatcgccatacacaatccccaatgtcaccaacatccccgccagagaaatcttttccagcttcttgtccattgtggcaatcctccaagaatataaatttaatttgaacaagctttaatgttagtcggtttcataagaaatgcaacactgaatttaactaatttagcctttgacggtcatttagattaataaacaattgccaacaaaaaataaaaggccagaacaaaatcattcttgttccagcttagaaatcacttatcgcttggtattgaacaaatggattctcataaaagatacagtcgccgattacgttgataatacagcccaattgccaacaaagtcgttaccacttcagtcaccggaaacgtgtaccagaaatagcgtaatccaaagaattggaacacccaggccagtggaaccagcaaaaacagctctctggttaaactcacccaaatactcttggccaactgattagtggcttgaaaataaaccaccaacatcattgagacccctgccggaataaaactgctgccgatgactcgaaaagcttcaacgccgatgcttaagagcgacggttgatttgaatagatcattagcagattccgcggcagtcccataaaaatgattgcaccaaaaatggtaaccagccccgccactagtaacgccagtcggacgacttccttaattcttcgcaactgcttagcgccaaaattatagctgacaattggcaggatcacctgttgaaggccttccaatggaataaagaaaaacgcctggagtcggtaatagattcccaacacattaatcgccgtgctgccaaatctctttaaaattaaattcagcccgacaatataaacggtatacaaagattgaagcaaaatcgacgcgctcccctgccgataaatggcaacacaggtttgaaatcggacctgaccagtgaatgactgccatttgtgaacttgaaaagccacgatgaccagcgccacaaattggccaataatcgtggctaatgctgaccccctaatcccgagcctagggattccccaaccgccaaaaatcaaaagcgggttcaaaacaatatttagtaaattaccaacaatctgagccaccatcggaccgaccattctacccttcgcttgcagcattttagttaaattggcttcaataaataaactgaaagcgaacagaaaaatgatcatggcataattaactcccattcgctgaaccagctgattattggtcgataactcataatacgattttacgaacaacagtcccaggactccaaagccaacataattagccccaccaagaaacaaaccactcttggcaacgtttgccgaggtatcaaatctttcgccaccatccaacctggcaagcaaaatgttaatgccaacgccggttcctgtggcgattgccatcatcaataactgaacgggataaataatggctaacgctgttaaggcagccgatgaatattgggtgacaaaatagctgtcaactacgttataaattgactgagccaacaacgaaatcatcacaggcggcgccattcgcaacatgagggtcggaactggcaagtcttttaaacatgtttggttttgcaaaaacattgccacttcacccactttccattgacaaccctcatttccaccgcagttattgaatgaccttcttatttggatccaaccaattaatgaccaatacgataatcagcatgacaaccacacttagaaaaaccgcgtgtaatgctgacaaaatgatgggatcaatggccgcccgattggcaacaactgtagcctgttttgaactgatgacgctattcaccttggcaaacgtcatcccaccatgaagctgcaatcggatgactaaatttaaaattgcgccgtaaacacctgccattaccgtttggcctaatgaacgccctaacgttaacacagacgtcgctgatccgaccatggctgccggtaccaagtgctgactgaggataatattcatactaataacgatccccatcccagtaccgttgaccatcgcgatcacatagaaggcccagaccggaaatgttttcccggcaaataacaaccccagatagcccaacaatagcacgataatcagtgaaattgaaattcgttttgggacaaatttagcaattaatgtgccaacaaaaaatgacgcgatcagccacatcacagagcttgatgtgacgaccagacccgctttggtagctgaaacccgataaagggattgcaaccaaatagggaagtaaacctggtaaccaatcagtacgccactcaaaattgtcgccgtcaaaatttggatactgaaggttggcgaccgaaacatcttcggtgacattaacggattttcaaatcgaccttcttgacgaatcaacagaattaaactaatagcggcaatgataaccaatccaagagcgagccaaggttgcgtatccagcatttgaatcgcgattaataaacttacgagacaaaccgccagccaagtaatccccagtcgatcaatcaccagcttctttttaagctgaattttttcgtgatatcctaactgaattagaaccatcacaataagtcctaacggcacgttcacaaagaaaacccaatgccacgataattgatcaaccaaaaagccgccgataagcggtccaaccagtgctgataagccccaagccgtattattcaaagctaaaacattagcccgttccttaaaactaaagatatcggcaataatgataaacgttagcggcatgaccgccccagcaccaattccctgcagcgcacgcgccagaatcaagatcaaaatggatggcgaaagaccacttaaaaacgatcctaatgtaaaaataatcacgccccattgaaaaatcacccgtcgacccatcgtatcggctaatttgccatagatgggcgtagtaatcgcggtcgtgagtaaatacgcactcataatccaactttgaaatgccaacccgtggagctcactgataatagatggcaaagctgtcgtgacaatcgtgacttccacggatgtcataaatgtcgcaataaaaaccgccgtcataataatccagcggttgttctgggacttatgtaactcttgtgatgccatgttcgaagtcatcccctcattcaattttatattcctgtttttatgatatcatcagtcggcaatcaatcctgcagttaaatttccactttagttaagttgaaatggcgcaagttcatctgaaaactggctaaccagtttcgccgtatatcgtttagattctggcgaacgtttgacgtgttgccatagaattgaagcaacttttagcttgtcgtggtattgccgactctcgggactctgacaaaaatcagtcacaaaatgattccactgataagtctgctcttccggattgctttcactaaccttagtcttcccattctgggcgagttgctggattaaatcaccaacagtcatggccgtatcgttttcggcttccgcccgccgtttgatgacggccatttcctttttaaatgaaaaatgagtgacaccaaagtaatttgcaaaccactttctggcttcattattaaatgaaaagcctgatccaactaatttggtttcgagatgaatttggtcaactgaaagcggcgagtgtttcttgaccacccgggctggttgaatcatttgacccggaactcctgataaataaagtcgcagatagtgattcaattctgccttggttccttgagtgggcaaatggtattgacgacaaagcctgatcaagtccgttttatagtagtagcgtcgttcaaattcctgtttagttagctgtgacatgcggatccacctttcaatcggactctctatttgttgtatactgttgattatacgcaaaatcaactaaacaagggagcccctcacatgctttttacttacgaccaagcacagccaactgacctaaacgaaattatgatcattgaacacagtggtttttcagccgacgaagccgccacaaccgaagcaatgcgcgatcgcattcgactttatccggatacctttattgttgccagaacagctaccggccatattgccggctatattgtcggtccaacatttgaccaacgttatttaaccgatgacctttacgcgaaatcaacggccaacaatccggatgacccttaccaaaccgtcttaagtttagtcgtttctcccgattatcgccgtcacggcttgggtggtcaattactcgaccagctcgccaagatcgctcgtctgcaaaatcgccaggcagttacgctaacctgtttgaaaaaacgagtccctttttatgaacaccacggctatcaaaacgaaggcgtttcggcgtcggatcatgctggtgagatttggtataacatggtattaacattaaataacaaccggtcctaaaacccttggccgccggcagcaactcaattttgagcaaataaaagagccaatcaaaccgattaataaacatttttactaatcaatttgattggcttttttatttgctcatccgtttagctcttttacaaaccaatcttaactttgaagacagtttcgactaatcaactactaaataaaagattgccaacgaaatcatcgacaataggacctgcagaccaactgcccatgccttggcaataaaatatccttctttgcctgattgaaatcttaaattcaaaaaatgctcaatcgtcaatgaagtcaccagattccacacaacgaaaatgctggcctcagccggatgtggtaactgtgaaatcatgctcatcactgccaaagctgtaaacgtcattgagatattatgacggtcaaaaaaatccaatgtgactactttattcaaagttaccatcacctttcaaatttaacactattttaaaactttttaattatttttcaaccccacacatcaattttgaccgatacgctgtctcaaatctacctcaccatctttcatccggataacactttcaacagatcatctcgtcaatttcattcttgatcaaaagcacgcacagccattttatattttgcatgcgctttcgcttgaaggctattttgcatgatgctattatcttggtgtaataattttgattagttcttggaggaaatttatcatgaaaaagaatcggctcattaccgcaatcgttgcggccatgctgcttgcaccggcaattccaattgccgaagctgccgcaccttctcaactcagcacgatcacaaccgcagctgctgccaaaacaaaagttgcatcaaaggcaagagtcgtttcggcaatcaatcggaccgctgacttaaatcccaccggagctgtgatgacctttaaccaaccaacttatgaagcttatggtgccttatttgataaacagtataacgttggtgcaatgagttcctggaaagtttttggtaaacacaaccgtgcttacgtttatactaattcaagtgcgttacagcgctatgttaccggtgccattaaaaattggaatcgggcccttggccaaaaagcttttgttcaaggtaccaaagcccatcacacgattaccatccaatggcaatataatggtgccagcctagattgggatggcttatacgcgaatggtaagctcaaaatcaacaagtcgctgtatgatgatccaacttacgtgccacaatcttatgaagccgaaaataagaccaccatgccaggtgctaatgatccaaactcagcggcttatcaacagcaagccagcaagtactggacagccattaccacccacgaattaggccacagtttgggattggaccattcaccatatacatcagacattatgtatactgattcggaaacggcgggcagcacaatcaaatacggttggcagcaagggaagaataccggtagtttcgctgagtttacaaacaccgtttcacaacgtgatatcaaccgagcaaaactggcggaaaaccttgggtactggtaaacgatgaacggatccaaatgaactggatcttagaccgcccacaaccttgatcatctaaaataggcaccacatttcagcaaaaatcaaggggctgggacaatagtcgttttgcccagtctctgtttgtataatcatgattattaccgtgcggaaacgtgagatgaaaggcaacttccagagtataaccaaattatcccaatattcaagcccggaatactgggataattcagttgtactctggaagttaaccgccttttatcccactctgttgatttttcttttactcgacttcaaaaaatatatggcaattcctcacaaccccacaaatccattaaagtgtttgtaactgacgtttatatcgactaataagttcacaactttccaaatatcaaataatctatgctttcaattattgatgtcttttgaccgcattaaccccggccgatcatctaccggcaaccatccatcacaaaggggcatttaaatagagttggaagtcatttaagccaataaatgcttgaatgtaataattcccctcatttttactgacagcattgacctcatttaaaaactccctcctctaattcttggtaaaacctgaccgcaaatgctattcttaaagtaattggatagactggatcgttataaatagggggattgttatgcaaatcgatatttccgaaatgtatttcctattaactgaaactaatgacaatggtagtgccattatgcgaaatatgaggaaacgggcttatttaacggttagttcgctttttgatctccagttgagtaacgttattgtccgacatgacaagacacttatcgttaatcagccgctcccaaccgatttcagctttttcaatgtcatagctgaagtcgttgaagaccgccgtggcaagtcctttaaacatattttacgacacttggtattaaatcgtaaaattaatcgaaccatctatgaagggatcggccaacagctactattccaaaacaaagcgactcaaacgatggctcacggtttgttacggcgacacatctcctttagccctaagcagccggcggttgactccgtgatcactgaaattcatcatgaactattagcaagtcattcccatccttccctgaaaattgtcgcgttggttgccctgttaaatcgaagtcacgttctccgcaatcatttcagcaaatctgaacaagcacaactcacgaagcgactgaaacaattgcagcagcaatccgagtacaccgaattctttgagtttgctaaatggattgacgactttattaccgcaatgattgtagctgcttcatcaagtcacggttaaagcatgttaaccataatcatgatacaagagggttcggcaagtgaaaataaaacgattatttaaatggttgattggatttttaggaatcgcaatcttcattattggcagttatgcaatttacatttttgccgcttattatcggctcccagattacatcaccctaaatccaaacaataaccaaccggtcaagctccaacctcaccgccaatataccgcgatgacttacaacatcggttatggggcctatccgccaaagtacagtttttttatggacggtggcaagtattcactggcatttagccaccacgctgttgaaaaaaatatggccgggatcatcaaaacaactaatcgtgtagcacctgatttagctttcttccaagaaattgacgtcaacggcgatcgttcccggcatgtcaacgaagttaggcaactcaccaagcagacacccgaatatagttccctgtatggtcaaaattacgattcgccctatctgttttatccgatcacagaaccgattggccgggcgaaatccggtttactaaccttagttaaggcccacattaatactgcgacccgctactcgctgccaattgataagggaatcagtaaactaaccgatcttgaccgggctttcaccgcagctcaagtgccggttaacaatggtaaaaccttgacaatcatcaatattcacatgtcggcttacacgaaaaataaagcaactcagcgagcccaattccaaaaattattcaactatctcgagcaaaagtaccgccaaggcaactacgtcatggtagccggtgactataatcacactattttaaaaaaacagcaatcgcatttttaaagatggcagtcaaaagctaacttggacacatccctttcctgatcaacaactacctaagggattttacagaccaacccagggattgaaacaagccgcggttccttctgtcagaaatttgaacactgcctatcatccccaccactcgtttgtgaccatgattgatggctacatattatcaaaaaatattaaggcaattaaaatcaaagttgtaaatacccactttaaggattcagatcataatccggttcttttaaggttttcgttaaaatagcattgtgccatcgcttaaatttcagtggtaacgattaaagattaccaattttcttgtattcacggttgggcgatgctatgataatggtcaattcttttaccctagagttctttagtcacgtggaggttctcatgaaaaaaattaagttgatgactgttgccctggcagcaatgattcttgcacccgcattttcagttactggtatcgtcacacctacatcaacaattactgcaaacgctgcttcacaatcaactgtgatttctaagattaagcaaacacctgatttaaatccaacggcaagtgtcagacactttaccaaagggacctatcaagctaaccaagcgatctttgataaacagtataacgttgaaaaaatgagtatcaacagcgtttttaacaatcatcatgccacaatttataccaactcgagcatcttgaagggctacgttgctgcttcaatcaagacttggaataatgcccttggctcaaatgtcttttccgttggcaccaagactaatcacaccattcttgttcgctttggctccggtggcaccaacgcaagcgattgggatggactctacaaatcaaatactttagccgttaaccgaaaacatttcaatagtcccagctatatgctgacagtcctgcgggcgatcaccggtaaaaacgtccaggcaccacaaacagatagtgaaaaagccgcgtttgaaaaagactacttcggtttttgggaagcgaccatcacgcacgaactgggccacagtttaggccttgaccacacaccctacatgaacgatattatgtttgcccagaatggctcagcttcttctgacgcaaagtatggctggcaaacggggaaaaatggcaatggcacctttgccggattaaccaatgtcttatcaaatcgtgacgttaaccgagctaagctaacgaaactgcttggatactggtaaaaagcagagtggcacaccaaaccggttggcgttatttatattctgggagctgcttactgtgccacgtttcagctaaataaaaggctcaacaagatatcacgggtttgaatatttggataattcgatgacacggccggaagcagtttcttatccccatctcagctgaatagcaacattcagaaagtaacgcgggggagacaaaattcatttttgtctcccccgcgttactttagaataacaaccagttttaaataacactcgatcattcaatcatctatttgatcctgtctcaccattgaacttgttaaacaatttatcgaaattaattgttcctaatccagttgcttgattatacaatttacccggttggccggtgtagtacaaattactgttattgtccgcatcatccaacacattaaatggtgtatccggttcagccgcaaacttatagatctgtgggttccaaaaaccaattcgagtctggcgaccgctattcatcacagcatttgcagcagccatttgtggtgccgtatagctggtacccccactgaccatccaaattttagaaggagttcgaataattgatttctttttggcatccacagatagttgatcgccggagaaataggttgcgtagccggtttgactatccgcattaccggaaacatccggcaggtttcgggagttgccggtcccaaagataacacgaggctgcttattaatgaccatttttccctttgaatacttcaatgaatcaactgctctaaacgtgttaacacccgggaatccttgctgataacgaggtgtcggattaagggctgagaaaccgccaccactacccggaaaaatgccttgtttaatctcagtggccgaagcggtatacgtatcaccccaagcccgttccttgttaacagtaaccagtttgttcttaataattttctgataaggcagcgttgttccacccacaataacttgatagggagacgttgaaaccggatgattttcacgtttggccgccatttcccgtggcccataatcaccactggccctaaacacagtaattccctgagcagcagcctgttccaaaaggagattaaaggcatgattatactgtttaagtgacgcactatgatcattccaatgacttgtcagctcaacagatggcgaaaaactcgtggaaatttgctgatcctgattactggagattgcctgggcaaacgttgcaaacgaagcagctggtgaagtggtggcatcatttacagaattgccaacgtaaaaatcaatatcagcgtttggagcaacggcactggccgactggacatctagtgacgcctccatttgataaggtgataacgccttcttcatgttgtccatggatgtcttggcattatcaatcgtataaatcttatgaatctgacttaacgaactgttcacgccggtttgctgccaatacttttgtaaatcactcattttaaaatcaccggtagaaataatgccaattcgttgacctttaccggatagcccctggttatacaactgatttaattgatattgcttagcaaatttaccggcaccatatttgttagaaaattgattgtccgaaagggtcgtgtccggctttgatacatcggttggtaagccggcgctggttatcacatgtttcttagcagctgcctttttagcaacctttttcttagttgttggcttcttggacactggtttttcagcgtaaaccccaatgaccgcaacaacttgattggatagtttacctggcagcttgtattgtgtccgggattctcgtcccttttctttgatatatttagcattaaacgctctgttcatatcaacgcgatgccctttaacttttaaagccaaattaccggaaaaggtcgttgcttgtagatgatattttgccaaatactgtttaaacgaatcgatgtaactattggactgaccaaactttgccgcgaattgatcgggtgttaaatactgatgataatcggcagcagttgggtcgacagtgtcgtaaacataattcgtgagatcagactcactggttggtttaaaaacaacgtttgcaacggttgtccgattatcaacctttttgacttttgatttagcgttaacggtgccactggcccccaagaccaataggccacttaacgcggcaatgatgacttgctttgccctcatattaatcccatccttcaaattaatttaaaaaatcagctgctttaattataacaagtcactcgaagaatcccactatcagtaacctgtaaattttaattgatggggacctgacttcttaccttataatcaggcaccaaatatgaattattgccatcgccgcttcgataacgggtgacgattcaaattcaggtccattgcaattaaataaagcgttgcaactgccaaaacagtcccaaagattacaacaatgccaacccaaggactactgctcgaagctgggctaaccgaaataccagattgccaatcgatcagaaagtgaattaagactacccaggtcagggtgttggtagctactcgaacagcggcaaataggacccccaaacaaaacgcgtaggttgcctgctggagggtcgcctcaatgccttgaccgccaattaaattgacaaaatgcagtaggccaaacgctgcggctgaaaaaatcgccgataaggtcatttgcaacttggcgttcttacataactcctcaaatacagaaaataagaggcctcgacaaataaattcctcaaagattgccgctgacaacgccattagcgtatctgaaataatggttggtgagtgaaagacctgactaatttgataaggaattcccatgataaaaaataacagaatcagcgtcacagaaacgataatcatcatagtcactataaatgaagtttgtttaaatttctgccgcctgactttcagggtattaagcgcgtggtaaataattccggctaccaatattgcataaccggcccgaacaattgaccgggttgttaagcccagcggccggagaaaaatatccagcgcgaataacaataacaccatgaccaacgcgccgaatagctgctgcggccatgtccaacgttttttaaccatcctttgtcacctcggttaacatgatgtacaacatctaacagtagcacttcgtccctttatgaacaattaaagagatggctatcatgatccccgatccaatccaaaattaatggcgatcctctttttgaaaagattggcataatcgtcatttttccaaccgcttcttgtatcatcacaattattccctggtgaaagcatcgggggaaggacaaatcccggccgtgccatcattttctgctaacgtttcaaaattgcgagataccagcattcgtgctaaattaagttaacgtcaaattgaccagaatagaaaagaggcagattaacaatgaaaattgttctgttggatggccttgccttgaacgatgatttaaattgggactcgttaaaagagctgggagagtgtcgactctatgaccgaacaccggttgacgacaaccacgaaatcatcaatcgaatcagccacacaccaattgtattaacccataaaacaccgattaacgcggaagtgattcacaacagcccgcaattaaagtacatcggtattatgggtaccggatacgatgtcgttgatgtcaaagctgctaaagaagccggtataacggtcacaacggtgccaacctatgccagcgatgcggtggctcagtttaccttcgcattgctgttggaagtaactaaccacgtcataagctatcaaaatggatcattaaataatcagctaaccgactttaaaggtagtccactcacggtgttaaggggtaaaacttttggtttaatcggttatggcgccattgcccaaagggtcgcccaaattgcccacgctttttcgatgaccgtcatcttttataaccatcgaccaaaaaccgttcatgagaagtggctccagcaggtaagtcttgatgagctattgacaagatcagacgtgatcagtttgcatgtcattcaaacaccgcaaacaattaatttgattaaccagacaacaatcaacctcatgaaatcaaacgttatcttattaaatacagcgcgaggaaagctaatcaatgaagccgatctcgccgccgcgttaaacagtggcagagtcggtgcagcggcattggatgttgtcagttcggaaccgattaaatctgataatccgttattaactgccaccaattgcatgatcacaccacacattgcttgggcatcccaagaaaccagagccagactattagcgatttcagttgataacctaaaagaattcttagctggtcgacagcaaaatattattacttacaaataatttttcctgtgacatacaatagtcgagacaatcagattacccgaatattttagccttaaatgtttgggtgattcggttacactgcaggaagttgccttttgcgcatgtttccactcggtaataatcgtgattataaaaaacggggctgggacaaaagtaatttttataagaaagtaacctaaaaaaggacatactaacctaacggtagtcaaataccgaaaaaattagtataatttagttaggtaaagtattttattgaccaacgagcgctttcgctcgttggtctt

SEQ ID NO: 677 - DNA, 94037 bp, Unknown
  Metagenome-assembled genome
agacgcatcttggactacgccacgcccgccaagatctttagttcctatgatactttatatgattagacacctagaccactactaaacctgaggtcaaaagtgttgcacttgatttgacaattcgggagcattatttttcctttaagtcagtgaattttccgtgaaccaaatcagccagttgttgggagtcaactttcacagaacgcccaatttgaccggatgaaacaatcacggtgcccatatcctgggcttcctgatcaatataaatgggatatttaaacttttcgtaaatcccaactggcgtgtttgcgccatgttcatagccggttgtcttaaggagatcttttaatggaaccatcgtgacttttttattaccggacgcttttgccagcttcttttcgtcaagatgttcatcaacgggaagcactcccacaacgggaccggtagttttaccagttaagaccaacgttttaaagattttgtgttcatcagtatcaacgtgatcaacgctaatttgtgcgacatcaccttcttgatgggtcggaaaagtcatctgttcgaatgggatgttgtgcttgtccagaatctgttcaactaatgttttatgaacttttttatgtttcttttttgccatatttaccacacctcacggacattttatcacaatggctcaaacatttctgtctgaatcgggcggaaatatctgttatactttattgttaataatgcatctttttgcaaatggacgatttaattaaggagcgggcatgacggatttagtttatcgtaacatcattaaagacttgaaggaccggattcaagacaacgagtttgaatctaaaaagctacccgatgagcgtagtcttagtgactcatatggtgttagtcgcagttcaatcaaacgggcgctaaatgtcttggcgaaccagggcattatttttaaaaaacggggatcgggaacgttcatcaacccgctatatcaaaaaaatcaaacaatttttcaatacgaaggttcaaatttaggggttactgacagctttaagagtgacggaaagacgccacagattaagttgttggattttgatgtgattccagccaccaaagaacttcaaacagaactatttttggatcccggtgaatttgtttatcggattaagcggttacgttcatttgaaaataaaccgtttatgattgaaatgggttatattccgattcgggttgcgcccgagcttaatcaagaaattgtgactggttcaattttcaattatattgaagatgcaaagggaaagtcagttaccaagtcgttcatgacaattactgccaatccgtcaactaatgaggacaaaaagctgctgggattaaaacccgtcgagccggtaggagtcatggaaggcattttctttttagatgatggaacgccgtttgaagtatctaatatgcggattcattatcaatacctcaattacaatacctttgtggaccttgatggaaaccaataatgatttgaattcaatattgtctcacgtttttgcccggtaataatcatgtttgaattaactgagtggctgggacataagtcgataaaatagttttaaaaaaatcccgtaaaatcagcgtttttgtgaactgatttacgggattttcactttgaagttaaaacgccataatataaatttggactattgtcacagccgctctcttggcatcatcacgattattgccggctttcgtcccactctcccattttgtacttttgcaataatggtttagaaacgctggccaatctaatttacaatcaacagcgtttacaacctatttttactcaaaaggatttatcctagagttatagaattcatttttctattaggaaggaaaatgttacgtggaagaagatggtgacatgaagaatcgatggggaatcttttcagcgattgtgctgctctcgtttatgtcaactttaaccagcagtattgttaatattgctttacccgttatgtctcgtgatcttaacgttccaatcgctcaaattacttgggtcgcttcaagttacttggttgtgacctgcatgttgttgcttccatttggaaaattgggcgatcttttcggtaaaatcaatgtttttaaaatcggcacggttgtatttaccattagttcactattatgcgggataaattttggcttcgcttgggttttacttatgcgggcaattcaggcaattggtgccagtatgactttaagtaccaacgccgggatcattaccgaaacgttttctaagaaacaacggggattagcccttggtagttttggctctgtggtggcacttggagcaatcgccggaccgggaatcggtggtttgattctgacttatttaccatggcattatattttttgggttaacgttccaattggtctggcggctattttattgggaaagtttgttctcccaaaagatgttcattttcaaaaagccaaggtcgatgtatggggactattggtcttgattgtcatgatgggctcgttctttttagcgttaataatcggccaggaagccggatttttaaccatgccatttattggcctgactgttgtctttattatcgcgctgatcgggtttatctggattgagaaacgggttgtcaatccggcagtaaattttaaattgtttgctaaaagtgatttgacgatgaatttaatggcaaccgttttggtttacggcattagttttattgttaatattattgagccaatctaccttgaacaaaatcgaaaattaccgacgaatataaccggttttattttaataagtttcccgattattcaaattgtcgtgtcaccgatcgccggtttactaagtgacaaattgggtgcgcattttattgtcttggtggctttggccttgatggtcgtcagccaatttggattggcaagtgtgcatcacgcaacttcactgattctactatgtctttggctgggatttgtcggactgggaaatggattgtttcaggcaccgacaaatgttcttattatgaattcggtaagtaaaaatcaattgggagtggcaagtggtcttttggggttgtccagaaataccgggatgacaattggctcaatttttgcgaatattttattgtttttgggaatcgatcgggcattaggtgaaatcactaaaaattatccgtttcagcagccgacggcatttatttcggggatgcaatttgtctttttggtcacggcagttgtcttatcattattttttatcattcaactgggagtgatttttaagcaaaaaaataatcagcaaaaagagtcctaaaattttttattacatttaagaacttttggtggactatcgaatttatagcgttcataatggcagtaatgtataggatttctcaaggttaaataattggaccgtatcaatttgcaaaaaggttgacttttggaaaatatggtttagtattaatcatgtaaattgatcaaggattaattggtgaactttacgaacattctatacaagtagctttgttgttaaatcgaagaaggagtgttaattaatgacagtagattacgattccaaagaatatttggaacttgttgataagtactgggacgctgctaactacctttcagtaggtcagttatttttacgtgataacccattgcttaagcgaccacttaagtctgatgatgttaagatcaagccaatcggtcactggggaactatcgtatcccaaaacttcatttatgcacaattgaaccgtgttattaacaaatacgatttgaacatgttctatattgaaggttcaggtcacggtggccaagtgatggtttctaactcataccttgacggtagttattcagatatttacccaaatatctcacaagacgaagaaggtatgaagaaattattcaagcaattctcattcccaggtggagttgcttcacatgccgcaccagaaacaccaggttcaatccatgaaggtggcgagcttggatactcactttcacatggtaccggtgctatcttggacaacccagatgtaatcgctgctgttgaaattggtgatggtgaatcagaaactggtcctttagccgcatcatggttctcagacaagttcatcaacccaattactgatggtgctgttcttcctattattaacatgaatggtttcaagatttctaacccaactatcctttcacggatgagtgacgaagacttaactagttactttaaaggaatgggctgggatccatattttgttgaagcaactcctgatactgaccatatggaagttcaagagaaatttgctaagactttggatcacgttatcgaagaaatcaagtctattcaaaagaatgctcgtgagaatgaaacgccagatagtgttaaattacctaactggcctatgatcatcttccgttcacctaagggctggactggtcctaagaaggaccttgatggtaaccctatcgaaggttcattccgtgcccatcaagttccaattcctgttgctgcaggttcaatggaacataaagatttgcttgttgactggttgaagtcatacaagccagaagatttatttgatgaaaatggtactttgaagcctgaacttcgtgaacttgctcctaagggcgaccaacgaatgtcagttaacccaattactaacggtggtatcaagccagaaccattgaagttccctaacgttcgtgattttgaagttaaatttgacaaacgtggaaacgatcagcgacaagatatgatcgaatggtccaagtggttggacgctgttgctaagttgaacccaactagtttccgtggctttggtcctgatgaaactaagtcaaaccgtctttacagtttacttgacgatgagaagcgtcaatggatggaagacattcacgaaccatttgatgaaaatctttcaaatcatggtcgtgtgattgattcacaactttcagaacatcaagcagaaggctggcttgaaggctacgtattaactggtcgtcatggcttcttcgcaacttacgaatcatttggtcgagtagtcgactcaatgttaactcaacacttcaagtggttacgtaaagcttcagaacaatcatggagaaaagaatacccatcattgaactttgttgatacttcaacagtattccagcaagatcataatggttatacccaccaagatccaggtatgttgactcatttagctgaaaagaagcctgaatttatccgtgaatatctcccagctgatgctaatgaattattagctgttggtgatgttgcattcagaacttacgaaaagattaacttgatcgtaacttcaaagcacccacgtcgtcagtggtactcaatggatgaagcacaaaacttggttaagaacggtctcggatacattgactgggcttcaactgatcaaggtcaagaacctgatgttgtctttgctgctgctggtagcgaacctaacttggaagcattagctgctattgacatcttgaacaaagaattcccagaaatgaagattcgtttcattaacgttgttgacttattgaagcttcgttcacctaagattgaccctcgtggtattagcgatgaagaatttgacaacttgttcacaactgacaagcctgttatcttcgcattccacggtttcgaagatcttatcaaggatatcttctttgatcgtcacaaccataaccttcatgttcatggttatcgtgaaaacggtgatattaccacaccatttgacatgcgtgtcttgaaccagttggatcgtttcgatcttgctaaagaagccgttcaagatattccagcatactctgtaaagggtagctacttcattcaacgtatgaacgacacagttgataagcataatgcttacatccgtgaagttggtactgaccttccagaagttgttagttggaactggactggtctcaacaagtaatctaattgaatcaataattaattactaaaacttaaagggcactcaaatccaatttggatttgagtgccctttttagctgcaaaatgaaatctgtgaaaatattggtcatagggatgattttctaacatttagttattttagattagggtaagattttaaaccatttatcatcttcaaaatacttaccgatttggagcagtaaatcttcgcgccccttctttgccataaattgaattcccattggcaacccgttttcgccaacatgagttggtaagctaatcgcaggttgaccacttatgtttgccagttgggtaaatggtgaaagcgtcagggcagggagccattgatcccaaataagttgttgctgttctttgggtgagaatgtttcgatatgtttcaacttttgtagatcctcattggaaattaacggatcatcgactcgcggcgcttggtgggcggttgttggtgttaggtaaagatcgtatttggattgaaattcatccattgttgcactgacattatcccaaaaaatcagtgcctgactatactgaatggccgaaactgatttcccagtcacatttaatgcccaagttaacggttcaacattctgtttaatcatctggtcatctagcgccatgtttgcgaacatggtcgcagtttccccagcattcattagataatatgtttgcattaacttagtaccgtcaatgggggcatcagccggctcaacatcaaatccactctcatccaaaaacgttacagcttctttgacggcctgtttggcggcattggaaaccggtgttccaactggcgatttagttgaataaccgatttttaggtgatgtggtaattggtttaacgtatctgcaaactttttatccggtgccgggacttgaaatggtgcagccatttggatagttgttagcgcatctaataaattggcagtatctgtgatgtcccgggtaatggcaaaattaattgaagcgccttgccagcctcgccattcgccaggaccagttgggactctgccccgagttggcttaagaccgatggtgccggaaaatgaagatggaattcgaatggaaccaccaccatcgttaccagccgcaattggcagccagccatctccaaccgcggctgcggaaccacctgatgagccaccaggttggtaatctccgttccaagggttatgagcgttaccatataattgcgagtcggtaatgtttttaaacccaaattcaggggcgtttgtttcgccaaccggaattaatccggcggcaagcagtcctaagacaaagttgttggtttcaggtgcaacgtaatcttttaatagttttgaactagcggtgtccagctgacccttaaaggactggcctaatccctttaacagaattggcaccccggcaaagggttggccagtatctttgaaagcggcggccattttttgagctcgctctggccagtagcttgtaacagcattaagatgcttattattatttttaattgtctcaatcaattcggaaacaagttcacttcggcttacttgatgattgcgaagaagctgagatagttccgttgcagaatgagcagctagtaaattatttgtcatggcagatttcctttcagtatcaataaaaagcgattaaatatgaactcgctttcattgtaaacttaagaaaaaagttgagcaattaactcactcaacttttgcgattatttttttgataaagattgttcgaacctgagaaagtatgggggaattggggcaattaccgtttttcgttgatttgtaaacggcattaccaatcctaatttccacgaatgtaatagtaaatactcatactggtcattcggattataaagtggatcaccaacaattggatggttaattgcagccatatgaacgcgaatctggtgtgttcggccggtttctaactgaattgatagtagtgaaaaacctttttcttcccgaatgacttggtaatgggtaacggcgtttaccgcgtgtggcccgcttacttttcgctttcgtttatcatctggatccaagccaattggtaagttgattttaccgattgattctaaatttgtgccactaacccacgctaaataggttctttgaatcacctttttagcaatattagccactagaattggaacaactgctggattttttgcaaaaacgatggcaccactggtttcttggtccagtcgatgaatcatgtatggtgagatatcttcggcttgtaaataagctgctaaatggttcattgttgcaccaacttcaccaggttgattggcatgtgttttgtcaccgcgacgtttgttgatcacaatgagattgcgatcttcatataagacttcaattgtagcagccgagtccaccaatacttccgggtatggctgtccaaagtcctgaggcaaaaaggtcatttgaattcgatcaccggtatgaactggaaaattgacgggcagatactggccatttactaggacacgttgattgtgccttagactaaatatcaaatgtttaggaattaaccaatattgatgtaataaaaagcggagtggctgattagccatctccggtggaacgacttcattaaatatccatttatcgatcatttaaattactttgcttttttagcctgcttggatcgaacaattaacacatcgcatttggctgttcgggtcacatagcttgtaaccgaaccaataattagccgctcaacagcgcttagtccagttgacccaatgacaattacatcattattgtgatcacgtggaaattcgcgtgcaatgatgggtttcgggttaccaaaacggatatgaatatcgacactcttaacgccggcgtctttggctttttgttccatgtctttaagtttatcttcggtattttcagttagtttgaaaacgacatctccgcttacggcgcttccataggtttggttgaactgattaacttccaaaatattgaggatatctagatgagcatcgttgactaatgctaagtcaattgctcgattaagcacatgctccgtaaccgctgagccatcaactggtactaagatgctactgtatttttgttgttccatttcgaccaccccgtattcgttttattccttacctaaactataacattctcagcaccgcttgtaatcaattattaatttgcagaagctttttccttgtgattgtaatcgcttacttatggtgctaacatataaactagtgaaacaatgaaaagagggattttttctatgtattattatgtcatgaagtccgacgatattcgtcaaaatttagctactgaacagtatttaatgaatgaaattaactttgatgaacctttacttctattttatattgaaggaccatgcatcatcgttggtcgtaatcaaaacacgcttgaagaaattaataagaaatatgttgatgagcacaatattgttgtgacccgtcgactttcaggtggtggggccgtttatcaagaccttggtaatctttgcttcagttttgtggttgacagtgatagtgaagaatttggtgatttcaagtcatttgttcagccaattgttgatgctttacatgatatgggggcaacttcagttgaagttagcggccgaaatgatatcttggttgatggtaagaaattctccggcaacgcgatgtacactaagggtggcaagacattctcacatggtaccttaatgctggatgttgatttgtcagttattcccaaggcattggatgttcctgaagacaaaatcaagtcaaaaggaattaagtcagtgagctcacgtgtcactaatctaaaaccatatttagcatcaaaatatcaaaacttaacaaccccggaatttcgcgatcggttactaaaagagctgttccatgttgatgatttgtctcaaatcaaagataaggaatatcacttgaaagatagcgataaaaagggtattgaaaagatttacaatgattactacaataactgggattgggtatatggtaattcacctgaatttacagttaaaaagcgtcaacatttcactaacggtactattgatgcccgtctgcaagttgatgatggtaaagtttccgaaattaaattctatggtgatttctttggaccaaaggatgttaatgaacttgccgacaagttacagggcctacgttttgaacgtcaagatttcgaagatgctttaaaagatattgacacaaatcagtactttaccggcattccaaaggaagattttctgaatatgcttttctaaagtggccgaataagttaaacttgaaacgaacggtagcataaagataaattccatgatcgaatttatcttttttgttttggaataatggaggggtattttgagagtcgaagagaagaaagttatcacttgggcaattgtttcgcttgtggtgttcttaattactaattggctgctgacattaaagatgatgcagcttgacaaagcggtgcatatgtccgaagcgattcaggttacttggatcgcaattgcattttatgctgctacaattattttggcagtcttaaaggttaaaatcagctattatttactagcagtcgttgttgcggtatactcagtgggatttgttggtatgttgatgacgatgatcaatgacagctctgccaactatttggtccgagcgttgccaattgtgatgagtgcgattggtatttgggttaacgtttattggtatattttagtattccgattacgagcagtttatcaacgaaagagtatgaagaagcaacttgaaaaacgtgcaaaagaatttaagaaataggtgaaatctagtggagaaggatgtaacaagttttattgatgatgcaacgaatgaaaaaattgacggtaaaacgttcaccggtaaattggatgatgtcgcagcagatatcgatggtgtcatgaagccggtttataattatatcgaagcgcaacttaacttggggaaattaggttatgctgaattgaaattaacagacgctgatgttgcgattcgattagagaccaatctgattaatttaccgttacaggagattaaacgtatttcgaaaatgatttctgacgaggataaattaccagttaacgtctatattttaatgatttcacctttggttaatgcttcaggtctacgaattgatgaggtttccagtgctgatgattatattgggcacgttgcggattacgccaagaccatgaacgagtgggttgctcagcatattgaggccgtcaaagatcacttggctcaagaagctgagaaggaaaaagaaacgcataagaaggcccctgctaagcgaactgctaaaaagtaggttgcattattaatctagacgtgtcataatggctttatgcgatgagtcgagagatcacacagcattttgctgttcgcgcaagcgactaaggtgatattttgagcgggacccaatttaatgcacagatttgcaggggtttgactttagcggattgtggagtccaagaagcccatctagtaactagatgccgtattgaaggatcaaccaagaaattggttggtccttttttcattgtcttaatctaataagacgttaccagtaacgcccagacaagcggtttgataattaattaatattaatatgttgatatgattgcaagattgctaaggacgggagattgacgtggttaagctaattaatagccggaattggttatgggtcgaatttgggacgttgggttctataaatggttccagattccaatttcagcgtgacgaaaaagatccagttagaagccgaggttttgtcagtttctaactggatctaatcttagattgttttcattctttattttctgaaaaacgtcattttaaaattcacgtttaccatgtaagtagacctgtttatcggtttgctgaacggcttcaacattggctaatggatcttcagctaagacttggaaatcagcatacttaccaacctcaagggtaccgtattcgtcttggatttggcaaagttcagctgagttgatactggaacattgataagcttcaactggtgacatgccaagtttggttgtcagcagctccatttccttgccggttttatcaaaagtattgaacggcgttccggcatcggtgccacaagtgattttgacgcccattttgaaagcgcggctaaggttctcataagtgtcatcaagtgcgtcggctgccttcatgatttcccacttgggaagtgtgccttcaccatattcgggaatggcccattcagcgaccaaggtgggcgttaaataggtgccttgtttgatcatttgctcagcttcttgttcggtaacataaaagccgtgttcaatcgaatcaacaccggcgtccagtgcgttttgaataccgggattaccttccgcgtgagcagccgcccgttttcccttgtgatgagcttcagttaccccagccttcatttcgtcaattgataattggggatcagccatgaaatcgccaggcgtcatgacgccgccggttgccattaatttgatcagttcagatccattttttagcccttggcggacggctttacgaacttcatccggtgaatcaaccaagtaagttgaatggggatgatcaccgtggccaccagtcattgagaacgttcttcccgatggcataataccaggcgtcttttttaataatcccttttcgcgcattcgcttgagtttaatgtcaacatcataactatttccacagccacggataaatgttacccctgatttcagtaatgcttgtaaattttgataagccatcacggctgtttcggtttctgagcggtcgcggccgccgtcaaatgttgccggatcacttgaaatgtgggtgtgaacgttaataaatcccggcatcacatattgaccttctaaattaatccaatgcgttgtgtcaggcattttgccagttccacggttggttattttaccggttgtatcatcgacgataaaccaggaatgaggttcgttatgaggtgatcggccgtcaaatagtgtgaaatttgtaaatgttgtctgggtcatgttacaagtcctccaattaaaataaattcagtttagaatagttatattgtatgagcagtttgccccgtgattgtcgattattgcagtgattacagtttactatacattacttccaataagcgtactggtattgcgcttcatttagtaatgagtaagtcaagccaccgactttactgctaattaattttgcttcggaaggttgatacagtgggatgcagcccattatcttcattaagtatttatctgcttggaccaagccatcatatcgggcttgaccagttttggcgtttgctgtatttaagagcttattgaatgtcgggtcattccaatgggcaaagttaactgagttgtccttggccattaagctgaggaagtcgtatgagtcacgccaattagtgctccaaccagttaaattcaattcaaacttaccatcaaagtcacgagcaacgtgctgagcgtggggaagtgatgtgaggttaatagttaagcctttgaagttcttttgagcaattgattggatgtaggccccgatatgtttgtcttcatcggtatcgtcagtcagtaggttcattgtaaccgactttttacctgattctttgagatacttattccaatagtttttagcctttgaaacgctggtcggtaggagattaccaacatcttcggccatgtccttgccggttttgggattcttttggtcgccacgaataaccatgttgagggcaggcttagacccatcttggagaacatcttgggtaatggttttttggttaatgatgtatccaagtgctttacggagattttcagaattggttttcttaatttgaggattaaaataaaggtaattgagtcgaccggtggcatgttttttcaaatctggattactggcattagctcgaacgtattgaccagtaacagtggtttcttgaatcttgccactcttaaacagattaattgcggtattttcgtctttagtgacactaacgttaacctggttgattttaacgtttttagcgttccaataatggggattcttaacatatttccaggatgagttgctaccggtccagccaacgagtttatatggaccatccgccattgttttagatgtattagtcccatacttctgaccatatttcttaacggcagctgtattgaggggcaggtatttcgaagccgccagatcattaaaccaaggaattcgtttagttaattgaatttgtagtttatgacgtccaattgccttagcaccaagtttatttggcgctagcttaccagcctggattgcactgtaatttttgaaagcactatataaattagcatactgagctttcgttttaggatcaaccgtccgcctaaaagagttgacaaaatcctgggcggtgacaggctgaccatttgcccatttcgcatttcgttttaaattaaatgtgtaggttttaccgttattagtgggcttaacgacttttgttgctaccccagggatgattttattctgtttgttgtatgtatataacccttccatagtctgaaaaattagtccggcactattagtgtctgtggctttgttaggatctgcagtgagtggttcgtctggtaaagttactgagagcgctttgtgagtactcgcagatttcttactaccacaggcagcaagtgagatcgttgtgagaaaaatagcgccaatcgtcaatagtttatgttccatatatagtccctccgatttgatgcggtaattaaggtgaatgacttaaatttgactttaaaaatttgaatctagtgacatttagaattcccgttttccatgtaaataaacttgtttatcagattgttgacatgctttaacatctgctaatggatcgtttttgagtacttgaaaatccgcaaattttcctatttcaagagtgccatattcgtcttgaatgtgacagagagaagctgaattgatgcttgaacatttataagcttgaagcggcgtgatggacaacttttcagtcatcagttccagttcttttggtgtcgtatcaaatccgttatagggcgttcctgcatctgtgccacaagtgaatttgacaccaagtttaaatgcacgactaagattacggtaggcatcttcagcggcatcgtctgctttttttacttcccatgccggtaaagtaccacggccatattccggaattgcccaaagtgcaataatagtgggcgtgaggtaagtgacttgcttgatcatttgttgggcttcttgttcattaacgtaaaaaccatgctcgatagaatcaacaccagcgtcaatcgcattttgaatgccaggatttccttccgcatgagctgctacgattttgcccttatggtgggcttcgtcaatcccagttttcatctcgatcgttgataactgaggatccgccatgaaatcaccaggtgtcatgacaccccctgttgccatcattttgatattttcagcgccgttttttaatccctgacggacagctttacgcatttcgtcaggtgaatcaactaaaaatgaaaagtggggaccgtctccatgaccgccagtcattgaaaaggcacgcccagaaggcatcatggtaggagtatgatcaagcagtccctttttcttgagccggttaagcttaatatcaacgtcataactggtgccacattctcggatataagtcacaccggatttcaacattgtttgaagattattgtaagcagtaaccgctgcttcagtttcagaatcacctgaattaccatcaaatgtattgggatcactggtaatgtgagtgtgaacgttgatgaaccccggcatgacgtattgcccctgtaaatcgatccaatggtcagctttaggtgcagcacccgtgccccgattgacaattttgccggtttgatcattggtagtgaaccaagcatccgattcattttgatctgttttaccatcgaataatgtaaaattgaaaaatgctgtttgagtcattgaaattcctccataatatcaattattttcgataattgattagaaatagctatctaggcgacaaaaaaacacccttccagaatttctctgaaagggtgctttcgcacggtaccacctttattcgctaatcattagcctcaaacgaacggtaaccagatcatcttctaagttaaataacaattaacttgaagagatttagaaacgattcgctgcattgataacggatgcgaccggtgatagcctacttttgccgagttcagccaacagctccgaagctacttctccatttggctgttgtcccgctttcactttaccgggttcgctatcaacggctgtaaatggatccttcttcatcaatgccattaatttctaatcaattattaatgttatatactctaacagtcgttttaaaaaatgtcaatctttattaaatctcttttgataaatcaatagtcgccgccgatgttgacacagtagggaaagtagctgctcattaagaaaaaaatagcaataagggaaaaataggtcggtgatttttcatctaaccattttctaatgataaggtaccagcattttgaaaaaggacgcttgactgatatgatttaaaatatcatcaatggtcatcattaaatagtcataattaatttgccaaccacgtgtcccgtttcgcttattttctgtagtttctgtgcgttttcgacactaaaaggcagttgctgagcgaccgtaatttttaatttattatcagcgaataattggcttagcttagtaataacatcgtgctgggcatgaccattaattttgctgaaggtaacatgatattggtcactgagttcatcggcctgctcggtggtttcgacaattgaaacaattttgccgcctggttttacaaccttgaaagcatcgacttgattattaccaccaagcgtatcaaaaacgaggtcgacgctgagtgttttttcagaaaaatgattggtcgtataatcgatcacttcatcagcacctagtgatctcacaaagtcaatatttttgccgctagttgttgtgataacatgtgcgcccgcatttttagctaattgaattgccagcgaacccacaccaccagaaccagctaagattagaaccgtctggcctgcttgcaggtttcccgcttcgaaaagagcctcccaggcagtcgttccagtgagtcccaaaccagccgcagcttggaatgattggttggcgggtttatggcctgcaagatccgcatcgattgcaaagtattcggcatatgtaccccgattgctgggagttccgtatgcaattacttcgtcattttctgaaaagttagtgacatttttgccgactttgacaacaattccggccgcttcttggcctagaatgattggaaattgaaaagggtaacgtttttggcgcaatccttgacgggttttccagtcaattgggttgacgccaatgcttttaatcttaatcaaaatttgattgtcgttaatttctggaatggggatgtttgctgcagttagtttgtgctcatcaccatattcgttgatgacgattgctttcatattattactgtttatcatctaatcacctcgttcacattatagcagatggtagaagcagcttaaaaaggttgtacacaattcaattgacattgttatggatgggaataaaatagacttgattggatgttgggagggttcaaaatgaaattaacagtgacagatcgtgcttatcaaaaaataatggctcatgtaccgttaaatagtaagctgcttctaagttttgatgatggggttggcccattttcaaaagttggtgtttgttcgttagataccgcttttgatattattgcggttgaccctgatgcgaatgtaccggactacgatcaagcgctattatcaaataagggaagctgggcttataaagggtattctaagatttatttgaacgataacatgaagttggacgtgaaaaataatcaattaatcctgtctggtgatagcggcgttttggacagtgaagttgatattcaagatttaacaggccaaaaagtctgatactaattaatattgactatcgttatttttagaatgaatgtggttgagacatcagtcgataaaatagttatttttcaaaaagtagagtggaccagcaagcgtttagatcccagaatatagcccctaacttgatatttctgattttggaatgttaagttaggggctatattctggggttgcttgctggtccacgttttttaaacgaaatattctgaacttgaattcggttacgcggccggaaattgccttttgccctgcgtttttgtttggtaatagctacagagactaggcaaaacaattattgtctcaccccctattttcactttgaaataagatgctaaactgtggatttctgactattgtccccgtcacgccttttagaagtaacattatttagtatttaataagcaaatgctatttgagttttcttatgtgtgcctgtgatattccgcttgggtgttatgcgtcatatttgcgactaaacaaaaagcggcgtgataattctaccaaaataggggtcattggcgtcgatagatctcggtaatttcgttcgacaaacggctgaaatttgctaagggcaccttcctcgagttttttactatcagtgagtaaatgtcttaaatcaattgtgaattcctgcaatgtaactttatcggcctcggtctgcattttatttttgcaagcgatgagttgcgtgaggtaaccatcataggctgtctctgacccgcttgcttttctgggagcgaaatttgaatggatcgattggctttctttaagtttcaaactttgaagatatttttgtcccttggttgttagccagctggtagctttattgttaaagagattaacaccgtccacaaaatccaaaacaaaggttgctgttaaaattctttcgtgtttctggtccatgatcgttaattcattgaggagatcgggagctgaataatcattgttttttccaaattcgattaattggcgaaccgtttttaagttgacctgattcagttgtgtttccaggtaacttaagatgaattcacgtttcttgtcgtcagttttcatgatcttattaccaccttattaattttattgattaactgtggaatagcttcatcttgatatcctggtcataattaccaaatccctggccaaaaatcgtacagccacctttatgcttggcatcttttttaatcgcaaaccgaacagtgaaagtgggctggcgccaatcaatgtcgtcaaccgagacatcggtaaagggttgaccatccaaataactgccatgatccgtaattcggacgatctttaattggccgtactggttaacgttatctgggacccagtcaggcgtgtatttgccacgaatatctgagaagtcgccggggctggtccatgtgccaatctcgacgtcattaatgtaaaaggtaatgtctgacggccaaacgttatttgaaaagggaaattctgatccgagctccatcgataaatccaacatttctaatttatctttgtcttccaagtaattcggaaattggtattcgacaaaaccatcggtccaccaaatcatcccggctttaatgcggtcggggctcataaagtaagtcggattatctaccttaccaatatagtcgtttttaccggctaatccacaagaaggcgtaactgagtagtttgtgaattgacccacggggacttgggtatcataaacagcgaatgccggatagattgttttaggaaaatgaacgttaatgttatcaaccttaaggtaagagatctttttatgaccgtgacgttcgaacccaatgatgccggcttctgccaacttattaagatgcattagtacaatagcactacttaattttaacttttctgataattcctggacgctcatccgttttgatgatagcgcttgaataatatcaattctaacgggacttgcgagcgctttataaacctctaatgaatctttggaaatatccaaatccataaggcatcacctttcatcttctatattaagttattttttggttgattcatatatttataaggtgttaagtcgaatttcacaattaagattcacctttatataaatctttttgaatgtaaccgcttaaaacagcttttatattagcaaaaacctagtttgaagtcaaaagactacttaaagtttataaaatccattgtaatcgttttctgagggccatatgataaaagcgtgcacaggaatgataaatatcatgtggtagaaaaggagaatttaaattgattgaatacacaagccccttgattgttcaaagagccgatccatacatttataaacataccgatggttattactattttactgcctcagttccagcttataacctgattgagattcgtcgggctagaaccttggaagggttggctcatgcagcaccgcgaacaatttggcgaaaacatgaaagcggtcccatgagccaattgatctgggcgcctgaaattcattatattgatggcaagtggtttatctattttgcagcggctgaaacaacggcgtttgacaaattaggcatgttccaacataggatgttttgcattgaatgtgatgccgaaaatccaatgcgcagtgaagacgattggttcgaacatggtcaggttgaaaccgggatggacactttctcgttagacgcaactgttttcgaacatcaaaacaagctgtactatgtttgggcacaaaaggataacgatattaagggcaattccaatttatacattgctgaaatgtcaaatccgtggacactgaagaccaaaccagtcatgctttccaagccagagtttgattgggaaattcgcggcttctgggtcaacgaaggacccgctgttattcatcgaaatggccgtttcttcttaacctattctgcgagtgcgactgatgaaaattatgcaatgggaatgttaaccgttgctgatgatgtcgatttactcgatgccgctaattggtcgaagtccaaagaacctgttttccagagtgatctagcgactcatcaatatgggccaggtcataattcatttacgattgcggaagacggcaaaaccgatttaatggtttatcattgccgtaattatactgatattaaaggtgatccgctttatgaccccaaccgtcatacaaaggttcagccattcacgtggaacgaggacggtacaccaaattttggtaaaccgactccatataattataaataggagggaacggtactatggattcagtaaaaaaagagaataaacatttttggggattcccattttcacattttagttatttcttcatttgggctacggtttatggttatttaactctttggatggaacaagttggtcatttaaacggaaccgagtctggcttggtgttttcaatgatggctggaatttcgctattatttcagccggttttcggggttgtgtccgataagctactcttcaaaaagaatctaatcttaactatttcaattgttgcaatctttattggcccatacttccaatggctttttgttccattgatgcatgttaattcattcttagttgctattattactggtacctttttaagctttattttaaatggtggggtttcagtaattgaacaatatgttcagcgtgctagtttagccaatggatttgaatatagtcattcacgactcggtggttcagcagcgggtattgtagcatcattagttgctggtcggcttttcctatggaaaccggattcgattttctgggcatgtactgcggctgcaattgtattgactgggttattaatgtttagtgataaagtgaatttgcaaaatgcgtctgcagcgggggatacttctaattcacttgattggaagacagttacttcagtttttaaaattaaaaacttgtggattttggcaatcttttacatgggtgcttcagctatttttgatgtttttgatcagcaatttattattttcttcaaaacgttttttgatagcgcttcacaaggaactattatatatagttatatgacttccggacaaacggtgatcgagtttattttaatgtttccaatgccttggatcattaacaagattgggtctaaaaatgggctgattatttatggattcttaacttgtgttcgaatcttgggatctgcacttgcgccttcatggggatgggttgttttcttccgattaattgcgggactcgaaatgccactactcctaacttctattatgaagtacattgccggagcatttgatattcgtttatatgcgacggtttatgctttagcgtctaattttgctaaacaaatatcagtattcatcttttcatccgttgccggcaaaatgtatgatgttattggttatcaacatacttatattttgatgggaatcttagtgtttgctattactttatttgctgcctttacccttaagaaagagaataaggtccaagctggtgagattgaggcacctgataaaggtaaggttgctgataatggtgatccaaatatggattaaatatgggttgtactcagtaatatttgaattttgaaaggatgtttactatcaaatcaaaattgtatcttgatcgctcacaaataatttctaaaattgatccgcgaatttggggttcttttactgaacaactaggacgatctgtttatgaaggaatatatcagccaagtcatccaagcgctgataaagatggttttcggactgacgttattgatgctgttcgtaagttgaatgttccccttattcgttatccaggtggtaactttgtttcaggctatgactggcaggatgggataggtcctaaaaatcaacgccctcgacggcttgagctagcttggcgaagcattgaaactaatcaatttgggttacatgagtttatgaaatggtcacaaaaagttggagctaagcctgacatggctgttaatcttggaacccgcggaatcgatgaagctcgtaacttgattgaatattgcaattttcctaagggaacttattggagcgatttgcgtaggcaaaatggtgcggagaaaccttttaatattaaggtttggtcaataggcaatgagatggatggtgattggcagataggtcataaaacggcacaagaatatggccgattggctcatgaaactgctaaggttatgcgacttgttgatcctagtatcgaattagtagccagtgggagttctctaagaactatgtcaacttttgggagctgggaagaaacattattagataatgtctacgacgatgttgattacttatcacttcatcaatattacgataattatgataatgatttgaaagagtttttgggaaagtctgttgattttgatggctttattaatgatattatagcagtttgcgatgctgtaaaagcccggcgtcatagtgataaacagattaatcttgcaatggatgaatggaatgtttggtatcattctaaggctgctgatgataagcaggcgccttggcaagaagcacctcatttacttgaggaccattataattttgaagatgcactgcttgtgggaagcttggcgatcacattattgaagcacgcagatcgagttaagattggatgtttggcgcaacttattaatgttattgcaccaattatgacaaatacaagtggtgaaccttcaatttggtatcaatcaattttctatccgtttatgcaagtttccaactatggtcaaggaattgcgttggctcagcgagcaaatgtaccagcatataaagctaagagttatgatgttccatatactgattcggttgctacttataattctaaaaccaatgaaatagtcatttttgttgaaaataaagcgcatgaaaaagttaactttgaaacaacacttgagaactttaatgtgaataagctggttgaagcaacacaattttgtggctatgatctgaaaaagaccaatgaagatcaatctatgagtattgattcattgaaaaaagttcacctagatgatgacaagcttactgcggagttgcagccactgtcatggaatatgattcgcattaatgcggatgattaataagtggtatttattaaaagaattgttatccataaaataaactatggattcaattctttttgtttctagaaacggtgaggttgactaacatcatattcctattacactaaagactaatgactttaatggaggcgatgtgtatttatcaatctaagcaaaaacatcatagaaaatgggtcgttattgcttccttgaccctagttttaatgattatcggcttgtggttgggaaatatgggctatgttaaattgacgctacggtgggaattagatcaggcgttggcgaccaaatccgctaagaacctgcacttgttaaaaaaagtatcagttgatcctcaaacctatcactatttgaaaactgcaaccggttcgaaaattaggcgactgagcgattttcaaggtggcgatcaaacgcatggctactatgccggcttagttaaaggcaaagggattagtgtttggatggttgataaggatcattcagcagggtcgtggacagtgttggctaatcctgagtggcgaatcgaatcattacaggtgcgttaggtattctgttctaataaattaaaagcagcgattcatcaatgataaattgatagatcgctgcttttgatatgtgtggcgctttttgggccggtagatgttctatgataaataattgatgacccagttattttggataatcaggttacaactgaatctatttggttgtcgaactttctgaagcaggcattggcgctttagcaaacttggaaattgcccagctgccaaagagaccgattaacataaatggtaagaagtccagtccaatgctgtacagtggaattgtgcttgaagcccaggcatcgatacttgaaaagagtggcatcttggcaaaaatcgggggtaaattatgaattagatcaaggatggcaggaatcattgttaatgaaatcgtgcttcgatagattaacttacgacgaccgattaatgggttcatgatgcctaagataatcaacgcaattgctaatggatataggaagctcaaaattggtgaggagtaaagaataatttgatccaaaccaaagttggcaattgagaacgaaataattgtcgcaaagattaggaatttatggtaactgatctttggaaaacgacggctccaatcttgagaaagggatgttaacaagccaattgatgtggttaggcaggctagtaaggttaaggccgctaagattgaagccccagccattccagtatagtgttgcataattgtcgtaaaagcagttccaccatcagcacttagtttagtgtaggacaagcttgaagcacccaacgcaatcaagaagatgtagattaaggcttcaaatcccattgtcaaagcaccaattttagcaactgactttgaccgttcacgattatctttttgaccgaataatttgagagcggcaacaaccgtaaccccgaatcctaacccagctagggcatccattgtattgtaaccttgtaagaagccattgatcagagatccggtgcccttgccagctgctggtaacagatccatactgcgcatatcgctccccttaaggaaaaaggcaacgaagaacaggaatgcgagcagtaaaaccaagaggggattcaaaattttaccaacgtttcgggtaattttgttttggttgtaagcgagtgctaacgttgccccgaagaacaagagtgaaaagataagcagactcatttgtgtccaagcttttggaatgaacggttgaatgcccattgagaatgtaacggttgcggtacgaggtgacgcaattaatagtccaagagaagcatgagtcaaaatcaaaaatgccaaggcaaagattcgaccagctggtaatgccaaatcatacatactgttactttcggtcatactaattgaaaggatcgaaagtaagggtaaacaaatggcagagactaagaagccaattgcggcaggcagccagttggggcctgccatttggcccaagtgaattggaaaaatcaagttgccggcaccaaagaacatcccgaatagtaaagacgcagtgataatatattgcttacgcgttaaaataatctttttgtccatttgcaattcctcctatgattaataaatctgaataaatagctgaaacattgaaatcctcgacaacgaaaaaacgtccttaactgttttttacaacagctaaggacgtttacacgtgttaccaccttgatttccaattatctcacaataatcagctcgaaaagtacggctcaagaagaccggtctagcttgagtgatactccattgcggtaatgggcgcattcccagtaactactacattgaaaatcatagttacaacttgtagattactttcacctgcattccgactgccccatcacaccaaactgaggctctcttcaaatcggcatccaagctactcttctacgcatcgttttttgaatatctcgttgtcattgactaagattctatttgattaacatgagaatgtcaaggcttgattcttacaaaatgtgaaatatctttatcaaagccagcgatatcaaatgcttaaagatttttcaatgatttttcaacgcgttgatacggcacaatccacagcatcatcacaataaaggtaccgatcatcccaaactggtgccaggcaaatgaaacaaagaagacaacaacgaaggcggccaacgtgtaaatactcttaggttcacgttttagtgccttgactaatactggtgaatttttatttgcacgaactaaactaattcgtaagaagttccaagaaaggttcatgaggataaaaataatggtgtaaagttgcgaaccaaataaactatctggatcatcgttcacaattttagtggcaaacgggataaatgacagccagaaaactaaaattgaatttgcccaaatcaccatgccatcgatttgtttaacaacttggaacatatgatgatggttcccccagacaattgcgagtaagaaaaacgaaattgcataggcaaatagttctcgtcgtaaatcccacaaaccttgccaggagtaactttttggcattccaagttccaaaacaagaacggtcatgataattggaattaacgcgtcggtgaatgcttccaaacgatttttcttcataattgaaaatttccccctcaaaataatcgtaagcctttatatacagaatacagcattccggcaaaaaggtttgaaatcttgttctgtgggtgagaatttggtgatttatgtgtactaaaacggttacatttgggttgggtaattgactttgatgattgagaaaagttaaaatagattaataattctaatcaatggttaatattccatttggagggtacatcattatgtcattaggttcaagaatttttcggcgggagcgattggatcgctacttggaaacagataagaatttcattaagacgatgtcggcgtttgatttgatttcacttggaatcggtgctgttatcggaactggtatttttattcttcccggaacggttgccgctaccaaagctggtcctggtattattctttcattcgttttagcagcaattgtttgttccacctcggcgatgtgttatgccgagtttgcgtctgcgttaccggttgccggtagtgcttattcatatggaaacttggtttttggtgaaattattggctggattcttggttgggcattgatcttggaatatgttttggcggttgccgccgtttccagtgcttggggcgcttattttcaatcactattggcaggttttcatttgagtattccaaaggcgatttcaggtccgtttaacccgtctcagggaacatacggaaacctgattgcgattttaattgttattttcatttcatggatgttaaatcacggcatgcggtcgtcggttcgattgaataatttgattgtggccgttaagatcggaattatcgtgctgtttattattgtgggtgccttctatgtaaaacctactaattggcaaccaatgttgccatttggctcaaagggggtattgagtggcgccgcagctgtcttctttgcttatttaggatttgacgcggtttccagttcggcagccgaagttaaaaatcccaaaaagaatatgccgattgggattattggaacattaattgtggcaaccattttgtacgttggtgtttcaattatcttaactgggatggtttcatacacaaaattggatgttgccgatccagttgcctttgcacttcaggtggttcatcaaaattgggttgccggcatcatttcattaggtgcactggccggaatgtttacgatgatggtcacgatgatttacagttcttcacgattaatttactcgattggtcgagacggtctattaccacatttcctaggcaagttggcacctaacggtagtcctcgaaacagtatgattacaattacgattgtcattgcgattatgggcggttttgtgccgctggaccaattgaccaacttggttaatattgggactttaattgcgttcttgtttgtgtcatttggtattattccattacgccataacaaggagattcaaaataatcacggatatcaagtgccttggtacccggtcctgccagttgtgtccggcctgctgtgcatgttgatgctgtcacagcttcaagcggaaacttggattgcatccggaatctggtttgcgtttggtctgatcttgtactttagttacggaatgagacatagccgactgaatcgatcatgatgattgacgaattatttaaagcacattaagataacgcttcatattgggtatctctaaactggggatatccatttttctattgcctacatttgggtattaatgaccatttggctggcccgtgttaaagcggtcatctatcttaatatcattaagaattaatttcagaaatcccagaacataggcaaacatgatgatgccactagttgcaatgattagggcaccgttaagttggctttgaaacagggccgtgtaaataagtgcgccgatcggcataattgctgtgaccgaagtatttaaagtcgaactaactcggcccaaaatgtgagttgggacggtggtttgcagtcggatgctaaatgagatattcataacggcattggttaatccagctaccagcatgatgagtgaaccagcgaggctcagttggaacggttgatggacaatggcgagcagtagaccaaggaatgtcatgcaaagacccagaatgataattggtggtaaaactctcaatgcaaagtatttttcatttgggatcaaagacattagcaggctgccgataaataatccgactgaaaagccggtttcgatataaccaattggaccattgccagcgtgtagctgattggtaatgacgtatggaacaccaatattaatagcggtaaacaagaaattaaccattatggccattaaaataacatcacggattagagatcgttgttgaatgtattgtagcccggctttgaaacttgccagctgtgatgcaagtgtttggtggtgtggctgtttggttgttgttgcagctgtttgataatggaaatgcatggaaaaaagaattagcaacgcacatgacgtcgcaataatttctacgataataaaagtttcaaatccaatcattgcatataatgcgacaccgagtgccggtgaaagaattgtggaaagagatgaggcagcctgcgtcagagaactcagtgttttaattttttgagtattaaccagttcatggacggatgctgagtaagcagttgtattgaaattggttgagattgccgcaattacgacgaaacaggtaaccggaatgaattcagatagaccactaaacaagggaaatgttaaggcaaagagaatcagtcctaataaccggatcgctaaactggatactaaaatcattttatgacggtattggtccacaatgttacccactggaattaaaaagagaattccgataattgggacaacggctgtttccagtccaaagcttaagggcgaatgagtgtcgtgaagtaacattaatcccattgcaagtgaaaacatgccaccacttagagagctgatgaggttactggcaatatcctttaagatttgctgatttgattgttgatttgtaatggtaactgtctgattatcagtggccgatttaagtgattgattttcaaccatgttgtaagcctcgattccgaattggcatggcgagtaagtcgatttcaaaataaaactattttatctattaaataaatttagtcgataaacaaaatatagtcagttgaaactattttgtcaagccgttatgataaatatgaggtgaaaaatatggcgaaaaacgcggtttccaaactagcgaaactcatggcggatgagaaagttattgcgatcttaaaggcaactaaagataaggacggactcacttcaaaagaaatttcgaagcgggttaacattccaaccaatcagctgtactatacggtaaaaaagatgaccgatgaagggctgctggaagtcactcaaaaaaagaatattaagaattttcaggagttctattattcaagctatcaaatgacccattctgatccacaacttggtctcgatgattcggagattgaaaaattaggcgtaaacatttcagcggaatgggttgaacaacatagccaagaagttgcacagatgattctatttcaaactcaacaatttcttgaagcgatgcaagcagaacttaaagattatgctaaatcccctaataataatcagattcattcgggctcaattcacagtacgtggaaattgacaccgggaaatgaaaaaaaactgtggcaaaaaataattaagctgattagcgaaactgaggaggaaagtaagggacaggagactcgtaatgttaatgtcttaatagaaagatgggttcagaatcccgatgaaaatctacatgataacaaatgagcagttcaaataatggcgatctatttttgaagtgttggtaaatcataggcgtaaaaaatgagagagtgggacgaaaggcggttacgcggcgggaagttgccttttggcgcacgttttctctcggtaataatcgtgattacacaaatggggctgggacaaaattacttttgtcccagcccctcattttggatttggtggcgttgttgtctgttcttaagaacggatagttggtaggcaatcgtttgaacgatctttaacggtaaatcattaacttggcttgcagtaatcgccagactaacgcaactgacagtaataccaggaaaatggcgacagatgcaattacaaataacgatgtgtaggaaacggcttcgatgataattcctccgaataatggccctaatgcccgaccagccgctgcccaggaactgatcaatccttgataaagtccctttgcctcgactggagttaatgagttaaccagtgccgggattgttgggaaggcagtggcctcgccaatggttaacgtgatcattgaagcgacaaagtaaagatagcttttggcaaaaatgagtgtgacaaatgaaatggcaaccataaaaatgccaaataaaatttgaatgactaaattttcatggtagtgagcaacccagttgacaatgagttgaatgacaacaatcaacccggcattaattgtccaaagaaaactataatcacggagtggaataccaagtgtggtcatataaacggacaaattagagtcccattgctggtacatcgtccagatgatcagtagcgaaacaaacaatgttgttaaaagtaaggcgttaggtcggggtaattgtttcttatcgtattttgagatgctgccatcactggcttttttccgagtgacgttggccgtcggtcgatatttgaaaataacgacaatcaagaagaacaagaataagccggttgcgatgacaaacaagagtgtcacgctaatactgtacacgaagccaactaatgatgttccgattacgaccccaaggttttgggcaaagtacagcatattgaaaacgtagcgactatcttgagatttgatgctggttccaattgaattaacgatggtgaggttccaacctcccgcgatcccgttgaagaagaggataatcccaaaaactggccaatcatgacaaaaaatcaaggtaatcaaggtgatgatcgccccaattatgccaccaattagtagatgatacggatttttgcgatcatacaggtagccacctaaatagctgcccaagacacttgccaaagaattaaatagtaaaacaatgccaatcatagttagcgagatgtctaatcgattgtggagataaacactggttagcggccaaatgaagctcatgccaatactgcttaatagggcgccggtaaccaaccaccataacttcatttcgttctttgccatttggggatcaccctttccttattaaaattatctgtgaagacactaaagattagtttagcaaaaagcgtcttgaaatagccagtatttattttaatggtaagcgctatcatttaacggtgctgtttgatggacttcgctttctaaataacatatcatgaaggcgttaaggtaatatcgtatttttattttattaggagggacgtttaatatggctgttgatggatcactttatcatacagaagttgttaatgaacatggtctgaccggtgaaagttacgttcgtggtaacgaaggtctggctttaggggtaagtagctcgttgatgcaaagtcctggtactaacccagaacaatttattggctttgcactgagtacatgtttcaatgcaactattggcattgttgaacaacaacatcgtatcaagcctgatagtattattcacactgccgttgatattgctaaggataccaaaggctataaattcattgtaaggtgtcagattctctttcatgatattgataatgaaaagggtcgccagatggtggatgaagccctagatcaatgcccagttgctaaattgctaaaggctaatgaaaacgtcacttttgaagtggttgatcaattcaaattttaatcttctttgagtgacaaactgatcacattgggtcattaaaaaacgcggttaaagcaaacctgaatctgctttaaccgcgcttttttatttttaattaatcaaaggttaatgttgctggtcgtgagaagccgacaacgtgccaccagggtgcataaacgttttccgttaccacaccgcggttttgtgagtcgatcatcttgccgttaccgatgtacatcccaacgtgggagatactacttttactgccaccaaaatataccaaatcacctttttgcacattcttttttgaaactttcttagttccgttgtattgcgcttgagcagttcgtggaatcttcttgctaactgacttcttgtaaacatactgagtgaagccggagcaatcaaagttggttgggccaactgcgccaaatacgtaacgtgaacccagatgtttttttgcttcgttataaactgcggaatagtgggcatctgaatcgctatcggcactcgcgttgatagtggttgaaagtgttgttattccgaaagtaagtaaagcaataactaataagaatggttttaagattgtttttgatatattgtgtgacaaaagatgttctccccttataaacgactttttttattaatttgatacataagctttgttagcggtaatgtagttaccatcggctagttgaaatctgtaagtgccatgactggatttggccatgtttttaactgctaattttttaccggctgtgatctttgaaattcgatttttgaagttgacgtcttgatactgatagatcgttcgacttgcagtcaccgtcttggatgatgttaatttagtgaaataagttgggacggctgctttagctgaactggttttcaaccaagaattaacggcactactgttaacaaccttgcttaagtcaacgttgccgctgattccgctaagtcggcctttggaagtatactgccaaagatctgattgaattttgggcttggcaccataattggcaatccaagaaccatcgaatttagaatagttgaccttatgtgttgtgacataattttcataagtgtaataaattaatggtttattggtcagtttacgcatttgacttaaccaggcattgacataagcctgttcagaaccgctacctttgcgatgttcgttatccaagacataaaatctggcatttgaactggcacgcttataaaaatcacgagcttctttcttagcatcggcaacgctgctgaattcagcgtagccataattgccaaatggaacattatatttagttgcaccatttgcatttacatttctctttgaatcaatttggaaatcggcatcccccgtatcaccatgttgaacccggatgattgcgaatttcagttgttttgaagccttgctccaattgatgttcccctgccactgcgagacatcagcaattttagttttgctagcagaaacactagtgctgatggtaaacgcagccagagcacccataaataggccggctatctttttaaaattaagtgtcattcaatagtcctcctctaaaaagctacaagaagaattatagtagttctatgctaccaaacggtctcaagagtgtttcacgaatgttaaaattaatttcacaaaatttataatcgctgatggttactagtctgacgcgaaccagacgctttcaaaagttttcatttttctcaaaaaagttgatttaatcaatcattttaaaataaaaggccttaattaaaccgcaaacctgtcgtaaaagtttccgtttgttacaagttaatggggtcaaacgtaatattgggatcacaaaatgataattcttgttaaaaggtttttcattttgatatgaacagactagccagtgagatatactcaaggtgaaacttgtttgacacactttatgtggaaggttgagatttcatgttatcgacaaaaaataaatgggcaccaaagtattattggggtgcagtaattgttacgccaatattgatcatcagtgtgctgtttatcctaatgaatatcgcaccatttggcgttaataatcttttggtcagcgatttatcaacacaatatttacaattttttacggagttaagaagacaactgttgcatctttcgttttcaagctattcgtttttaatttcaattggcgatagtctggtgcctatctatgcgtattatttgctcagcccattaaatttaatcatcgttttctttagcaatgctcatttgccgattgcgattgacttgattatttgggcaaaaataattctttgtaatatcacaatgagcacctttttggcaaaaaaataccagcgctatgattttatgacgatttgtggtggtctggcatacggattatgtggattcgttgcgatgtatttttatgatcttatgtggttggatgcactaatttggctgccggtgatgatttatggcctagagaagttattttatcaaaatcgggtgtggttgtacgtgtttggcctggttatgattattgtgactaactattatatggggtatatcatctgtggatttagcgtgatgtactttgtctacctattgaagaagaatcagccggtccacttaaaattttggcaggcgatccatcaacagcggagaaaagttggtcgctttatctggtattcggtgatttcggggatgctaacggcgattgttctcgtcccaactgcgctttcaatgttatcgaccggcaagaaaaatattttaccccggaatttcgcttttaagggcacatttggtccaagcttcactgtgaatttaggtgtcgggggtaatgattttactggtcggcttgtccataatccaagtttattcacaggatcactgtttatcattgcggcaattgcctactttttttctaatcaaattagtaaacgggataaacaggcatcaggattattgcttggggttattctgtttggtatgtggttattacccttaaatacaatttggcatatgatgcaacggccggctggatttccattccggatggtcttcttatttagttttgtactgattatggttgcctatgaaggctacataaagggagtctttaaggatcaaagactaattatctattcggcagtgggtttggggactgcgatttttatcggctatgtttgggcgactatctttgggcagaagctgttgccgtaccagtttaaaatttcccagctttcagtaaataattttgtcttcctattagtggttggcttaattgggatcacagcatttgagatgattcaaattagcgcccacgcccctggtagtaaggtcatcatggtgctgatcctggcatttgagatgtgcttaaattttctaattgcaacaagaaacgcgccctttattaatcagcacgatcttgagcgctcatatcagcatgcttcacagttaatcggtaaagttgaacagcgcgaacagaataagaaccgattttaccgaatggtcgtcatcgatcagccgtttcgagaggtttttaatcgccccaatatgccatatagcggatataacgatgcacttatttttcataatcggggggttagctcttatagttcaacattaaactcaaatacccatcatgtcttagcaagcttgggtttttcaagccgaaatattcgtcggattgatatgcttggaggatctgtaatcaccaaccatttatttgggatcaggtactattacttaatcggaaaacaccagaatcggttaattgttaggaaaaatgcagctcaactgggatttatggtgaatgatcggatgcagcatttgaaatttaaacgtggtcaggttttcgacaacctgaatcgttttgttcaagctgaggcgggggattctggtcactatttggagcagcctcaagttaccagttatcaacaaaaaacgtttagagatttttatcaatataaaatgaaaattcaagcaacgacttcggggcctcattacctgtatatccctcgtgtgcggttgcatggcgttaaaataattgttaatggtgcagtcctatcttctttatatagtgggttaggaactgaaatgattccgttgggatatttacaaaagcatcaggtggcaaccattacattgcagtctgtaaagcagttaagaaaaccgacggaggatgttgccgggattaatatcgctaaatttgaaagagtggttcaactgacagaccagcatcaatttaagttagacgatgtgaatcgattaaatgaacatggcggtcattttcggggcgttgttcatgttggcaaacgtaaccgaacacttttgctgagtattccatatgatcaaggatggcaggtacgtgttgatggcaagcaacatccaatcaaaaaagttgcctcaggtctgattggtactcagttaacacccggcaagcatcgtctggcctttaattatcatattcggggcttattagcgggggcattcttgtcatcctgtggattagttttaatgctcggatcaattattttgagaatgaagcgtcataatttgtaaaacattttcatagaataactaattggttattcaaagtcatcataagaatcacaaatgtaatcacctgacaaaatgggaaccataagcgtatttagtatgtaatttcacaattacaaaaaacatgaaataaatttacacatatcacttgcgaaaattcttttcaaaatatataatatctaagtaaggttgagtagaaaactagtatataagatgaaagaggtatgattacttatgcaaattggtatgattggtcttggaaaaatgggtcttaacttggttaagaacatgattcgtaacggaaatgaagttgttgcatttgatttaaacgcagataatgttaagttagctcaagaagccggcgcaacgcctgcctcgagtaacgctgacctggtaagtaaattaagcgcaccacgcactgtttggattatggttccagccggcaagccaaccgattcaacggttcaagaactcgttggacttctttcaaaagatgattatttgattgatggtggtaactcgttctaccaagattcaattcgtcatagtaagattgccgaagaaaaaggcgttaacttctttgattgcgggacttcaggcggtaaggacggtgcccttaatggcggtaactttatgatcggtggtccaagtgctgaaaaattcgaacacttagtgccattatttaacggcatttcattagaagacggctatctttataccggtaagccaggctcaggccattatttaaagatggttcataatggtatcgaatatggaatgatggaagctattggtgaaggctttgacgttttggatcacagtccatatgactatgataatgaaggagttgctaaagtttgggttcatggttcagttattcgcggctggctcatggaattagcccaagaagcttttgccaaggatgctaacttggatcaaattaccggtcggatgttttcgtcaggtgaaggtaaatggacggttcaagaagctctcaagcaaggaattccggttcccgttattactgattcgttgtatgcacgtttgcgttccgaagaagaagatacgtttaccggtaaagttgtctcagcgctgcgccacggatttggcggccatgcgatggatatgaagaagtaaacagaaaagcgtcttgatttcagaataaaagtaaacaacccgggtatctctaaattttagaggtgcccgggttgtttacttttatttgattttgaaagaaatacttgtataacagattattcaatatggtgacgaaattttcatgacatcggtaaaaagcaaaatgaatgcaatctataaagtggataaagtcatttttgataaaagtatgtggcccccttgtaatcaaagtaaagcccggataaattacatgtgatcatggaaaaacattatttactgacggtgttgaaagcgctacctttttgtgctatatttcttgtatactgatgtattagttttagctgatgaaataccatgtttaaattcatcgattttgggcattgctcagataaaagtactagtcgcggataatttgaagtcaacacacttttgaaataaatatatagggggaacaaaaacatgttatatccaattacaactgatagtcgaaccgttcttaacttggatggcacttggaaatttatgattgatcatgaaacaacaccaattgatcctggtaaacctttaccaaccgagaccgtgatggcggtgccggcatcatttaacgaccaaactgctgattccgaggtccgtgaacacagcggcttcttctggtatcagcgtcattttacgattcctaagactttaaaagaccaacgactggttttacgattcggatctgcgactcatgaagcttgggtttatttaaacggtgaagaaattacccatcacaaaggcggttttacaccctttgaagttgaaattaatgatcatttaatcgatggtgataatttgttagccgttcggttgagtaatattcttgacttcacgacattaccggttggcaattatagtgaagaaaaggacgctgacggccacactgtacgcaaagtcgacgaaaattttgacttttataactacgctggattaaatcgaccaattaaaatttattcaacaccgcgagcccacattgatgatattaccgttgttcctaatgttgatctaaaaaagggaacggctgacgttcacttagaagtcaaaacgggcggcgaaaagtttgacgaaattagaacaacgattctggatgaatctgggcaatcggttgctgaagcgactggtgccgatgcccacgcattgattagcaatgtgcatctctggcagcctttgaaagcatatctttatacggccaaagtggttggcgtgactaatggtgaaatcgtggatatctacgaagagccgtttggcgtgcggaccgttgaagttaaggctggtaaatttttgattaacgggcaaccattttactttaaaggatttgggaagcacgaagatacttatgtcaacggaaaagggttaaatgaggccgttaacgttcttgatattaatttaatgaagaaaatgggtgccaattcatttaggacatctcattatccatactcggatgaaatgattcgtttatgtgatcgcgaaggaattgtggtcattgaagaaacgccagcagttggcttgatgctgtcgtttacgttcaacgtttctgaggtaacaaaggatggctatcaggatgatacttgggaaaaattaaagactgccgaagcgcataaacaagtgattcgtgaaatgattgatcgtgataagaatcatgcttgtgtggtgatgtggtcaattgccaatgaagctgctaattattctcaaggcgcccacgaatatttcgaaccattatttaaggaagcccgtaagcttgatcctcaaaaacgaccactaacctacgttgcgatcatgtggacaagtcctaaatccgataagtgtacagacttggtcgatgtgattgctttgaatcgatattacggttggtatattgataatggtgatttgaagatttcggagcagaaaactagagatgagttgaaggaatggcaagctaagtatcctgataaaccaatcatgtatacagaatatggtgctgatacgatgcctgggttgcatagtaattatgatgagccatggtcagaagaatatcaggaagattattatcgaatgaacagcaaggtctttgatgagattccgaactttgttggcgaacagttatggaactttgcagactttcagacaaaatttggaatcaaccgggttcagggtaacaagaaaggaatcttcacccgcggtagagaacctaaagcagttgtccgatatctaagtaaacgttggaattcaattccagactttggctataaaaaataattggagggtaagtcatgaaatctagtcgaaaaatagttggaattaagcctaatcaaggctatttaaccgttcagacggacggcgcccagtttcaaatttatttgttagatgataatattattcgaattcgtgggacgtttgccaaaagttttgcaccggaagcctcttatgcacttgttaaaacggcatgggacgatcaacttgacgatctgtttaaggatgagcgcgaacaggtcacaccacttccaatccagttgactgaaaatgatgacgagtatcttgtccctggccctaagtatgacttgcatattgaaaagaacccgtttggatttaaaattacggataaatccggcaatgttgttcatgaagacctgcctaaacgctcatttctacaagatgataatggccgatcatttcattattcacggatgggagatcataattacttctacggctttggtgaaaagtccgggaaactcaataagtttaaacgtcggatgcgaatgcacaataccgattcgttgggctggaacgcggccaaatccgatccgttatataaaatgattccgttctatattgatttagattcgcagcagaacatggcatccggaattttttataacaatgcctatgattcagtgtttgatatggattgcgaacacagtaattattggaagcgctatagctatttcgaatgtgatggtggtgacattgacttattcttcatcggtggcccaacggtcaaagatgttgttgaacattatactgatttaaccggtaaaagtgcgttggcgccccttgcatcgtttggctatatgggatcaacaatgtactacactgaattggatcaacactcggatgaagcaattttagattttgttgatacctgcaagaaaaatggtattccttgtgatgggttctttttatcctctggttatacatctggtaaggatggcaagcggtatgtcttcaactggaacaaacaacgcttccctaatcccgatgattttgttaaggaacttaaaaagcgtggcgttttacttgctccgaatattaaaccgggtttgttgctaacccacccgtttatggatgaatttgaaaagggcgatgcgtttgtcaaaacttctgatgaaaaaggatttgaaacggatcagtattggggtggcgatgcgcattttattgatttcaccagtgaaaatggtcggaatacgtggaatcgatttatgacaaaagcattattgtccaaagggattacgtcgatttggaatgataataacgagtatgaaattagtaatggggatgcggtggttgacgcggatggcttgaagaagccgattaaaagtttgaaaccaatcatgccaaccatgatggctaaatcagctaagaaggcgattcatgattatgatccaaatattcgtccttacttgattaaccgagctggatttgccggtattcaacggtatgcccagacctgggctggcgataaccgaacgagttggaccaatgtgaaatataacgtaccaactgttttgggaatgggattatcaggcgttgcaaaccaggggtgtgacattggcggatttgatggtccggcaccagagccggaattgtttgtccgatgggttcagaatggtattttccaaccaaggttctcaattcattcttcaaacacggataatacagttactgagccttggatgtatccagagtatacgtcgtatattcgagatgcaattcaattaaggtatcggctggttccgtatttctactcacttttatttgaagcatcaacgaagggatcgccaattatgagaccgctggtttatgagtttcaggatgatccaaaagtgttggaggaaagcttcgaattcatgctggggccttcgttactgattgccaatgttcttgacaaaggtcaaacaatgaaaaaagtctaccttcctaaaggggcggactgggtcaacttagctgacagtcaatattatgagggcggtcaaacgattgagttgccggttgatctgcatagtattccaatgtttttaagaaccggtggcattgtcccaacggcgcctcatttgatgaatcttcataaccagtcaattgaacagttaaatctgctgattgaaccgtcagttggggcatccttcatgttgtatgaggatgatggtaagacaaatgattaccaaaagggcgattatttgacgacaaaatttgcagtttcaagttctgatgacggggttgttgtggatgttaccaataacggtacgtacaagacaagtgttcagaaactgcagctggaagtaatgtgcccggatgtggcgccggcgcaagtgtcggttgccggaactgaaattcagcaattcttgaatcatgaaaaatttgagaaagcggatcaaggatggttctttaatggcgaaaaccgacgagtgatcgtaaaattatcgcgaccagaagagaaaaagtatcaaattcatttgaacttcgcggtgaaggatttgatttctatttaaaaagagtgggctaaagagcgcttaggctccagaatataagccaagtaacgccatattcccgaacctggaatgtggcgttacttggcttatatggccggagcctgctctttagaccacgtttcagctaaataacagctgagggaacccatattcccgaacctggaatgtggcgttgactggcttatatggccgggagctgcttcttagaccacgtttcagccaaataacagccgggacccatattcccgaacctggaatgtggcgttgactggcttatatggccgggagctgcttcttagaccacgtttcagccaaataacagccgaggacccatattcccgaatctggaatgtggcgttgactggcttatatggccgggagctgcttcttagaccacgtttcagccaaataacaatcgaggacccatattcccgaatctggaatgtggcgttgactggcttatatggccgggagctgcttcttagaggctctttccatactctagtgaaattttgatgatgatttttaaacttcaaactgaaaacgaaataacctggcaagttcaaacaattttcacctgatttaattttgagttatcacttcaccatggaaagagccttcttagaccacgtttcagccaaataacaattaaggacccatattcaacctggaatgtggcgttacttggcttaaatggccggagcctgctctttagccaataacactcgaaataactgaccaggcctacttttcaaactgattgtttcgacccaatgatatgtgcacataattaaacggaagggtgattatcatgtcagttccaaaaattgaaaaaatgatggtatatccagttgccggatatgacagtatgttactaaaccttagtggggctcatggcccattctttacccggaatattgttattttagtgacaactgaagggcagatgggagtcggtgaggttcctgggggcgaaaagattacagatgttttgaagcggtcaaccccattggtaattggcagttcaattggcgactttaaacgggtattgcaaacagttgagaacaaatttcaagcgttagatgcaggtggtcggggtaaccaaacgtttgaccagcggatcacgattcatgcagttactgcgattgaaaccgcctttcttgatctattaggcaaatatcttcatgtgccggtggcggcattattgggagatggtcaagttagagaaaagatagatgttttagggtatctattttatgttggtgatcgatcgaaaacggacttgccgtatattcaagatgatgatcagaccgatgactggggacgcattcgccgtgggccggcgttaacgcctgaagcaatcgttcgtcaggctcaagcagcttatgaccgctatggttttcgcacctttaaattaaagggtggtgtttttaacggagagcaagaagttaccactatcaaggcattacatcagacgtttccagatgctcgactggatctggatcctaacggcgcctggtcgcttgacgaagcaattcgatatgccgaccaacttaaaccgtttttgacatatattgaggatccttgtggtgccgagaatggtttttcgggacgagaaattttgtcggaatttcaaaaggcaacctttattccaacagcaacaaatatggtggatactgactggcgtcaaatgcgacatgcaattgccctgaacagtgtttcaatcccattagctgatccccatttttggacaatggcgggatctgttcgagttgcccaattgtgccatgaatttggccttcattggggaattcattccaataatcattttgatatttcattagcaatggctgccaacgctgctgcagcggcaccgggtgaaatatatgcaattgatacgcattggatttggcaagatggtcagtatctaacgaaaaatccatatcagatcacaaatggtcagttaacagtttctaaacataacgaaggactggggattcagattgatttagatgcgataaaacgggctcaccagctttatgttaatcagcatcttggtgctcgggatgatgctaaagcaatgcaggcgttaattccgggttggcaatttgatccaaagcgtccggctatggttcggtgagaaacagtttaactgatccagtaacgaatctttattatttaaagtaagatattagagatcaaacggggctgaggcaaaagtaattttgtccagtcccgttttttgcctcactcttctttttgattagagaaaacgccaagacgttaaatagctaggccgtccttgtcttgtttaaagagtttccaagtcatgatcacgcaataaactaaagaaattgcccaagccaatgggtttgaatagcaaatagcagtgtacccggcggcacctaatgcaaaaaggctgccaattgaccttccaagtaattcaccaaatccagagacaatggcatataggctgtgcccccatccctgaagggtgtttctaaaaatcatgagcaatccatgaactggaaagaaaaatgaaatgattgtgagatattcgttggctttagtaactgtttgcatagaaccggttcccaagacagcagttactaatgaagtctttgttaaattaataatcacaaaagctgctactgagtaaataatttgaatcatcaccccatttgaaatcccctgtttaattcttttagcgtttttggcaccaaagttttgagcctgataagttgccatcgctgccccgacactttccattggcaaggtaaacaattggcggattttgtcagcggcagattgggcagccatgatatttgagcccagccgattaatcgcgtcttgcatgataatggcaccgattgctgaaatcgaatattcaaatcccatcggaatcccaattgcagtcattttacgaattgccttgggagccgggcgccaactttgacggtcaatagttagccggtgtttcccaaacaaaaagggcgttaagttaagaataccgccgatgaactcactaataacggttgcccacgcagcgccggcgattcccaaatgaaaattgataataaaaataagatcaagaatgacattaataactaatgaaataactaaaaaatggagcggatgaatcgcgtcgccaaatgcgcgcaaagccgccgccgaatagttgtagagaatgttagccggaattcctaaaaaggaaatgacggtgaatgtgactgctgttttgaaaacattactgggggtatttagaagcttcagagcaccagaggcgccgattatcataatcggtgttaataagattgccatcgctaaacaaatccaaattgcatttgtaaaaaaggttttggtagcttgctgatctttagcaccgacactttgcgatagtgggatgctgaaaccaatgcagctgccttgaatgaagccgaggactaaaaagcttaggggataataggcaccaactgctgcgaccgcgtcaataccaattagtcggccaacgattaaagtgtcgataaaattatatagttgttggaagagggaaccaccaactaatggtaaggaaaaaagaattagtctggttaatggatttccctttgtcaaatcaatttgattcatgcggatttttctccatttatttttaaataatagaaaacgattacaaagcctatattacgggagatgttttgaaccgtcaagaactggtatattaaaattgttaaaacgtccgatatttttagtaaaaacacactaaaaaatagtgtatttttttcattactaacttttaacagtgacacattaggatttcttctaatcgaagtcattaaggaactgatatattcgggatacataatagatatactagatttgacggattttcctattatttgttgcttttaagcaagatttattttttggaagaaataaacaatattaaatcatatactgctgatattaccgatttacagctttcctaaagcataaatggatgtgaaaaaagtcaaaaactattttttaaggggtcttgtaaacgcaatcatttggtgttattcttttagtaacttatgtatcagtttgaaggagggctaatgtcaactggtcatttggaatgtaattctgagtgtttattaaatttaattttgtaagcgcttaagctgttgatatggatttgcaatattttttataatttttagaggaagtggcatacattggataaaacacaaaagacaattattacatctgacaagccttttaatattaaagataaaattggttacatgtttggagacattgggaacaacttttcatttaacgttgttaactcgttcttaatgattttttacaccaacgttttgggattaacgggagcccaagtcggaatcctgttcattattgcgcgattcgttgatgccttcgctgatattactgttggtcgattggttgataatagtaagcttcataagattggtcgattcaagccatggattaacaggatgaagtacccattattaatttcactggttctgctatttgtcccaatcgttaaagattggtcattaacttatcgtttgatttatgtgttcatcacatatcttgcatggggaatcttctattcatctgtcaatattccttatggttcaatggcttcagctattagtagtagccctaacgacaaaacatctttatcaacgttccgtgctatgggttctgcattaggtagtgcaattactagttacatcattccaatgttcatgtacgttggcgcttcacaaaagatctccggtaaccgtttcttctgggtggttgtcgtttgtgcaattttaggttatgtttgctaccagttgacgactcatctaacaaccgaacgggttcgaactgaaaaaagtgaaaaagtaccaatgggtcggttagttaaaggaatgcttgaaaaccgggcattgatcatcttagttgtcgttgatttgattttggttgttaaccagaacctttcaggaactttaatctcatatctgtttaatgattatttccaaaacaaagccgcaatgtcattagccttgattattaactttgcaactgttttgttacttgcaccatttagtaactggatgactcaaaaatttggtcgaaaagaatgtacggtcacagctttgatctttggtgccattgtttatggtattctgatggtcactcatacgcatagtgctgcgttctacttgattatgttagtccttggttcacttggtgccggtgtctttaacctgatggtttgggcattcattactgacgtgattgataaccacgaagttttaaccggtgttcgtgaagatggtattgtttacggcgttaactcatttgctcgtaaggttgcccaagcaattgccggtggttttggtggtttcatgttgacggcgattggttatatttcatcaacttccggtggtgttcaacaaacgacccaagttgttgatcgaatttactatttagcaacgggtgtgccaaccgtttgtcttgcattggctgccattgtgttaattttcctttatccactaaacaagaagcgggttcttgccaacgcaagcaagcttgaaaagattcatgaggaaaacactgaggatgaagagaaataactttctttaaaaaataggttaaaaaagtttttaaaataaaatgaggttcaaaatcaatcaaatcgattgattttgaacctcatttttttaatgacatataatggtaattaatcttgctcataattttggaaataatcggagtaagcatcaagtactttcttactttcgattaacattagatgaagatgctcgttcactaggtattcaagatcatcaatgtctttatcaacaacggcatcaaaaatcttcttatgctgattgtaaatggtgctccaatttagttccatttctttaagtcgtaatcggcggaatcggttgagttgggtattgttaatttgcagccactgccagacagtttctttattaacgaccttgtaaaattcatggtgaaaatcctgatccaaatcaaaaaagttgtcgggttggattttatcagccgtttgggcctgtgaatgaagattggcctttaaggtatccagtgactcgtcagaaatgttaacggcggcattgatcataatttttggttcgatacattcccggacaaatcgaccatctttggcatctgccatatcaattttggttatataggtcccactctgaggtatcacttcaattaggccttcacgttcaattctgatgattgcttctctgacaggtgttcgaccaaggcctaactgttcagaaattaacttttcagatatcttttgtcccggtatgtaatcgaagtggataattttgtattttatttcgttataggcgtcactacgcatattatccatatcataatctcctttaattattcctacagtttatcatacgattatccaaaagttaatgcaattttacttaacgttaaaaggtgttgacaatctgatatatcagaatataatggtattgaaagcggatacaggttactagtgtatcagtttttgtaaaaggatgcagattggattttaacgaccagttgcactaggagggtatgttaatggtaaaaattactgataactatttaactgataagaaagcatttacagacgcaggaatcaaggttccaagctatgatattaaacaaaaaacaggggctactcgctgggttcatttcggcggtggtaacttgttccgggcgttccacgccgcaattgcggatcgattactagaatctggtgatctggatgccggaattgttgttggtgaaacccatgaccccgatgttgttaaaggtgtttataaacaatatgacaatcgaattttgcgggtgattacccacgaagatggtaagtttgaaaaggaactgtttgcttccgttgcggatgctgacttctttgatcagggcaaccccgacggctggaagaaaatgtttgcaatttttgaaaatccagcccttcaattagcaaccttttcaattactgaaaagggatataacctttgggacagccaggggaatctaattcctgtcgttcaagaagatatcaaaaatggtccggaagcaccgaagaataatatggccagtttaacagcactaatgtttgctcgtttcaaagccggcaagtatccaatggcacttttgagtactgataacttctcgcaaaatggtgaacggcttgaaaagagcgttctgacaattgctgagggttgggaaaagaacggcttagttccgacagaatttgttgattacttaaaagatgacaaaactatcagcttcccactttcgatgattgatcgaattacgcctaacccttctgatacagtttcagagcagttaagcaaagatggttttgaagattataagattctgcatacaccaggccatacgaatattgcagcatttactaataccgaagaggttcattacttagttgttgaagacgattttccaaatggtcgtccggctcttgaaaaggccggtgtcattttaactgatcgtgacacagtcaatgatgctgatgaaatgaaagtgacaacttgcctgaatccgttgcatacggctttggcagttaacggtagcctacttggttttaattcgattgctaaagaagtcagtgatcctgacatgctgaatttaatcaagcaaattggttacattgaaggactgccagtcgttaaagatcctaaagttattaacccaaaggaatttatcgaccagttggttaacaaacgattgccaaatccttacattcccgatatgccgcagcgaattgcttcagatacctcacagaagttggcggttcgctatggggttacgatttcacattatgtcaacgatcctaagcgtaacccagctgacttgaacttcattccactagttttagcaacttggtgccgttatctgatggcgatcgatgatcagggcaagccatttacaccaagtccagatccattgttatctgaactccaacctaaagtcagtgacattaagctgggtgaaaagactgatgttcatgcgcatttgaaggatatcctttcaaataagtcaatctttggtcatgatctttatgaagttggccttggcgaaaaggttgagaattattttgcctcacaaatcagcggggtaggagctgttcgcaagacccttgaagatactttatcaaaatacgcaaagcaaattaattaaaggggaaagataaacgatgacattattaaacgatgacttcttattaaccacatcaatggccaaaaagctgttccatgatcatgcttctaaaatgccaattattgattatcattgtcatttggatccaaaagagatttatgaaaaccgaaactataagaacattacccgaatttgggttaatgatggtagtgtcggcgaccattataaatggcgattaatgcgagccaatggcgttcctgaaaagctgattactggtgacggtgatgattatgataaatttattgcttgggccggcaccattgagaagtcactgggtaatccgttatatgaatggactcaccttgaattgaaacgtttctttggaattgatgatatctttaataaaaggtcagcaccggcaatttgggaaaaggcaaacaagctacttcaaactgacgattttaagcctcgtaatttaatcaaacgatcaaacgtcaaggcactctgcacgactgacgatccggcttctgatcttaagtatcataagttattaaaagaagaggaagaccaaaacggttttaaagtattgcctgcaatgcggccggataaggcacttcatttaaccgatgacacttatggtgagtaccttgatcaattgtcagacgtttcgggcgttaagatttcatcattcaagacattgatgagtgctatgcgtcaacgatttgaatatttctcaagcatgggcggtaagttatcggatcatgggcttaacttcttccgatttgctaaagcgactgacgctgaacttgatcgcattgttgagaaagctcgcagcaataaagctttaaccgaccacgaaatcgatcaatatcaaacgatgttgattgaaagcctcatgaaattgaataaagaatttaattggacgatgcagttccatatgaatgtcattcggaacgccaacaagccaatgtttaaacaatttggtgctgatggcggttttgattcaatggggacgcaaccggatattgcccaagaattcatgaagttattgatcgatatgcaaactgaaaatgagattccacgagcaatcttctattcattaaatcaaaatgattggttgcaattagcaactggaatgggtgatttccaacaagatggtgttcaaaagcttcaattaggctgtgcatggtggtttaacgatacatttgacggcatgaagaaacagttaacgatgatggctgagcaaagtctattgcctaactttgttgggatgttgacggactcacgaagcttcttatcttatccacgtcatgagtacttcagaagagttttgtgcaacgtgattggtgaatgggtccaaagaggccaggcgcctgatgacgaggactatctcggtcaaatcgttgaagacattgcctacaacaatgcctatcatcaattccatttctttgataaggactaaggattctcagaggaggataaaaacaatgcaaaaaatcagtaatgatcggttctctgctgagattgatgagcacggtgcccagttaacccatttgattaataagcaaggcggttttgactacatttggaataatgatatttgggagaaacatgcgcctattctgtttccggcaattggtcgttcaaatgacgatgcttatttaatcaatggcaaaaaatatgagatgccacagcatggttttgtcgccgactttgattttgtcgttgctgaaaagactgacagtgccgtctcactactattaaagtccagtgatgccactaagaagtattatccctttgattttgatttcaaagtatcgtttagtctttctgagaatggtctggccgttaaatttgacgttaaaaatgacgatgatcagaatttgtcatactcactgggttatcatccagcatttaacgtgccaattaatggtgaaggaacatttgatgactatcgactggatattgaacctaaaatcgactccctagagacttatgagatcgtcaagaagcccaatccttatcgaagcgggaagattgaacagttgccaaactacgagaatgggacggttaagcttgatcacgccatgtttgaaaagggattattgatcattgagaatactgggattaagtcagtcaagctttattctaaggaaactaagcatgctgtaactgttgacgtatccgactttgatcatattactttgtggacaaaggaaggtgctaatgcgccattcttatgtattgaaggatttaacggcttaccggatgtctatggcgaccttgttgagcttggatcaaaggaaggcaaccatcatcttgatgccaaagctaccagaagctatgaatgtgacattaaacttgattaaaaagactttgacaatggttcgacaaagaactagtatatcagtgtaaacaattaatcatctaaaggagagtttgagatggaatataacattgctgttgttaactcaagcagttttggacaaattttcacagagcattggcaggaattagaaaagattggtagcgttaagcggtttatgctgccaaccgacattgatggcaagtctttagctgagaagcttcatggctacaacattattattgccagtgtgaccccattctttaacaaagaatttttcgataacatggatggcttattattgatttcccgtcacggaattgggtttaacaacgttgacattaaagcggctaaagaacacggcgtccaagttgctattgtgccgcaacacgttgaacgaaactcggttgctgaaaatgaattagctaatttgatggcattggtccgtcgagttgttccgtcatcagaacgtgaacgtgccggtcgttatcaggatcgggctcaatttatgggtaacgagttcagtggtaagacatttggtgtgattggctgtggaaatattggtagccgagttgctgaattgttcagcatttttggtggtcctgtgctggttaatgatccggatcctcacgtttcgggtgaatggctaactaatcataacgtggaacaggttgatctggaaactttattaaagcgttgtgactacatctcattgaatgcttctttaaatgatggtaactatcacttgattaattctgaaacaatcaagaacctcaaaaagggtgcttatatttgtaacaatgcccgtggtgctttggttgaagaaaaggcgatcagtgatgcgattgaaagtggccagctttctggttacgcagcagatgcaatggaagttgagccggttccggctgatcatccattcttaaagaacgatcgcgttattttgacaccgcatacctccgcatacacgtatgagtgtttacatggtatgggtgagaagtgtgttagcgacgttcgaaacattgttgccggcaagcgaccggttcgggaacttactcacacgattgattaaacaatccgaattattttttgaacgatctttaattggatgagaacgattgctaaaagggaccgaggcaaaatttacttttgtcccagtcccttttgctgtagattgaaggcaacacgatccttgaattaataacaatgaaagcgctattgacaatctggtatatctgatttaatattctggtatactagttattgtaagaacggagattaacattatggattatattattggaattgatgtgggaaccaccagtacaaaggcgcttctctatgataccgatggcaaaatttatgcaaaggccaataaaggctacaccctgtatcaagacactcctgatatggcagaagaagatccggatgagatttttaacgcgactctttcagctattcaagaggtagtggcaaaagcacaattaactgacggcaaagtaattgcgatttcctggtcagcccagcaacacagtctgatcgcattagataaagattttaaaccgttaaccagaacgctgacctgggcagataaccgatcggaaaagtatgcccgtgaatataaagaaaatggtcgtgggatggcaatgtatcaacggactgggttaccaattcatccgatgggacccttctataagctgctgtactttaagaatgaacagcctgatttatttaagcgaacggcttattgggttggcattaaagaatacattatctggaaatataccggggtcctcaaagaggaaatttcaatggcagcagccagtggtttgcttaatatgaagacttgtgattgggatccagaggcacttaaagaaactggtatcacgaaagatcagcttcccgagctcgttgatttaactgataagttccaagggattaaatcagaatatgctaaagtcatgggaattgacgaggatgtctatttcgtaatgggggcaactgatggggcattatcgacgattggcgttggcgccattgatagcggtgtcttagctattaatatcggaacatcggccgcagtgaggacctttgttgataagccaaggattgatcccaaagcgcggctatattgttacccaatcatgaaagggaaatacttggttggcggtccgattaataatggtgggattgtccttagctgggcacatgacgcgttatttgcttcagaagagcaggcagctaaattacttgggatggattcatatgatatgttgtcaaaaattgcagcaactgtcccggctggttctgacggcctgatcttccatccttacttgggtggtgaacgggcaccgttgtgggatgcgaatgctcgtggttcgttcttcggacttaatcgaaagcataccaaagcacatatgatccgagctgtgatggaaggcattatgtacaacctttattcggttactttagcccttaaggaagttaccggcgatcccaaagccattttagcggccggtggctttgcccaatccaaactctggacacaaatgatggctgatatatttgagaatgatattattatccctgaatcctatgaaagcggcagtctggctgcgatgttcctggctaagatggcgttggggatggaggataagcttgaagatattaagaagtatttaggtaaggaaaacaaatatcaaccaaatgaagaaacgtttgcgagatatcggaaactggttccgatttacctgcgattgagtcgtgaattctcaacggagtacaaggcgatcgcggattatcaacgagagtttccgggataggaaacaaagtggggtaaaaagcggttagctcccggaatataagtaactcagccagatattccgggtttgaatatttgactgagttacttatatggccgggagctggcttttggaccacgtttccacttggtaataattaaaagagactgagataaatgagtccctttatcgaatttgtttttataaccgctttatcatatcatttatgaatgggaagatgattttttgacaactaataatgaatcaagtgaattttcaacagaattttggactgcaactgctggcgatctttcacagaagcgtgagcaaattgccacaccaaaatttggtgatgccgatcaggcagcagctaaaatcgtgattgatccttctgaaaagcatcaggattggttgggacaaggtgccgcgattactgattcagcagcttcgttgatttggggcgttttaaacaaagatcaacgggattctctgctccacgaattatttgatccgactcaggggggcttttcaactgttcgggtaccccttggatcgtgtgatttttcaagtcaagattactacacttacgatgatgtaccgtttggcgaacatgattttaagcttgaaaaattttccgttggtgagggtaagccgggggcacctgatgcgaccaaagatttgaaatatatcgtgccggtcctacaagaaattttaaaaattaatccggctgttaaaatcattgcgtcaccatggtcggcaccggcatggatgaagaatacgggtcacttaacctttggtggtcatttacgatttggtgagtttacgggaaacggctatggcaaagcccacacgtttgatgccgtttatgcccgctactttgtccgttatatcgaggcctaccaaaagttggggattccaatctatggtgtgacaattcaaaatgaaccgtctaatgcagctcactggccggcaatgatttggacaccaagtcaaatcgctgaatttgggtacgagtatcttcgaccagctctgaattcgacgttcccggcaactaaaatttacttcttggatgatagttttcatgcgttggatcagccgattaccaacaatgtcacgcctgtccaagcaagtgcctttgacgggttagcggtgcatacttacacaggaccctatccatacctgtttaacgctaaccgggcttttccaaattggcaggttattatgactgaacggcgttgcatgatggaagaaacgcctgaagatgctgcccacattatgtttggcattattgccaactggttggttcgaaatggtctgaatatgattaatctctggaatattgctttggacgaacgggggttgccaaacgcagcagattcaacaggtcgccgcggcgttgttaccattgatcatacaactggtaaagttcagcgtaatcttgagtattatatgcttcgtaactttggtcaggatgttccagttggctcaattgtcattgggtcatccaattacacgccggatggttttacgggtggcttgggatcagtagcgttcttagctcctgatggttccatttccgctcatctctataatccaactggtcagtcgttgaaagcagccgttacaattaacgggtatgcggttaattggcagaacgtgacggttccggcttggggaacggtaaccttgcataaggccaatcatgcagtgaatgaatcaaaggttcctgctgatgatcactttaagctcaacccaacaccggctaatactgatgatgtcgcgccgggaagaaaataagttatttacagttttgtcttttccacaacttttattgccaataaatctaaaagtgaaaatgtcgtttgtcacgtatctatgactaacggctttttcgcataatgacactcgtctaacgatcagaaatgaaagaaggccagcttatggcagatcctttaaatgttttgcacacaatcggtcttgatgtcttgtatccaattgttcgttgtgaaattagattttcttcaataatcaatattgaacgattaaaagaagcagttaaaaacattggtgtgattatcccagaaattttttcgtattatcaggttcaagataatacatttgtgagcttaccccataatccagatacgattgtgacgcaaaatcaagattttagtgaagacgaagctaggcacttggattttttgaaagaaccacaactgaagattattgtgtctggaaataaagtcgttgtgtttatcagtcatatcctaacagatggtgccggtgccaagcaatttctttatttactggcagcctgttataatcaacaacagcttccacttggagttgtgaatcatacagatatcgaccaaattaaatcacttcttggttctacgaagaatataatgaaccctcaggcagatcatccaaaagaggcactatcattacctaaactgcaaaattcaaaatcagttgactatgaggtgattgagtctcaattgacaaaatcgcaagtgatgaaacttcacgacaaaacccgtcaaatacaagtcacattaaatgatgcactaatggcagcgtttggtaagactatccagcaatattgtggtgtaccggacatagcactagcgtgtccaaccgatatgcgccaatttctgacggaacaagccgcaaaagaattaagagtccaaaacatgacggctcgctataactttgacattgtaagcccgacaactgaagacgtgttattagtcgttaaaaaaatacacaaccaaatgaaaaagttaaaagaatcgaaacaattccttgaatcaatccgatctttaattcaagaagttgataaaggggcgtatattggcgatcttcaaaaggaagttgagcaaaactaccatgttcgcgaaattgcttatactaattttggaattattaatgccacaaagttaaagtttgttggtttagacattgaagattgctttatgactggatcgttccgacgaatgcccatgtaccaggcagcaatcagcacctttaatgggaaaatgaccttagcagcaaatgttattggaagtggccaagaacgccaatttgggaaagcaatcttaaatcacttcaaattaatgttagtgggattaacttattgattaataagtagaaaagatgtgagcgggattggttagttacttaacttccagtcgtgctgtcgaaatttgtttttctggcacttccatgtagtaatgtggttgaactcaaaagaggtgctgggatattagtcttttttacagctatggattctaaaaatcaggtttcacatttcgttcatttagaaatgtgaaacctgatttttggatcttttgtctttgagtccaatttgcccttattgggctaacttctttagttttccaaccatcagggccgttttccatgacaatgcaccaattgaaagtttttttaacctcatgaaacgtgaatgtcttaatcgatatcaaatcaatgatgtcaatacattgcgtcaattggttaataattacgcgcaatggtttaataatgaaagaatttctagaaataaaaatgagggtgggacgaaaggcggttacgcggcaggaagttgccttttggcgcacgttttccactcggtaataatcgtgacctcatggtagcttgaactaaattggaacttgtctaacttttctattgcacttcagatcagcgtttttgcaaattgatcttacaggattttttgaaaaataattaatttatcgaattatgtcctaactacaacaaaacacgttatctagataaactatactaatttttaacattgtatcttttagctaatcaaagcaaaatagtaaggcgaattcatttgatggggattatcaattaaaaacacagaagactggttgcataacactattcatgaattttaaatgatggaacgccggaaacaccaacattcacccgtaatagacttccggcaaaaggcgattcttgtttgaaatcattatcagtatagtttaatgttgcagtggttaatattaaactatcttcaacaaaaatagggcaggtaacaattttattaggaaagacgatttcatctagttttttacccgtctgatgatcccaacaagtcactcgtgaaccaccccaatgagcaatccacaaattaccattgttatcgactgtcatgccgtcaggattgccaatttctccattttcattgaaatcaataaataatttttgatttgaaattgaacttgtttccttatcaaaatcaaatttataaatcaattttgtgaaagaatcaatataataaaaaatggtattatttggactccaagctaatccgttagatacgataacgttagaaagtacttttcgataattgaaatcatgatcgattctataaagctcgcaatgttcgtatccttcaaagaaggaagttgtgccagcccaaatgattccattaacgtcagctttgccatcgttgaatctatgagaataaatatcataaggaacgggtgctccaagtaattcaggttgattcttttcaaaatcatatttgtagagaccgtcttgcatacctaaatatacgccacccttatctcccaaaatgatataactatcatactttcctgcgttgtattgcttaagcttttttgtgcttaagctatattttagaaatgttttattgacaatatctacccagtagatattgttcttatctggatcatagacaggacattccccaattgcattttttaattcacatagaatttcaatattgttttttgccattattttaaattctcctttatttattgtcttgaactaaggttccagcagtttcatgaatgaaatgaagtggaataaagacaagtaagacagaaatagttaagaaaatatagttagcagtccatccccatttatcaataataaaaccaattacaggtgaaactaatgctcctgataatccataaccaataccaatcaatagccctaaacttgatccggcttgttttggtgttgaatccacagcgattgaattaatgacggcataaggtgaatttctaaagaggccccagatgattaaaataatccatcccgtaatttgacttgtgataaaaatgcatcctattacacttgcagcgaatcctactgtgatgattccaattgaaaactttcttcctaatgcatcgctgactgttccccaaacaatttgacctagccagccggtaataccagatgctccagaaatgagggcagcaacactgattgataagcctaaattatttgtgaatctgagagttaaaaaggtggcaacacccatttctgtccaaagaaacaagaaatcaatgattgtggcgagcaaaacgtttcgatttcttaaagttattgtgaggtccttaagagtctctttaaaggaacgtttttcagagatcatttcttcagtgtacggttgtgttaacttatgcttttgaacccaagtacgcatcttctgttcgtttcttttatttccaaccacaaattgtaataaaattacaatgataccaattgccggaatccaaagaaaggcatctctccaagacccatgcaaaagtattaaggaaagaactgcaggaccgacaaattgaccaatcggcatgcctgtttgatttactcctaaagcaaatcctcgattttccttttgccaaaaatcactgacaagagcaacattggctggttccattgcaccagttgataagcccattattacccgccaaaattcgagactaaataggctatgagtcagaaaagttgcaaagccactgacgattgccagcaagcaactaccaccccaagcaaaaattcgtttatagccacgtcctatgctgtctgcaattatgccaataaatgcagcgccaataaaggttccaataaaattaagtgaacttatcaatccccccattgtcgaattcaagtgaaattctttcataatcgctggtaaaacagtaggcaatatttgtctatcaattgaaattagtaacatggataaagttccgattaagagcattaaccaagatacactgtgtcctttaggaatccaagaagtttttcccccaacatttttcacgagtatctcctcctaaaatatctggcataagaacatttactaattaatcaaatgtagtatattacgttgggaaaacgttttcaacaatttcaactttatttctgctttttgctctaaaatgcttgtgaaacaaggatccataacgttcaccccaggtacctatatcattaggataacgttaagacccatttttgatgttagccaaaataggaaaaagcgttgatgaaagggttaagcagatcaattattttttggcatgttttgtaatatccagaactcaaaagctagaagacaggctgatttcttttgtttgtctcttctaggctaataaattattaactatcataattgccaagtgattgtagctgaggcaatagtccaaaatatacattataacgtcttggatttgaaacaaggatcccgtaaaatcagcgttttgaaaattgcgactgattttacgggatcttttggaagacaaccattatcgactaatgtccaaaccttctgtgatttatcaagacgtaaataatgcttagcaatttcaaagcgatttttgacttatcaacggacttgtaaatgaatgatggctttggattgaagccctgattatgtcgttgctaaaactaaataattatctggtcaatcacaattggtaatggataccggacatgacttgagcgcctgcggattaactggagtttcaacagaaaattatattgacagccctactgtagaggtaagattagcttcttataattatttgcacgaatttttagttgaatatcgatagctacgatagtgacaacgaattctacaggactgtctgaacatgatcacactccaaatcaaaaaatattttttctgatttttaaatagttttttattgtataagcttttaaattgtcattgagcaaccaatagccacgctataatttatagtttttaaaatcgaactttttcttgtttgtactaatcagctttgatcacttgttttttaaacaaaccatgtagaggaaacagctcaaaatattcttatggattatacaggtaaatatacataactttaaagactgttcatgaagtaattaacgaataaataatttttttatcgaaataatgaattcaaaatttaaaaaagcaaaacttgtgaaaacgttatcctataatccgaataagtgaaaaagactaggatccaaggccttgaaattgagccttagtatttatttcattacaaataggattccaaatacaattttgtttacgaattatacgcctttatatcaactatttaagtgaaaaatccttttaactaacagaaatactcttatattttttaacgaaatattatgtgtaaatcttctaagcaataagtgacattttagaatataggcaaacgttttcttgactttgaatctggcaaatgatatattcttgttggaagtgaaagcgtttacatttatcaattaggagggtgttattcatgaaatatattttacgaatgttgcctaatcgtgttagaagaaattatcaagggggtaaaggaatcgattggctacatggcaagaaaaaagcttctgatggagatacaccagaagaatgggtcgcttctacaatgttagctatcaatccaggattgcccttgattaaaaatgaaggccaatctaaatgcgatattgatgggaaaagcgaatatttggaagaattaattaagaagcagcctgagctttactttggaaaggaatatgttgctcaaaagggtaccgatcccggtttcttatttaaaattttggattcatcaatgcgccttcatgtccaagctcatccaacgagacaatttgcccgagaaaagatgaattctccgtacggaaaactggaatgctattatattctgcatgttcgcgatggcgtggacccgtacattaggcttggtttccagcatgcaccaacaaaggaggaatggaaaaggataattgagacgcaagatattacggctatggatcactgctttgataaagttcccgttcatgaaggagaggtctggtatgttcctggtgggatgccacatgccattggtggcggcatcctaatgcttgaaattatggaaccgtcagatcttgttgttagatgtgaatttaatcgtcatggaataattgttccaccagaagcaagattcatgggccgaagtttagacttttgcttggatatatttgattatcatcaatacagcgttgatgacattcgaaaacgatgtaacttaaatcccgtagctgaaaaaatagaggctaattataatttagtgaagattatcgacaaagatttaactggaagttttaaagtatctgatttaaaaattaaaaatggtaatgccacattgaatatttcaaagtttttggttggtgttgttgttgagggcaaagtaacgataacccacggtgatgaaagtgaaaactttaaacgaggagatacctttgtgattgcagcaaccgcggagtctgtaaagattaattcgcatgataaaccagcagaagttacctttgttgagtcaaaattgtaaatgccgttttagagtttcaaaagtactttaattgtcaaatggttttacgaattcacttccaggcgataaaaggtataccgataaatagtcaaaaaagttatggtttcattctgtagattaattaaaataaaacgttatgcttcactaataacaagagtgcttacaacacaagacgatgtcattaataaattacaactagataagatcctgcggtgttttgggatgtactgttaatttaaaactgtatgataactatttgcctaatattgcattctttgacttaacagaacattctcttgagaggtgttattactatggagaataatcaaaaaactattattacaagtgacaaaccttttaatatgaacgataagattggttatatgtttggtgatattggtaatacgttatcatttagtattgttaacacgtttttaatgatttattttactaatattcttggtattacaggggcccaggttggtattttatttttactggctcgatttattgatgcttttgcagatgttacagttggccggttagttgataatagtaagcttcatgagaatggtcggttcaaaccttggatgaataggatgcgctatccattactcatttcgttggtgttgttatttgttccatgggtatccgatttatcgtatttatctcgattagtgtatgtatttgttacgtatctggcatgggggattttctattcaacggttaatattccgtatggatcaatggtgtcttccattagctcggatcccaatgacaaaacttcactttcaacatttcgtgcagttggagctgcaacagggacagctttcatcagttacgttatccctgtagttatttatgttggtacttctaaaaaaatatctggcaatcgtttcttttgggtagttgcgggttgcgctattttggcatacttttgttattccttaacgattcggttaactactgagcgtgttcgtaccgaaaaatccaaaccggtaccactgggacaagtttttaaaggcatgttcgtgaataaagctttaattgctctggtttttgttgatatgcttctggttatatacactagcttttcgagcatcacgctttcatatttattcgatgactatttcaaaaattctactgcaatggcaattgctttagttttaaacagtgctactgttattatcttagcaccatttagtcattggattgttcgtacttggggtcgtaaaaatagtacagttgtggcattatttttatcaaccatcttctatggagcgttgtttgttatccaaacccatgatgtaacggtttatcttgtactgttattttttgcctcattatcgattggaatgtttacggtttcggtttgggcatttatcacggatgttattgatagttacgaagttcaaaccggtgttcgagaagatggtattgtttatggcgttaattcattctcacgtaaagcggctcaggcaattgcagggggatttagcggatttatgctttcatttgtcggatatgtttcatctaccaagggtggtgctactcaaacaactgaggtagttaacaaactttacgatttggcaaccggcattccaactgtattattagcagtcgccacactgatcttattatttatttatccattgaataaaaagaaaattgcagaaaatgttgccaagcttgctaaaattcatacggaaagacctgatgattaatctcttttattgatatgtaaagtgaaatttgaaagctgagaattacgctgagttggcgttcttctcagctttgtttgtgtgcagagactaagggattaaaaatgagctgattcgtttacttaatcgaaccaatctggataagatcgctttttttatctaaattataataagaataaattgcttgggtatgaaacctagcagcttagtattaggctttctcttacataatatttatgataaacgtcagctttcgataaactcagaaagtatattggtcctcaagtcgatttaataatatctgctatttagaattaatcataaatttggtacatttcgacaatatctaatagatcaggaaataaatttagtgatacctataatttagtttataatacgtatattacggcagtttgaattgcttggacttgtaatctttaaattataaaaagttatatttaattggctggtgaataaattggaaagtaacaagaaacgtaatgcgaacatgaaagacgttgctgcacttgctggtgtatctatttcgacaatatcaagatacctgaatggtcgtgcagatagaatgtcaaaggaaactgcagcaaaaataaagattgccattgacaaattaaactatgtaccaaacttagcagcaagacaaatgataacgaagtcaagctctatggtggccgtcatggtggctaatatagatgattacttttcaacagaattattcaagggagctagttcgattcttgaaagtaacggatatatcggcatgctgtttgattctgattcgagtttggccagagaacaacagttattgaaagctgtcgataatcatatgttcgatggtctcctactacagccactcacaaatgatgtccaaactatttcatcagagatgagaagacaaattccggttactctagttgatcgtgaactcgcactatctccgtggccagaagttgtcacagataattatgaagctgcgagacaagcaaccaattttttcataaatgaaggatttaaacatataattattctgtcctcaactgtaaaaaataattcaacacgaaaagaacgcttggatgggatcacgtcaattactgataactatgatctgatagaggttccagatcaatcgtataatcattatgaagttcagaaaaaaataactaacttaataaagaaagcaactgaaaagacactaatatttggccttcgggagtccctattactcgaatatatagcacctttgatgatgaacggagatattgacagaataaatgttacagtaactggattctctgataccaggttgctgagagcaattgatccgccactgaaaatgttaaatcagaacccgttcctaatgggagcagtggcagcagaaatattaattaatatgttaactggaaacaagacggatcaaaaggacaaagtagtaatacacgcaaaattaaaatagctatccatttggtggattcttattattgtccgtgtatgttcaatcctagagatcaacggcaccatgacatctattttcgatcgtaaaaatcaggcttttaagtattaaatagccctttaaaaattacgcaaacattggtaatttttaaggggctattttgagctaattgatttggttaaaaaaggctaatattctaaacgcttgcagccaccaatttttcatgcatataagttttaatttggtcaatggtgattaatggcaagccccattctttagcgtcttgggctaaatcatcgcgacgggccatatgaccatctgtcttaataacttcaataattgcggcgacaggtgctttaccacatagtttagcaaggtcaactgaggcctcggtatgaccgtcgcgtgaaagcaggccggattctttggcgatcaatgggaaaacatggccgggatggttaaaatcggttggcttggcatctgcagttgccaaacgtttaattgtggcagcccgatcaaacgcagaaacgccggttgtcacaccagttgcgtgatattcaccatcggttgaaatggtaaatggggtctgattgggatcagtgctatgttccaccatcattcgaaagccgagcttttcagcaacttttggactcatcggggcacatagaagtccttttgcgtgaccaatcatgaaattgacagtctcgggggtaatcgtttcgcccaaagtgacgatgtcaccctcattttcacggttttcattgtcggctaagataatcataccgccatttttcaaagtttctagcgccttattaatatctgaaaaaatgcttgccaaaagaatccacactcctaattttatttataaggaagatggccatcgttcacttacaactattaaaatacatacattttcatgaaaagtcaatgaaaattaaaaataaggcgaactatataatagctatttcactatatagttcgtataatctcaaaaggttaaggatggttcaaccaaattttcaacgataaaatatctcaattatgtggactagtgagctgaaacgtggcttaaacaatgttaaactgatattggatacgttttcataaggaaaaattcatttacatggaggtaccacgctatgtccaaagtactgattgttaacgcaggaagttcatcacttaaattcaaactgtttgatatgccaaaggaagatgtgcttgctgacggtgaaattgaacgattaaatatgccgggatcaattgtgaaggttaaatacggcgatggtcaggtatacaaaactgttgaagataatattgattatgaacgttcggccgcaattatgctgaacgggttaaaggatttaggaatcattgatcatctacatgaagtcagcgccgttggtaatcgagttgttgcaggcagcacgcattttgataaggttgccaagattgatgacgaggctttgaactggattgttcaactaggtgaaattgccccaatccataatccggttgaagctgaatacatcaagattattcagcgaattttaccggataccgatcaatatgcaatttttgacagtgccttctttaaagatgtgccagaggtgaatgccatttatgggattccatatgagctgacacaaaagtacacaatccggcgctacggtgagcatggtatcaatcatggctatattacccagcaggctcaaaagttattggggtatgatagcgcgaaactagtgacactgcatttggggtccggcgcatcagtcgccgctgaaaaagatggtaaatgtgtcgatacctcaatgggatttaccccgatgaatgggttggtcatgggaacccggtctggcgatcttgacccggctttggtcccatttttcatgaaacgaatgggcgccagtgccgatgaagtgatggatatgtttaaccatagatcagggttacttggcgtttcgggtgtttcttctgatatgcgtgaccttgaaagttccgatgatgaccgggctaaattagctttggaaatgtttgtcaaccggacggtaaaatacgctgccggctacattaccgaactgggaggcgttgatgctattgtcttttccggtggcattggcgagcatgatcagtgggtccgtgaccaagtttgcaagaagttggaaatctttgggattaaacttgatgatcagttaaataaaaaacaacagccaggagatttgagtacgaaagagtcatcggctcgaatcttcttaattcctgccaatgaagaattggcgatggtcagggatgttgatcagagcattcagaaatagagtgggtcagcaagcgtttagaccccagaatataagccccctgacttgatattcccggttttggaatattaagtcagggggcttatatggccggggtctgcttgctggcccacgtttcggctaaggacaaagttcaacgagatattcccgattttggaatgtcaagtcagggggcttatatggctggggtctgcttgctggcccacgtttcggctaaggacaaagttcaacgagatattcccgattttggaatgtcaagtcagggggcttatatggccggggtctgcttgctggcccacatttcagcaaaggacaaagttcaacgagatattcccgatttgaatatttggacaatccgcttacacggtcagaagttgcgttttactcggtaatacttgtgtttacactaacggaaactggacaaagcaattattatcccagtctctagggttcagtgataattagactgattcaaattgttttaattcgtgaccaatcgctttgctaacgagttcgttttgaagtcgttttaattgcttaggttgttttaacagcttggggtcttgtttgattttagctgttagtttggttttaacctgagcttgcagtttggtttgaaatgattttgattttagtttggtgaccgcggattttagttgctgtttgctcaagacagtccaatcttggtcaagctgataagtcacaacctgcctttttaactgtccttggctagtgacaccgttaaaaagaaatttcatcaatgaattagcataatgatactgggtgttggtggttagcagctggttgggattgtcggcacttttttggatcacgacctttttgtctttgtttaagattaagttgagcttggaactatttggtttcttagttgcgaacgcggtgtagtgagtctttccctgcttgatcgttttgacgatcataatgtgattagcatgaatgctggcaacaggtttgatttgtgatatttgggtatgtttgtcggttgttgttccaaaatgagattgtgaatccagcagtaagcccccttgaactaacagaagtgcaaaagttgctatgatgccaatttgttgatgctttttgtaaaagctgactccaatgataacaaccaatagtattgtgattaaaagtaacatcatttagccttctttccgatccggttggtaagaaacatggctgggatgacacctaacaaagtaccgatacttgtccagataaaggcgacctgataggcgttgctcatcatcccggttgtagcaatgttattaccaacaatgctttggatgacaccagctagaactgcggtggcaattgaaccgccgatattttgggccattcgagtgacaacggttgcttgagggatgagtttgggtgccaacccggtgtatgcatccgacatcactgggattgtcacgccactgcgggttagccccattaggaacagagtcaacaagaccagccattcagaagtttttgccgtgaaaaagacgaacggcagcgtcgtaaccgcgccacccagcattgaaacgaccacaacccatcgggcacccaattgatcggttaaacgaccagcaatggttcttgtgaccaacataccggcaccttgggcgattaaataaatccctgtccagatgacacttaaatggcgaatgttctgaagataaagtgggaggacaaacataacaccattgaccattaagccggataggaaaagtaataaggttgaagcggagaaagttgtactatgaaatagattggtgggaattagaactttctttggccgtttaaaggcataaatgacataagccagtaggcagtcgatgccaataaaaatggggaacagtactgacaatttgccgaagatgttatcagcgctgtaattagtaattccgacgatgatgccggcaaatgtgccggcaatcaatccaaaccccagaaaatcaaaggatgctcccttgtgggtggggatgaactttggcagactgactgatgaaagaatcagggcaatgataacaacggggacgttaatgtagaataaccagtgccaatttaaatacctaatcagtgcgccacccacagtcggtccgagaatgggtgcgaagataatcggcaggccaataacagacattagactgccgagattttgtcctttggccgcccgaattgctaatgcgctaaccccggtgatgatgacgccggctgcagcaccttggatgattcgaccgataacaagcgccgacaccgaggtggccatcccggatacaattgacccgatcataaagatgataagcgaaatttcctgaagcaactttccagacatttggtcaagcagccagccggctagtgggaccgctaatcctaaagccaggacgtaggcagttgcgacccactgcattgtattgacagttgaacttaagtctttcaaaatagtattgataccaacgttggtcatagttgtgtcaagcattggcgccagggcacctatgaccaaaatgagtccaactcttgcgacagaagggctgcttgatgtttcgttaatggtttcttctttcaatttgtttcactcccttaaggtactttaagtacgctaaaagatactactaccttttttcaagatgtcaacaggaagggatgaaaaatagtggctgaaaataaagtgcatcgacgacgtggtaaagcacttgaagacgcgatcttagatgcaacctggcagttgattcaaacaaccggatacttaaatatgacaatggatgatattgctaaaagtgctcacacgaataaaaatgcgatttatcggcggtggaagacaaaattagatgttgggattgcggcgatgagaaaaaatgtcccgtttcaaaaattttatttgccggataatgggaacctaagagcggatttgattgaattactttctgaatcagtgccaaccgtacatttaatcggaattaaaaacattaaggaaattgcccgagatgcttttaaaacgataaacgaacccggggggattaatgtcaagcaattctcaacccatccagatcagaccccttcagaagggaacttcattacccaaaatctacttaaaatcctgaaaaggtcctttgaccgaaacgagattgaaaccgatccagcgtcatttgatccaacggttatgaatctgccacttcttttgatgatgtcacggatcattggggaagaagcttataatttagaaacggtcactttctttgtagataaagtgctgctccctgtttttaaatctcagtaggacgcacttttaagtgaaccggtttttcaaaaaaatagtcgattcgaatttaagaacacaaaagctcacaagccgttttggctttgtgagcttttgtgttcgagcgtagtttattttcaaatattatttgtaacttggcacgtctaaagaattgaggaagatgctttcaaaagttaatgaatttattaagccccttgcttttacgatttgttgatgataggatattgtcatcataaggtacttgaagtacccaaaagcaattgaggtgttcatattgaaagtgattgaaactaaaggattatcaaagcaatttggtaagaagcgagtgattaccaatgttaatttgactgttgaccaaggaagcatctacggatttttggggttgaatggtgctggaaaatcaacaacgatgcggctactactcaagatgattcgaccaacttccggcacaatctttattgagggccgggatgtcgcaacgttaccggccggtttttggaatcaggttggttatatgattgaaacgccgcatgcttacccgaatttcacggtggcagaaaatctaatcatgtatgctaagcagcggttaattccacaaaagcagataatggaacgaattagtacgcttagccggcaattattgttgacaccttacttgcatgcaaaggttaaagatttatctctggggaataatcaaaaagttggccttgccaagacgctaattcatcaacctaaaattttattattagatgaaccgactaatggattggatccagaaagcttagttgccgtgagaaatacgctaaaagaattggcagctaacgggaccaccatctttatctcaagccatttattgggggagatggaagaaatggttactcaaattggcattttggctcatggtcggttattacgtgaacttgattttgaccagtttaatcgagaacgcaaaagtaaattagccattcagattgatgccaaacaagcggcattgactaatttcttaactgaaaaaggattaactgtatcatcgactggtaagcaattattggtctccggtgtagcaactgctgactatgcatccttactaaatgatattgaaaatcaagactttcggccaacgacctttcaaccgattcaagaagacttggagtcgtttttcttgcgacagattggagatgtcaacaatgttagcaatgattgaaattgaattaaagaaaatttggcgcagcaaaatgccaatttacctgttcctagcctttgcaatcttactgtttttccatattcaatcccatacatggaatggctttattagtgaaaagttaaactggttcacaatggtaatggggatgatggggtttggcatctttagcagttggcagtttggccgggaataccaggatgaaacctttaaggatttacttgctctgccagtctcacggaataaaatcatttgtgcaaaactagttgccctggcggttacggaagtgttactttcaatcctctcagttgtttggatttttgcggttgggttatttttgcacttgggaacatttcacttggccggaattgggacacaactagttaactttgggttatcgatggttgccgcaatcggtttaacatttcttttcccgttaattgccagcttgtcacggggaattctcgcgccgattagtgtctcgtttgcaaccctattactagggaaactggtagcggctgacacgattggccattattttccatggtcggtgccaatgcttcaagcagcgcaacaacccagttcgattaacgcgattagctggttagccgttggtctcatcgcttgtattggcgtatttggaacgatggtctggtggacctatggtgatcatactgattaaaggatccggaagaaaagacgcagtggggtagtatttatcgcattagttgcgttaatgacagctggattaataacaataaaaagagtgggacgaaagcccggttacgcggcaggaagttgccttttggcgtacgtttccactcggtaataatcgtgattacacaaatggggctgggacaaaagtaattttgtcccagccccgttgtttgttattgcgattgttattgaacagccggcgcaacacgtactagttaaaaatagcttgtaacatttgaatgatgagccagcagattggaaacagcagccaccaaaagcgggccagaaaatcccaaccgttcatttgaccgtatcgacgtttgtagcggccttcggttggatcaaaggcatattgggtttcatcgattttggatttggtttcctcagttccaagaaccagtgtgtctaaactgatcccaaatatttcagctaatttgactaaattatttaagtcgggggtggcatcacccttctcccatttagaaactgcctggcgagagacgtagagtttcttggcaatatcatcttgagataggttttgacctgttcgatatttcttgagctgagctgcgaattgaagcatgatgatcgttcctttctgttaaccttattctgacggatcaccggctcattatcaagaaagccgtggttgcaaacctgcactaatctaataagaattgcgcaacttttagtagaaattagtaagacgatcattgatatgagtgtactctgacgggttgcgatctatcgttgagcctaatggttatgatcaggatataagcaaaaaccgcaaactgcaaacttaaaaacttggatgatgggcaaaagcatccgtaacttgaaaagtattgagttgatcatcataaaagtaatgaaaaatggttcttgcttaaatttcgtttatcaaatcatgacatttgtcatatcaactcatgacagtcatgtctggtttaagactgttggatttcctacaattatcagtgtagaaaagaggaggcggttgacatgacatcagtcattgaagtcatgaacgtatcgaaagagtttgagaagaagcaggtcttgtctaatgttagttttaaagtgcaaccgggtgaaattattgggttgattggccaaaatggtgctgggaagagtaccttgattaagctattgttgggactagcccagcccagttctggtcagattactgtttttggaactcatccaacggataaagtaatcaaggatcatgttggtgttatgttccaagacagcttcgggattagtcggattaaaggaaatgaattaattaaattggtttgcagctactattcgcatcctttatcgtttgaaaatatggttgcacttgcggacttgggtaatgatttaacgaccatggtttccaagctttccggtggtcagcgacgaaaattgaattttgcacttgcgatggccggtaatcctgatctactatttttggatgagccaactgccgggatggatactaatagccgttacgatttttggcagcaggttcaatccctggccaaatctgggaaaacaattattgtgaccagccattatttagccgaaattgaggatgttgcaaccagaattctgttcttgaaggatcatcactttatttacgatggcgcacttaacgaactccaaaaagagtttacccgaatcattgttgaatttgacagtgatttatcggaacctgagttaatgaagcagttaccatccggtgagttggattcacatttgcaggatcactatgtctttttaaccgatgatgaagatcagttattaactgaactatcaccacagatggccagagttaaaaatgttcgggttactcagcgatcattagatcaaatctttagagaagtgacgaaaggagtggaagttcaatgagaacatttatcatgcaggttaaaaataattttatgaggctgattgtcagaaacccacgttttttcctatgtgatgttgcgatacctgctggtttctacgttctatttaccaaagtgatgaatcagggaatgccggcttcttttaaccaaacctacctcattagcatggcaatttatgcaacaattctgtcgtcaattattacggttgccaacaatatttttaccgaccgtgaacaacaatatatgcgctttattgatgtttcaccaattagccgtggcagttattatacatccatgggaactgttttgtttctgttaacattaatcgaggttggcattgttgaagcagtggctaaattttatatcggcgtttcatttcctctgacgacatggctggcaattttggtgttggcatctctgggaagtatcccaatcatgattttgggcgtggctttggccttttgtgggtcatcagacctaattagcatgatgacgtatatgctcgtatttccacttgccattttaagtggcctctggtggccgatgcaaatgatgccaacctgggctcagcacattggcaaactcttaccaacttaccagacttctgttattgttaatgatgtggttaatcaaaaatcatggtcgttaaccgcgacgggtggcgaagtggcctggttggtgattgcgttagtgattttgattagcgttcaaaaaataaaaagggttcaacaagcgtaaaagtttatgaaatttttgaaaaagtatattttatttccaaaacggtttggtatttttccctatatctggatgatctggattatttacccaattacggatttatggccgtttaatcgggttgataccattatcccaacaatcctgctgatttgttttctatggttttaccggaatggctacagtgtctctaaagccctaccaatctggatatatggccagtatggcattatctttgtcctgacgataaccaatgaatggatctatctcttattattttcagcttgggagatttcttcattgccggtcagtaagcggacatttcatcagttcctagcggggtactacatgaccttggtcggctgtatggggttattgatggccttcgatgagatgacgccgtggtcgtttaccaatcaaatgagcattgtgatggtattgtttttgattttatcgccactgggtggtaaatcggttgcaaattcgtaccggcgctcgcaacagttaaggcagcagaactctcggtatgcaaatttaattaaacgtggtgaacgtgaacgaattgctcgtgatttgcatgatacgttgggccagtcattttcaatgattaccattaaatctgagttggcggctaaattgcttgataagcatccggatcaggttaaaaatgaattaaaggaaatttctgaggcatcgcgccaaaatttacagttggtcagaaatattgtaaccggacttaggcaaacatcgattgcagagattatgattgaactggctgatgaactaaaactccagcagattagtctaatgactgatggggaaggtcaaaccaacaagtggccgcatgacattcaaaatattttagcagatattttgcgagaggcgattactaatgtaatgcggtatagccgggcagatcaagtcgaagttcactttacgcaaaccaaagctgcctatcacttaatggttgctgataacggcaagggctacaaagcagttcgaaaagatgcccatggtattaaaggaatggcagaacgcgccaaaattgtcggtggaaaatttggcattcaaaccagccgatctgggacagtcatcaatgtgcaactaccaaaggagggatgatagtcgtggcaatcaaaattattttagctgaggatcagagtttactcagtagtgctttggcacaattactcaacttggaggatgacttagatgttattggcacctatgcggatggtcaggcggcttggcagcatattaaatatgatcatccggacgttgtgattcttgacattgaaatgcctaagcagactggacttcaagtagctgaaaccattcattccgaaaaattgcctgtgaaggtcattatcttaacaactttcgctaacaagcaatattttgaaacggcggttcaagcaaaagtgaatggttatttgttaaaagatattccaagcgatgagctaattcagtccatccatgaagtgatagcgggcaaaacgttatattcaccggaactggtcacgtcaattttaggggatgtaaccaacccactgtcacaaaaggaaacccagattttaaaggaaattagtctcggaaaatcaacttctgaaattgccaaagcattgtatttatcaggtggaacggtacgtaattatatctcggcgattctcagtaaattgggggccgttaatagaattgaggcgttaaatattgcggagaagcatcggtggatgtgagagagcgcaaagagaagcgcttaggttccagaatataagtcccttaactcgatattccaggtttgggaatatcgagttaagggacttatatggccggagcctgcttctcctttgcgcgtttcagcaaggtagccggccctcaaacacgttgttaatttgaagatactaaggttagaggggttatatggccggagcctgcttctctttgcgcgttttgacaaggtagctgtcccccaatacattggtaatttgaagatgttaaggctaaggagcttatacagtcgttttttaactttgatggaggctttagaaaaaatagtcatccgatttatatattaaaaaggagcttgacataaatgccagccccttaatttcttgataattatttttatttatatcacttaagctttattctactaaactactttgctcgtttatcagcttcaccctgcagcaggcgaagttgtttttgggtattttcataaacctgactaagttgtttggaacggttacgcgtcatttcaatgcgttcatcgagttcctgatcggtatagtttgataattgacgttgggtcttttcggttaattcataggcatggcgaacgacatagtagctgattctgccaacattgaccagttgtttgccagcggttcgaaagcttggtgttgaactgaaatcagtgatgccctgcatgaccttttcactaacgtgggtatcccagtaagtaattagtggaccggtaaagaatgcaacgataatggttgcgaaaccaacatcgccgccgatgaagaatgcggctaccatgaaaataatatcctgtgtgattcttgcccagcggtacttcacgtgagtccgttttgaaataatgggggcaatggcatcatatggtgcaacacctaaacgagcacccatataaagagatgatcctaacgtaaatagcagtaagccaaatactagattagtcataatcgtaaaaatgttaaccgtgtttggcaatatttgatggtaaatgattgagaaccattggatttcgtaaccaaccaagaccatgttcatgatggttccaattccgatctttttgcggtcaagcaatagtaccaatacgaaaatgactaagttgaccattaattgaacattgccaaggccagcacctaatttacccgccagtcctgtgttggtggccgtaaatggatccagtccgacgttgccctcacgaagcagggttgttccagttgaaagaatggcgatgccaacgaacgccattaacgctcgcaggccaacgtcagcaaatttattcagactgacgttgggagagtctttttcctcacttgcttctggattactgttttgtgggttacttgtcatcgaaagcttcctttctcttacttgtaaaagtcatccttacctgttcaattactatctattataacatctgaaataaaatgttcaacgattgacataagcgaccgacgaaggaacaccgctcttaatgacaaaagctgacgcgttaaaagcaaaaaaatctcatcccgtcattacataaattgcaatggttgggatgagatttttaacgattgaaaatggtctttgatgttaattagaattcggctttatatttaatagtgtaggttttttcttcgccagctggaagtaaaacactgccgaaaccttcgtgatttggtgtatctggcaggttttgagcttccaaggcaatccccatgtgggcaacgccatcgcctcgggtaaacttcacaccgtccaggtcatctggggtgaagacaaccagtgcgttacgagctgatttgatggaaactttacgaccggaatcaggatctgccaacgttgcgattggctgatcgacagaatggtcattgataacataaacctcgtcataggtatgaccaacgctttgcttcatgtcatcgattccctttttgatgtttaagtctgaccggaaatcataggcagtgttggcaacgttaaccatcttgccggttggggtcttatctttatttaattcaaggtatttgtcggcattgattgttaatgtttggccgtagacattatcatgatcacttaagttgaagtaagcgtgttgggttgggttaaataatgtatcggcatcactctttgcagaataagtaatggtgacttcattgtcatcactcaacgcaaagacaattttgacatcgatatttcctgggaatgaatcatccgttgaatcaatatgtttttcaaaaacaatttgattgtcttcaaaggaaccattccagatctgggtgttaaagccgtgaggaccaccgtgtaaagtagtggtgccttcgttagcatcaacgtggtattcttttcccttaattgaaaaagtacccttagtgattcgaccagcagttctgccgatcgcttgacagaaatattgattttttatgatttcttcactattgtccatgcttaggagaacattggcttttttaccgtttttgtctggaaattcaaatgcgttccaagtagcacctaatgaaattgctgaaatggaaacaccgttatcatttgttaaggtaaaccgctgaatatcttgaccattatatttatcgaataattcttttttgatttgcattgttgttattctctccttagaaataataaattgcggcttgaaaccgcttttatatgtattataatatctttttgtacggtgttgcaacacaaaatattgtatttatccgtacaattctatataaatttttccggaagtatgatattttattagtggagcgtccgataattgccggatattgttgagattaaaaatgattgattatctaatggctgaaaatatgaagttggatgttatttatccgttgatgagtagtgagcactcagtttgcttgcaaccattccttagctgagtgactgactttcacgcttatctgctttcgggggaagaaattcgaggagtttattatgagcacttttttgtatgtcttatccggtatctctgatttatgtctgttaatcctaatttttgcatgggggtttgactttgcacgtaaagaccgcagcaaaatcaagcataagcgtcactatggtttatgggcgctggtttcgctggtcttgaccgttgtcttgatgctaatggccggatcagggcaataaaccaatttgcaggagtcataatagccgtgtgaatcatgagacggttttaaagaaggttgaaatttgtttgatccttgttccttttgcgatgagaacagggagtgcgatggaattgagcaatttttgacccgataatttttaaaacgggggattcagtaatggaaacgaagtacgttaaagttaaaaagagtatcaaaagtaacattatcaatggtaagtataaaatcaacgagaaaattccaactgaatccgaattgatggcaatgtattcggttagtcgttacacgattcgacgagctgttggtgatcttgaacacgaaggctacatatatcgtgttcagggtggcggcatgtacgttaatgattggattaacaaaaaagtatctgctgatcgctctaatcaaagtgttggggttgtgaccactcacattgctgattatattttccctaatattattagtggtattgatcaggttatttccgaacagggattatcaattttaattggcaacacccatgatgaatatgataatgagcggcataacttacttaatatgttagataatgacgtggtgggatttattattgaaccaacgagaagcaccttggaaaatcctaacttggacatttatcaaatgatcgttgaatccggcaaaccggctgtctttatcaatgctcactacccacaacttaatttcccatatgtcgagattgatgatacggcgtgtgaaaaagaattaatggattatttgctggataatggtcatgaacaggttctgggcgttttccaagtcgatgatcttcaaggtgtcaatcggatgaatgggtttattaaatcttatcaaacgcatccacaggtttcctcatccggggatattatgatgtatcggtcgagcgatgatattaacaacgttctggataaagtgaaagatcgggttatttcaccggatgtgcggccaactgcgattgtctgctataacgatcaattggcaattgaggtgattggaatgcttagtaaggaaggcatttcggttccggatgatatttcagttgctggatttgatgattatgaaatttctaaatatattgatcccggactgacaacgatggttcatccaaaacgtgaaatggggacaacggcagctaagcttctattagatatgttaaaaaaacaagatgggtccccaaaaatcttggattcgaaattaattatcagaaattctactaaaacaatctaaaaagtgaaaaaagttttctaagatttaatcacatgaaaggtggtgatgcgacggcgggcgcgcccattcttctttttttattcgtaaaatttttatgctaacaaatcaaaaacaagttgatttatgcgtacaaatattttatactctttttgtaagcgatgtcagaaaccgtttacagtgtgcgcacaatgtttcagcaatttttgttttttggttataaaaataatcgaatggggtgctcgttttgaagaaagtttcaaacggttttatctatagttttggagcactaggtggtttgctctttggttacgatattgcgtcggtttccggtgcaattctgtttatctccaagcaacttcacttagggccatggcaacaaggttgggttgttagttcagtattgattggtgccattgttggtgcccttgcaactagtaaatttttggatacgtatggtcgtcgtaagttattaatctgggcttccgtcatcttctttgttggtgcgattacatctggttttgcacctgatttctgggtattgttatttacccgagttatcttaggaattggtgttggaattacttctgcattgattccggcttacctgcatgaacttgcacccaaacggatgcatggtgcggttgcgacaatgttccagttgatggttatgattggaattctgttagcttacattttgaactacacgttctcgcatatgtatacaggctggcgttggatgttgggatttgccgcattaccagctgcaatcctattcttcggtgcaatttttcttccggaaagccctcgatttttggttaagatcggcaagcttgatgatgcacgtcaagttttgctaaacaccaacaaaggcgatcaaggcgctgttgatactgccttgaaggaaattaaggaaaccgcatctgttaaatcagctggttggaaagaattatttggtaaggctgttcgtccagcattaattactggacttggcgttgcaatcttccaacaagttattggttcaaacagtgttatcttctatgcgccaaccatttttaccgatgttggttggggagtttacgctgccctacttgcacatatcggaattggtgtcgttaacgttgccgttactgtggttgcaatgctattaatggataaagttgaccgtaaaaagatgttggagtttggtgctactggaatgggcttgtcattgcttgttatgtacatcattcttaagttcgataatggttcacaagcagccgctatcgttagtgccattgctttaacagtttacattgctttctatgcaacaacttgggctcctgtaacctgggttctaattggtgaagtcttcccattgaatattcgtggattaggaacatcattatgttcagcaactaattggttagctgatatggtcgtttcactcacgttcccaatgatgcttagttcatggggacttgataatgcattcctgttttacgccgcaatttgtgggattgccatttgggttactcatactaagttccttgaaacccgtggtaagtcacttgaagagattgaacttgatcttcacaagcgtgccgttgctgataaggagacttccaagactgcaaactaagatttgcagggcatagtttagctaaataaaggtattaaaaaaggctgatctgttcagaggccttgtttaaaacaaatattattaaacacagaggagagaaaacattatgttacaagttcctgattatgaattttggtttgttactggtagtcaacacctatatggtgaagaacaacttaaatcagttgaaaaagatgcccgtgacatcgttgacaaactgaatgctactggtacattaccttacccaattaagtttaagatggttgcaacaaccgctgacagcatcactcaattaatgaaagatgttaactataatgataaggtagccggtgtcattacttggatgcacacattctcacctgctaagaactggatcagaggtactaagttacttcaaaagccattacttcatttagctactcaatacttggatcatattccatatgacaccattgattttgactacatgaacttaaaccaaagtgctcatggtgaccgtgaatacggctttatcaatgcgcgtcttcaaaaacacaataagattgtttatggctactggggcgatcccgaagttcaacaagaaattgctgactgggaagacgttgctgttgcttacgacgaaagctttaagatcaaagttgcccgttttggtgacaacatgcgtaatgttgctgttactgaaggtgacaaagttgaagctcaaattcaatttggctggaccgttgattactatgcgttaggtgacttggttgaaactgttaacgcagttcctgaaagtgatattgacgctaagtacaaggaattacaagataaatacgaatttgttcaaggcgataacgacaaagataaatatgaacattcagttcgttaccaaattcgtgaatactttggtatcaagaacttcttggacaaaggtaattattcagcattcaccactaactttgaagacctttatggtttggaacaattaccaggccttgcagctcaattgttgatggctgaaggttatggtttcggtgctgaaggtgactggaagacagctgccctggatcgtttgactaagattttgactcacaaccaagcaactgcattcatggaagactacacccttgaattgcaaaagggtaaggaagctatccttggatcacatatgcttgaagttgaccctggtattgccagtgacaagcctcgagttgaagttcacccattggatattggtggtaaagcagatcctgcacgtttggtatttactggtcgtgaaggcgacgcaatggacatcacaatttcagactttggtactgaatacaagatgattggttatcctgttgaaggacacaaagcgccaaagccaacgccacatctaccagttgcaaaacaaatgtggacaccaaaggttggtttgaagcatggtgctactcaatggattcaaaatggtggtggccatcacactgttttgacattcgctgctactgagactcaaattcaagaccttgcaacaatgtttggtctcccatttgctgatatcaacgaataattgttgtttataaatcatatttaaagcacacaaaagtaaggttggggcggctgcggctgtcgcaaccttctttcgtacataaaatgaatccgttatctttgatataataaagtaatcaaatggttggaggttgcttttatggcaaaaactgaaaaagaaaaaatgctggctggcgaacgatatctgaatactgatccggaattggctgatgaacgacgaactaatcgccgattaattaatcagtttaatgatgtttccaaaaccaatcctgaaacgggaattgaagtgatgcgtcaaattcttaatcgggctgggaaaaacctggatattcaacccccgtttcagtgtgattatggctacaatattaatgttggtgataacttttttgccaactatggctgttgttttattgacgttggggcaatcacgtttggtgataattgtctgttgggaccgaacgttcaaatttacacggttaatcacgcctttgatgtcaaagatcgtgaccggggtgttgaaattccgggtaacgtgacgattggcgatcatttatgggcaggcggtggtgttatcatcacgccgggtgtgacccttggcaataatgttataattgcggcaggtgccgttgtgactaaatcatttggtgacaatgtgctgattggtgggaatcctgccagagtaattaaaaaattgaaataatattggaggaattagtttggctaagcatacgattggaaccacagttaagttagcggatggtaatgaaatgccaattgaaggccttggtgtttataaaatgaccaaggaagatgagctgattaattctgttaaagttgcctacgatgccggatatcggttatttgatactgctcaaatgtacggcaacgaagcagcagttggcaaagcaattaaagatttgaatgttaatcgcgatgatatttttgtcacgacaaaggttgccgaagataatcaaggctatgataaggtaattgcttcagtggaagaatcacttaagaaacttcagctggactatgttgatttgttattagttcattggccaatcaacactcactttttcgaaacatggcgggcttttgaaaagctaaaggaacagggcttaactaagtcaattggaacaagtaattatgggatgctgcaccttcagtaccttgcaaccaaggcaaatgagatgccagtcgttgatcaattggaggttcacccatatttatcgcaacaggcgatggttacctttaataaagaaaaccatattgtaacgcaggcctgggcaccattgggccgtggccgaatttttgaagatccggttattttaaaaattggtaaggttcatgataaatcggctgcgcaagttatcttacgctggcatttgcaacggggcgactcgttcatcccaaagtcagtgcatccggagcgaattaagcaaaatgccgatatttatgactttgagctgagtgatgaagaaatgaagctggttgacagtatcaataaaaatacgagaatcagccaggaaccagaaatggtttatgagatcggacatcaatatccgcatggatagaaaacagagtgcgcccagaagcggttaactcccagaatataagcaactttagccaatatcccggtttgaggatattggctaaagttgtttatatggccgggagttgcttctgggcgcacgtttcggcatggtagccacccccagccaatatccctgatttggggatattggctgaagttgtttatatggccgggagttgcttgtcacagcacgtttcggcatggtagccacccccagccaatatcccgatttgaggatattggctaaagttgcttatatagccgtgagtcacttgttacactgcgtttttatcataataaggaaaattcagaccactctttggtaaataatgacgtaggggtatttactaacccagtgccacatccaaaaccatcattaaggtaaaaccggccataatgccaaaaatcgcccagtgagattccgcagttgttcgtgcgtgagcctctggaatcaattccttacaggcaacgtaaatcattgcaccggctgcgaatgcgagcgcatacggcaaaatcatgttaactgaagcaactaagatggcgcctaaaataccagcaacgggttcaactaccccacttgcctgaccatacataaacgcccgggttcgactcatcccactttgacgcaacgggattgagacagcagccccttctggaaagttttgtaggccaattccaattgccacagttatggctgccaaaatcattgctgactggttaccgctggcagctgccccaattgccccgaaagcgacaccaacggcaagtccttccggaatattatgcaaagtgatcgagaagacaagcaaaatcgttcgtttcagctgtgttcgacggccctcgggatgccggttatgttttaaataaaggcgtggaatgattttatcggcaatataaaggaaaagcccaccaagaataaaaccggttgcaacgactagccagggagtccgatcttgttgttccgccaagctaatcgctggatccagtagcgaccaaaatgatgcggcaatcatgacgcctgcagcaaaaccatacatcatggccagcgcattactgcggattgttttaaacgcaaaaacgagggctgcccctaaagcagtcaacccccaagtgaataaagttgccagtagtgcttgctgccatgcagccaaatttagcaggaaattcatgtgacacctcacttatagaaaaaattgattttttgtcattaatttaaataccttgttaacgtaattataacaattaaataaaaacatttcatgaatatgatattgattcatgtatataaaaaacgagtaattaaattgtaaattcttgaacattaaagtggttttgagtgattaattactggtaattcgctatacttaaagtgatatctgaatatagaagcgatataatttaacgaaatgggatgattttattggcaaaggtcacggcatatttggtccgacatggacagacatacatgaacctatacaacaaagttcaaggttggattgattccccactaaccgaaaaggggattgcagatgcaaagagtgcgggcaagcgacttgcaaaaattgattttaacgcagcatttaccagtgattctggtcgggcaattgacacgggtcgcttaattttaaaagagaatccgcataatatgaacattgttagttaccagtatcctgaaatccgggaacaattccatgggtattttgaaggaaacgatttaaaccagatgtggcagtttgttggggcacaagttcagaagacgagtgaaaaagaagttttaaaggatttcggcttggaacgtgcacgagatctcattcatcgagctgatttgtataataatgctgaaaacaacgcgatgttttgggaacgactgaacattgggtttgataagattcgccaaaatacccatgacggggaagatattttgattgtgtcgcatgggatgacgattcgttcaattgttgaccgctatgcacctgatttggatgatggcacgccaattcaaaatgggagtattaccaagctcattatttcggacgatgatattaaagttgaatgggctaataatttagggtcaattgataagtaatgttgtattgcttcacgttcttaaatatgatacattgacatagattattaacgacgtgcgagaaaaaagtggttagcttccagagcataagtggtccaacccaattatccttgattctgggatgttgggttgggctatttatatgatcagacactgtttttaaggatcaaaattgattttttaacagaaaacaccgtcggctgataatatgtgaatttaaagtaaagcatttcatccagatgatttgcacgattacgataattgatcagactattttgaacaaaaagaacgcgagggacattaattgattacaatttcagacatgggattacaactttcaggtaacaagctttatgacaacgttaatttaaaatttacaccgggaaattgctatggggtcatcggcgcaaatggtgctggtaaatcgacttttcttaaattactggaaggcaaaattacccccacaagtggtgaagtgcatgttgataaaaacgaacgaatttcgagtttagctcaggaccattatggctttgaggatcaaactgtcttgcaaacagttattcagggctatcagcatttgtatgatgtcatgcaggagaaagatgccttgtatgccaaggccgatttttctgatgaagacgggatccaagcggcaaatttggaagctgaatttgctgaaatggatggttggaatgctgaagcagatgcctcacaattgttgcaatctcttgagattcccgaaggtcttcatcaacaattgatgagtgaattaactgaaggccaaaaagtgaaagtcttattggctcgggcgttatttggtaatccggatattttactgttggatgagccgacaaacggattggacgtgtacaccattgagtggttagaaaattttctggccgactatcgcaacattaccattattgtgtctcatgaccgccatttcttaaatcagacttgtacaatgatgtgtgacgttgattttggtgaaatcagaatgtacgtgggtaactacgatttttggctgcagtcgagtcaattagctgctaagatgaaggctgattccaatgccaaaaaagctgataaaatcaagcaattgcaagaattcgttgctcgatttagtgccaacgcgtctaaatcaaagcaggcaacttcgcggaagaaacaacttgataagattacattagatgatattaagccgtcatcacgtaagtacccattcatcaaattcgaggaggagcggccattaggtaatgacttgctgcgagttgataaattatcgaagtcaattgatggcgttcaaatcttggataatgtgacctttacattaaggccaggggataagaccgctttagtaagtcgaaatgatttagcaaccacgacgttaatgcaaattctagctggcacaatgaaaccggatgctggtgaagtgacttgggggcaaaccgttcagatgtcttcaatgccaaaggattttgcggccgagtttaacgataatgatcagcgaattattgattggttgagacaatatgcccaaaagggtagtgatgacgatgcttttcttcgccaatttttaggccggatgttattctccggcgatgatgttaacaaacaggttaaagtcctttccggtggtgaaaaagtccggtgtatgttatccaaaatgatgctccaaaagggcaatacgttgctcttggatgatccaaccaatcacttggatttggaatccattacgtcactcaatgagggattagtgagtttccaaggttcgattatttttacgtctcatgatcatgaatttatccaaacaattgccaatcatattattgaggtatctagtaatggtattatcgataaggcagatacaacgtatgacgagtttattaatcacccggatgtccaaaagaaattggccgatttgtataaatagggcgataataacaggctttggccggtagttgtttcgaaagaatttaggctctttgtcaactgaggttgatatcagcttatatagcaaatccgaaaggatttgctttttcttttgcattaattgaattaagcaaataattccatttgaatcctagttcgataatggtcaaaa

SEQ ID NO: 678 - DNA, 337279 bp, Unknown
  Metagenome-assembled genome
ttttaataaattgaagcattttcgccatctttcgaccagatttgataagttggcagcttcttttttggcatttatccagattggtgccatttttttactgattaaatagtttgaagacacaccctaatatcggtgcaaaccaggcaacctttctatggctaagcttataaaattctcgatataaattggtaatcatcaaatttccccctttttgattcgaccaaaactacacgcgtctttttttgaataaaagatagccaagtatcataaagataataatgtaaatgatattacacgtgataatttgtgagttggtaagatatgaaatctttataaacttcttgggtacagctagctgattcatgacatatatcatgttaaaggggttccacttcattaacggaattagtcctggaaaatcactcataatcacgcttgataaagaagcacctaagaaagaaatgcccaatccaattccgattactgcggcattatttttaatccaagagattaagagaaacgcaagggattcaataaacagaagataaataaagatgcccactaggttaagcagaagtgcatttagtaagcttgtctgctgatacgatgcggtccatcgaaattgttttcctacaagtaatgctttaaaaagaaacgtcataactatccctataattactaaagcagtaccatataaaataatgactaaaaatttattcaaatagattttcactttgctcgaatttttatagagtagagccacgattgtattgttttcatattccatttcaaagaacgtcgaaccaacggtaatgatgattagaacgatccattgacctactccaaatccttgggcaattgttgttttactaatttttgtaccactaaaagctgaatacaacattaaaaccagcaacgttattacaccatacaaaggaattcgctgatgcttgaatttataaaattcctgtactaaattatttttcatgtggttgccttctttgtttttcaagcaaactaacaacgatctgttcaaaattcattcttcttggtgacaattccaacaaccgaatatgattggcgtaaagtaaatcctgaatttgatatagaaaccgtcgatcaatttgcaaatattcatctgacttaatgatcggaatttgattcttttgaaacacattaatcgtcttatccatattttcagtcaaaacttgatactgctgatgactcaaacgttcaaattcgctaattggcttattcacaatgattttgccttcagtaatcagaatcgcatctgtcataaccttttgcagttctcctagaacatgactggaaatcagaaatgaagatccttgagccgcgtactgtttaataatttttcgaactaaaattgtcgcttcaatatcaagaccattcatcggttcatctaaaataatcaattgaggccgattcaacaaggcaattgcaattcccaatttttgtttcattcccatagagtagtcctttgacttcgcatcaatatactcccccatttctaataaatgaacgacattctgcatgtctacttcatcttgagaatataatttaagattctcaagcccggataagaacggataaattgctggatgctcaattaacgcacctacttttgacaaagccgcatgattattctctgtgactacctgatcatctactgcaatgttcccggtaaatttggtcaaacccaagatagttttcatgatcgttgttttcccagctccattgggtccgattaagccaacgatagcccctggcttaacttgaaacgaaacacccttaataatgtgtttccgaccaataaaagtatccatattactaactttcagcatgctattacctcgattcttcttatttaaagtgacaattaaatcacttgaacttttagcatcaccatgagcatacttcattaaaagccgattgtgtgggggactggcaccgtttttatcaatgacggagagtatgtcttgtaacttttacatgaaattgatatgctaaagatgatggtcgggatgtctgaatattctgacaaggaaaggtacctgagttctgtgaaccacgaactaatcgcaaacctaaaatcattacgaaaacaatcccatattaatcaaacagagttagcccaaaaattgaatgtctctcgtcaaaccatttctagttgggaaacaggcagaaacaccccggatgcggcaacacttatccgaatcgctgacttttaccatgtttctctggaccagttggtatcgcatagaaaacatttggataagacaaagaaaatcattcttgtgattttgtttataatcttatgcgttgagagaataaccactaattccactaccccaggactaatatggattgactatcttatattggttccaatggttctttatttgctactattattaatagataaagggtggctcaatgctaaagtcggtctattaatctacacagtctgtctttttatttttggaattgtcgggattgccagtgccatagttaatcttttctcaatgggatttgattttcaaatcacctgcttcatctgtggcgcaattgccattggctatttaactgtactagccgtcaaacatctaattaaaaaagtcaaagaatccacttctcttagagcttaaaaagtggttccgcccttatgaccattgtcaacatggtctgaattttcatgcaaaacaaataaccgctaagcttttatctaggtatatagataaaagtctagcggttatttgttttacgattcacagcgtttgtactgataggctgtcacctcactgctttgatatcggcgagataaggttacccacctgatttttcaagctatatccgacctgcaaaccatcaacagatgcaataaaaatcataatgatgacccacagccaaaccggccacataaagttagccagccaggataacgtcattgttttgtgggtcatcacaacaatatgcttaataagcaggtataatggcaagtttgcaaggacaccacagatcagaaaagtccctgaataaatgattgcttcttgaaatttttcacccagtaagtctttcggtgtaaatcccaggatagacagttgagttaagccatccctcttttgagtacttgtcataattgtgatcgttaagacatttgctaagataattgataatggtgtcccgacgaaaataaccaacgactccttgatattagttgccgcttcctgattagttccaccatttgttatttctgaagcaatcaaggtaatgccagtcaacatgagcgaaccggccactaacggagaaattaaagaagatagataatcttgatcaaaaatggtattccaaaatgcagtgtttactgttggcgatgtttttcttggtaacagccaagtccacccctttatcaaccacggtaaaataatttgagaaaccagcgagaaaaagataatcgacaacagaataattaacatcaagtttgtaatataggtcttcgctgcttcgtgaaactgcccaactctcagaaaatgttgagcctgaggcgtcaaaattaaagaatctccataacaaaatattaagcctgcagcactgacgatcatcaaaaagccacgaataatcagctgcagtttggctggtttctttttgaatgctaaaatatcgctttgcgtgctggcaaatagttgatgggcgtgaagataacccgccaatccagaaaccacggcgataaatccaacagttaatccacatgcggataatgaaaattctaacggcaatgccggaaccctttgtgcaaaatgacttccttcatagacaacaatgaaccacctatctaatgaaaccatcggtgggaccgccagaacaaatccgatgaaactccccaacgccccggttaatgccagctgaccaccaattaatagtgacaattgatggggattggcacccaaaataacccaaagtatatattccttacttaaacgattaatgactaatttaatgacgccactcgaaacaataaagatcgtaaggataccgaaaagtagtggaaagtaaaatccgttagttgggttaatatttttagataaatgtgggtaatgatcagcaatcgtccgaacggcgttcaaacaagcccccgttagaaagcctgtcacaataaatagaaataaagttaatccccaaacctttagagaatgtctaaattgcaaccaaatgatccgaaacatctcatcacaccctttcttcactaagtgcctgaaagagttcggtggctgttggctttttaatgattttttctaaacggccatctcgcaaagtaatggccacatcagtagctgctgccatttcaatgtcatgggtaaccatgacgatacaagcgccttgattggccaacttacgcaataatccaaaaataattctgcgggaaactgtatccaacgcacctgtgggttcatctgcaaaaataatccggctattggcaaccaagactcgggcaattgctactttttgctgttccccaccagaaagtgccgaaacaaaatgactaggatcagcttcaaaattaatttcttttagtaattgataaatcttttctctattgattttcttatgggctagtcgtaatggcagcacaatattgtcaaaagcgggcaatgccggaatcaaattatagctctgaaagataaacccaatttgatcgcgccgaaatgcagccgctttagccgcccgcaaatgatacggatcggttcccagcaaaacaacttgtccgctggtggggcgggaaagtcccgacatcacattgagtaaggtggatttcccagctccagacgggccgataatactcaaaaattcaccagcgtttaccgtaagtgaaacgtcatgcaaaatttctaaaccttgtttgtgattaccgatagaaacctgcttttttacatgattgatgttaataacctgtttcataattaaaatgacttctttctacatcaatttccgtaaaatcaataatctacctacttaaaacagctccaaacattaaagacgctcaatcaattacttaaatacctaaaaccgctgctgcctaattaaccccagtatggatagaaatatttcaaataactcttaagagatttaaatcaaagtatttattgaatcttaacgtgtccaacctcagtcgtaaaatgataattaaccggattcttaatattctgacggccataatggctaactgaacggccaaatatggatttgtgaccaactgaggtggaaacagagatttgagttcgccgatttcgtttaacgcgaccattgatggatccagtctcactgtcagccgaaaatcgttttgaaacattctgtgtgttaaacgaaatatggcctgcatcggtctcggccgccaatcgcgtgaattgattcgaccgtaaattgatattaccaacgtcgttatgaagcgacccatcattaaatgtactgttagaaagcgataagtgacccatactgctgatttttaactcatctgccacgtggatctcattgagcgacaaattagattcaccagagaaagaaagccgcttcgctgaaatgccgttaatcctaacgtggccgttcaaattatcactgttatattcatgaatgtgacaagtcagcgaatctaatttaagatctttgggaacggtaatgactgtgtgaccaaaattatcctcgacagtgtggaagccaaatagcgtaaatgcttttttccaatgtttggatccctgaacggtcaatttatttcccgactgggtgaccttggttttgctgggataggtcacgctgatctttgaaacgttcccttttcgaatcgttacctgatttgacgtcgcaaccgtcagttgtttcacatgatcaaagtgagctgtccgttctttgtttcggccagttccttcaacgttaaaaccatgatcccaataaaccgttcgaaaaccatcattacccaatccaactgctagacaaataatccccacaattagaatgatcagcccaacccaagttgtctttttcatgattagaagccaccttttttcttctcagcccgattttttggcacaattttgtgatacattgatttggcaaacagcgcgcaacgatgaatcagcccgtcagttacttttctaaaggtcggaataagcattgttaaaataccagcgaccgacagcccaatcccaagataaaacagccctgtaaataggtgtgcaaacagcgttccaatcccaacaatcagcgataggaaaccgctaaagatggccgcaagtaatattgcgatcaccgaaacaacaatcgcgccagtgacagcgatgcccgcaagcaataaagcaattggcacaatcgcgattggaatcattaatggtgacgaaaaaagagctaatataatcaaccaaatcgttttgacatccccctttgaccgttgcctcgtcgaagtattgggattgggattttctgatgccttaatggagtaatccgctaaaacctttctggcaagttgtcggggtgcgccaagttcgcgaacacaatcttcataggacgtgaaaccaccgtcttgcaaatattcccgatagaaattaatgacttcacttctttcgtcactatgtagttggcctaaaagtgccttaaattctgcgagataattcgtcatggttctccaccttgctttcgatttatcgtttttaaaatccatgactgttaaacataccagccttaaatcctatttatatcattatactattaaatcagtaatactatattctgtataatatgctacgagtaaacaatacaacattgcctttactgtgtcaacatcatacgataactttttgtgagctatagttaccgataagaaatattccagtcaaaaaatgtagccaatacaaaaagaggattgcacatgaaccgtgcaatcctccgggaactataacataaaagaagcctcacaatgagctcccttgtaatctcaccaaatactattgtgccagcagcttggatttcttttgatccaagatccattgctcatgctcaacacacatcttccaatactgcaattcatattcactactatactgaaaagcaagccgcatcttctcacgcacttcaggagttgcagcatctgcaagttcatcggttagatcaagcattttttgattaagcgaaccgaactcatcccctgagcaaaactcaatgaagtctttgtacaccggtttggtactatatccttttttgcgaatattctgaaacatttcagtataggtccagtagcatggtaccaaactcaccgttccggcttcaattccggcttcttcaaactgatagtacatatttgtaatgtatgcgtaagcagtcggtgccacggaaacagaatcaatttctgcctgcgtcagtttgagttcatcatagattggactccgttctgtgatttcgttacaaaggtctaccaagtggtttagcagatatgcctgttctttgttagccatctttttagcaattttttggtgaagatcataaaaggcgacacagtacttgttgtcttggataaagtagtagcgaaaggcatccatcgaaagggtaccgtcagtcaagccggaaataaacgggcaattaaatatttgctgccaaaccggatcgttttcttgtcgtaattgatcagtaaatttcatcatgattcctccatttttatgcatcatatttggcaaaggcccgatcaaaactcagtgtaatcacctttaccaaaaccccatcaaataataaacttgagattgttgaaacaacaaagatcaaaataatcatccaagcatggtaattgccatacccagaagtgaacaacatgtatagaaatgctaataagttagccccaaacgcaccaagtaggcagctggtccatgaaaaccgttgatatccgtgcggaaagaaaccaaattcgttccctaatccttgaatgaaaccgaagaagaccgtcatggcaccccactggcccccaaaaaacatttcaacagtggcagcgatggtttcaccaacgattcctgcacccataaccgggacaaaatacatgcaaagtggcgctgcgataaaccataagccggtgtaaaggctgtcaaccagtggactcaacccaagtggggtcagcgcgattttagtcacgtcatacaaggtattcaacccgaaaaagtagattgccccacagatgactccgattagtgtgatcgtaataatttgtcttaaattccaatgtggtgaccggacgttcatagcagttcctcccctgatccttcgagggcattgcggctccagtcatcccatgttatctgcttgaatgatgcgtcaaagaaataccattccagtaaacaacttctcaaaaaatcctgtttaaccttatccaaatggtcttgtgactgctcaactgccagccgatccaaaacctttaaaaaaccatccgaaacattttgataatcatcgcctttcagcgaatccaaccacccatgaaagggattatctgaagtgacttttcccgtatcatcgagatattcaatcagctcaacgtaaatccacacaccagcttcaaaagatgccaagatgtttaatgggtcgcccgttttaattggatccagtaaatggtgagtataaatataagtaaccggctccattttagcggtccggatcgtatcccaattttggctggtcatccctttaaaaacagcctcatcaatcccaaggtggttgcttaacagttccgcaaagttccgctggtcggcaaagtgcttgctataaatgatgagataggcctgcacctcagtttcaacatccccgtattgaagatcctgcccaacataatagtccaatgcttctgagcttaaattgttggctaagattgccttcacaaaatcagaatgtttaactgcctcaaggtatggttgtgcttcagtaatgagttcctgtgaaaatgacatctgttcaactcctaacgttgtttgcaatggcgacggtaatcataaatgatctaaaatctgaatttttccactaaaaaaaggacctcctccataaagagcggtccttagccatgcgaaaacaatacaagttgactaaacggtcttcctacgtcagtactaactgagtcaggttccatgggtatttctcagctgaattgaatcagcaccccagaccactgtaaattattagttaagcatcttcagtaaacaccttgtaagttgttgtgtcaataagaattgaaattatcagaagcgcttctttcgaaaaatcaaataacccaacgcaaagaaaatggtcatgtaagccattgtgccaatcagcaattgggcatttgccaaatggctagtcgcataataggtgatgtaattgtagtattcccgagttagattgatcatgttaagtggattccatttcaaaacattggcaaatctacccgaattcaataaacttccggtaacaaattgacccatgaacaccactaagaagctcacactaatcacgatggcattattattaattaaacatgacaacagaaaaaccaaactgacgattaacattgtcgttagtaaatcaatcgctgaagttttgagcatattttcccatagcggctgctgatatcgataacttgttgaccaagccacttgggcgttcatcggtgcataccttaacccaactgtaaaaataattgccaagacatgcagaaagacattgtagcaaaaaatcatcacatacttcgatagatagacgtcaattttgttggatgccttatacagtaaggtcaagattgtattattttgaaattccattgaaaaggtcgttgcgccaataatcactaaaatgaacatgatccagtcaggggagttataacttgtcatggtcaataatcttccctcgttgaaaccaatcgtgtagcctgacatgatcattaatgctagaagaattaacggcgatatccaggttatttttttatgcattaacttatagaactcttgatatatgctaaaagccatcctaatatctccattcataagaaatcaaattctacggtgtttaaataaaacataacccaatgttgcgaaaacgagaccgtagccaatagttcccacaataatctgccagccattcaattgagataggttagcatacgacctgttggctaattgttgggtcacaaagatcatattcagagggttccactttatgactgctagtaaagtggaaaatgtcttcatcaaagctgtcgagatactcgcgcccagaaagccaagtgccaagccaataccaatcactgctgcattaaccttgatcagcataataagcataaaagacagtgccacaataaagaatgagtagataattgttcccacgatgtgcaacgttagactgtccagtaaagattcatgcccggtataatcggccagccaccggtacttattgcctaccaatataattttgagtataaatgtaaaaagaatcgcaatggctgcaagtaacacaccatataagaaaacgacgaggaatttagctaaataaatttttaacttattagaatttttgtaaagtagcatgatgatggtgttgttattgtattccatggcaaagaaagctgatccaactgcaattaaaataatcggaatccattggacggctccaaacccaaatgaaacagatgcgggaccaacatttgatgaaatgctactataagccattaagattagcagggttaagataccgaacaataaatttttctgatgattaaacttatagaactcctcggctaaactagtcctcatgctgttgccttctttgtttttccaaaatgctaacaacgagttgctcaaagttcgcttcagccggtgatatttcctttaaatgaatgttgttctgatacagaatgtcttgggctctaaagagatcctctttctttaccaagaaattatctgtgttgttagaaattgggatatgattcgattcaagtagttgcatcgccaatttgtctctttctgtgcttaatttgtatttttgccgactgatttgattaaatgtttcgttatctcgattaacaatcacgcgaccatcgttaattaagacgactcttgtcatcactttctgcagttcgcttaaaatatgactggaaattaaaaatgcggttccctgttcagcatattgctcaatgatttttctaaccccaatcgttgcttcaacgtcaagtccattcattggttcatcaagaatgattaacttgggatgatttaatagtgcaatggcgatacccaatttctgcttcatacctaaggagtagcctttagccttattgttaatatacgcatccatttgaagcatcgaaacgatattcgtcacatcctgcttatcgtaagaatacagctccaaattctgtgatcccgttaagaatggataaattgccgggtgctcaattaacgccccaaccttggataacgcattatgattattttcagtcaccaactcatcacttacagaaatccggccggtaaatttagtcaaacctagaattgtcttcataattgtcgttttcccagcaccattcgggccaatcaacccgacgatagcaccaggattaacctgaaatgaaacgttcttaacaattcgttttctgccaataaaggtatttacatcagtaacttttagcattagatttccctcgattccattgtgagtttccatttcaaataactatgcttaaagacgttacttttaaattttgaacaaagtgtacacccactcgaaggtgattatgacaacgattaaggctctttttactgatgttagtgaatgtatcttgtaactttgatatcaagtcgttatgcttgagatataaacgagaaaatttcacgactttaattagagaggtgcctgattttcatgaataacaaactaatcgaaaacctgaagtttttcaggaaacaaaatcatcttaatcaaaatcaactggccacaaaactaaatgtttccagaccaacaatttcaagctgggaaaccggcagaaccacgccggatattgataccttggttagaattgctaatttctatcaagttccagtcgatcaattgttattcactcgaagccattcaaagggaaatattaataaaagcaaaaaacatatcttggggattttgtttatgatcttaataatcgaaagattcactgtggatgcgccgcctgctgctcgaggttggattgacattcttgtgttaatacctgctttgctctatcttccattagcattagtaaatcggaactggttgatttcgagaatcggtttacccatttacactgccggccttttcttatttggcatgttggggattggcagtagcgtaattaacctgttttcaatgggcccgggttttcaaacatcttgttttatttgtggcctgattgcacttggttatcttgataaaactaaaattaagtatttggtttggagaatcagaaaagcaacgacttcctgaagatttcctttaatgtgaaacgaaaaccgctaacctgacatggttagcggtttttattgttttaatttcgcacaaaaaactttgattaattcaaaaggcagtttccagatactgcgcaacaaatcgattaatcccatcatgcagttttagtttcctgtcaaataattctgttattttatataagtttactttacttttgtatagaaacagtttattattctgggcaagggtgatgaatatgaagaaaaattttggcgattcaatagctaataaagtatatgaatatcgagttcttgctaaactgtctcaaaaagaactagcaaatgcagttggcgtctccaagcaaacgatctttgtcatggagaagggcaattatgttccttctatgttattggcatttcggatcgcagattttttcaatgttgaagttacagatatttttacttatttgaagggaaatgatcagcatgataattaatttacctttactcacctcagagagattttttcaaccatttcattcatgggcagaacaatcagttggtaattataataaattgatcggtattttatttattctactaatggctagctttatcttctgtgctgttgaagtaatcagaatgggttggtctgatgaacgtacgaccgtcatttctttaagagcctcgtatattatgcttgtaataatcatcctactcgatatttgtctacctaaaacatatatgtggcacgtcttctttatgttcaagtactttatggcattttcagcagccgggatttacttagcaatcaaacaccacaaagacttttcttgatgtaagttttgacagttcagccacaaacttggggtgatgataatgggtcacttatatcgacaagaaatattcaaattatttaaacgaaccagcacattcatttgcatcatcgcattgattttccaaaacgttgccttcgcaataacaagtaaattatattcaaagtttttcattcctaaagaactgtttgtctcaaattatgccaccacttacctgattacgctggttatgataggcgtcactgctaccaacgttgcttctgaatttggttaccacacaattaacaatattatttatcaaggatattccagacaattcattttgattagcaaatggttggctgttcttacctattctttcttgttatatatcatcgctgccgtggtaacgttactgaacaagtttctatttttccgaacaacttactcactgaccgaccaactaaaggacagctcgcaacaactttggcaatactgggtttctaccctcttcgcgaactttgtcacactgtggctgttactaagtattgtctttttacttgccgccgctttgaagaatggtgtcacagcaatcatcgttggcataaccggttactttgccttgagtatcattggtcggatcatgtttcaaaccattcaaaagtgggaaccattgaaatggaatccaattaactttatgaattatcccactcagttagcagctccagattcgctgtcacaattaacaaggctgacaaatacacaacttttaattggtaatcttctttacattttgatattcctattactaggcttatatttgttcttcaaaaagaaaatttaaccgtcaggagctgaaaccaccgcgaagccttatttctcaattttacttacatatcatgtcgaggatttgcttatttcggtaggcatttgtactcagctaggggaaatgattgtctaatctgaaacatttaacgactaaaagcggtcaacatcttatccaactgatatcgatgctgatcgcttttccgattgctaacaactaatttctaattttcaattttccttcgccgactaaactgccaaacggtggccgatccaagagcaaccataacaatcaccgtaacactcattccaaccgtgagcgtaaaattaggattcgcaaaaaagtatgatttactcaaggggagtaatcccaatcggtacgcaaaaactgttggaatataatagccaaatggggctgccattaatattgcgttgataaccatgcacacaatcccaattaccgctgttacaatcgcatttctaaaaacgttaatcaaaatagcaccaagaggcagattgattagtatcaccagcaaagaatacagaacaaatgaaactgaaactcgaaagaattcaaaacaggtgccatgaatgatcacaaacagcccaacggtcataacaatataattcactaaacacattccaagtaaaagtaaagccgcaaccgacaacttggccacgattagtttccatttggcatacccataagtaatccagtcaacataagtcccattactatattcaagataaaagatcgaggtggttagcaaaataaccacaagtggaaaaaataagctgtattgattatacataggaaaataaaggtcaaataatgaataattttgtttaaccatgagcggccgtgacatattaataacgatcggaataagcgccaataaaagcagtaaaaccgtactcaaactgtgtttcatcttgataaactcactattcatcagcgttaacattgccatcaacctccccgataattacgaaatcaaacaaattttccaaactggttatgtcgccaataaactgccaatcaaactgttggattaagtcagtcaactggtcttcatttaaggtggttaaaatataattgctactcttaattcgactgatttgccattgttggttgaccggtaccgtaattttgccggtatgtgagtagacataatatatcgagtctgtttgattatcaatttgaccaatgatttcaccatggttcacaaagacaatcttatcgacaattcggctaatctcattcaagttatggctcgccagcaacgtcactttgtcctttctaatcgccggggtattgagcaactcccggactgccttgattcccagaggatccaagccattctgcggctcatcaagcaacaaaatctggtcattgcccattagcgcccgagcaatccccagccgctgcttcattcccaacgataaatcgtgaaatttcatatcaaccgcatgaattaagttaacctcttttaaggcttggataacttttgcttcatcagtaccgatatacttagctgataattgtagattttgtttgactgctagagcttgataaaaattagggtattcaatcaacttgccaacttgagcatcatttatcggcttcccatcaatattaatctttccttggtaacgtgtaatgctaagaattgatttaaataaagttgttttccccacaccgttaggtccaacaatgccataaacatctcctgattcaaaactaattgtcatatttcgtaaaatttgtttttgaccaatctttaagtttaaattctgaattttcaacacggtggatcgcctctaatccttttgaaataaatcgttaaccgtaacatttaattgttcagaaagttccaaggccagcttaagtgtcggatcgtaatgatcattttcaatcatgttaatagtctgccgactaacatgacataatttagccagttgcgcttgggtcatctttttctcttttcgcaaaactcgaattcgatttttcattgcataaccatccagactaaataaaatatgacatacgctataaatgacacaatcactactcttgccattacaccagcttttcttcctgcgattacacgttcatataaataataaattgccgtgaagaaagcgattaccccagaaatgatacataaaatttgaacgatcattaacgtactaattaatttagtcaccctctttatccgaatgacggaccatatactgatacctaatgtagaagatcagatacgttccaatactgattaccaaatatttaatattgaccaacagacttgcaacctgagcattctcaatcgccactcccttgggtcgcatcaatagtccaacgatgtcaaatacgactgagaataaactaacgataatcgtaacaaaaccaacctccactaatgcatgagagagaaagtacctgctcatctcatctttccttttgccgcgcatcaaaagtgcacattcaatgactaaaacaaaacagataatcaaaatagttaaaataaccaatggacattccccgattctctttttgtgaatgtatcaaaatgtcaagacctttggacaccctttatgactcagatcgtacgctgattatttttcaatgtcaagatctcttgacgttttaacttacttttcttttttaaaagtaaataaaaggtgtctcaacgaaggcaaattctcccgttaagacacctaaaaattttattgatgctaactttttatttccatgctcgtaatccgctgatcctcaatgtgaagttctcgatcacacaatttacgcaagaaatagcggtcatgagaaaccaccagcagtgtacctgtatatcctgccaacaaagtttcaatttcttctcgcgcagcaatatccaaatggttggtcggctcatccaaaaccagcaagttaatctttttctgaaagagttgcattaatgcgatgcgaacccgttcaccgccggaaagatcttgcaatcgccgggcagcatcgtcactgaaaaagccaaactgagccatttctcgccgggcaacctgctcattaggcatgaatcttttaacaaaagttagtaatcggtctttaggtttacccaattggggattctgggataaataaccaacttgtaaacttgcccctaacgatacgcgaccactagtcggggttaactttcccaaaataagtttgatcagcgtgctctttccagttccattagcaccggtaatcgcaatccgctcaccccgatgaattcgaaaatcaacgtgttggaacaaaacccgttgatcaaattgttcactcaaatctttaacagtaattacttcattacccgaacgacccgcaacctttacatcttgcaggcgatgactaggcgattgaggaacttgaatcacctggattttcgctaaccgtttttctaattccttcgctttccgaaaaaacttttcgttttggctctcatttccccattggcgatactgacgaatctgtaattgcaatttatggattgtcttagcttgaaggtcatgatccttctggattttagccagccgttctgctttaagtttcgcgtaacgggaatagtttcccgggtaggtaatcaattcaccatcttcaatttcccaagtctgattcgcaattcgatcaagaaataatcgatcatgggaaatgactaaataaccgaccttaccctttattagaaattgctccaaccactcaattccttcagtatccaaatgattagtgggttcatccagcaagtaaaagtcggcatctgataacaacaactttgcaagtgccacccgcatccgctcaccgcccgacaaattgttgaccgactcatttcgaaacgcccaaatatcaaggcccttcatcaccgtatcgattcggtcggcaaaggcatagccgtcctgttcttcaaatgcctgttgtaaatcagcgtaccgggctaacacgttttccaagttagctggtgactgactcatctgatcctcacactgtcgcatagcaatttgtaatcggttcaagtcgggtttgctggtgctcaaaaaagttgcgaccgaattagccgactcaatgagttgttggttgaggtgcgcaatcttcatatccttggatcggctcacgacgccactatccggcttatcgctgccaaatagcatattcatcaaagtggattttccggttccgttggctccaactaaagcaacgcgatcgttatcagccagttgtaaagaaatattggtcaaaataggttcgtcatcatattgcttcgtcattttattagcttgaattaacatttttttctccttaaaagctaccggagaacacaaaaagctatggcatcacgcaccatagctttacttaaaggttttagcatcccggtggccattgtttaaaactatcaactatttttggacagactgatcccgttaatagccaaaataaaaacaatggcatgaaaagataaactcgaacgcatataatctgtttttatgttcatcttttcgtaaccgcacataagacgctattccttctttcgttgtttgttatatttaggatacaggtaatctggtttaattgcaatctgtgaataatttatgtcgtttcaattaaggccaacgtcgttagatcgcagcacccatattaagcacgatagtcattgaataactgttcaaatgttaattaccaagtacaatctgtccgctacaatcagccgatctttaacctgcaattatattaagtcgtggtataattaagcatagaaaaaggactgtctctgtaaagacagtcccaattcgctaagtgagtttaaccgctttacagacggtggctcagaaacgtgaaacgctatacaaaaatcgtcccaggttcgcttgccaaagtttcgatggggctttttttgtactttgaaggtcaactaattgattaaaataagacgatcacagcatccagattgaacaggatacattgtagtaaccattcaattgttaattaccaagtacaatctgttcactacaatcagccaatctccaacctgcaattatattaagtcgtggtataattaaacatagaaaaaggactgtctctgtaaagacagtcccaattcgctaagtgagtttaaccgctttacagacggtagctcggagtcatgaaacgttatacaaaaatcgtcccaagtccgctgtgcaaaagtttcgatggggctttttttgtaccttggaggtcgactaatcgatcaacgcgataatcgcgacgatgacgcttagtagcgtacacgttgcaatgatcgttttgaggattaagtcgagcacatctttggtactcaacaccgcaacacctttcatgtaagtatagtgaacttcctattacccacatacgcatgcccccttccagggttgacgggtcacttcccataaaactttaaactcgcttagctttaaaagtatatcatattttcgtgttaaccaacaggctgcaatcgttgctatatcagcgattacagcctgttggttatttttgaacgcttgttcgattttgagatattaataaccgtcgtttaaccaataaacagctaaattcatttaataagtcatattctttactttgattcatcttccgtctattcttagagcaaattcggcatcgattatcagaattaatcattcgagggagggctttaaaatgtcgaaaagtcaactcatcattggcattatttgcttaattggaatcttagcttctggaattctttttttcagtggcaacactcagttcgcgtatatcttggtcaccctttcaatcgctgctctggtaataatcaacttcatttttgcgctgcttaatcggcgaaagtaatttttaccaccaaatagccgtatgcttaaatcgcgtttttttaacgcagaatcattttgatttttcttaataaaagaggcgctgaaatctcaaaaattgagaatctcagcgtctttttaagttcattcaatattggtcactagttgtcagcatccggattaacgccagcctttaaatagccgcgccacacaatcccgcttacttttccgtttgcactcgtcacaaagtaataaacggcctttttcccttttttagatggctgcatcagcaaactttgagaaacgcgccacgtagttttagggtagtttttcaaattatggactttatgcatgtgataaacatcgtagatataagcagaccgctttgttttagcgtgatatggcaaattagattttgtgacggccttgagaacccgatactttttagctgcttgcgccggttgtgttaaaacagtcgcactagtaatcccgattcctaaagttgccataactgacaacatcaatgttcttgaaatcattctttagaccctccgtctatgacactatgatggctaatagtgctggttttaactaaaaacttttccaacttcattttaactgaaaatggaacaagttcaaacagtgaaagtgtcatttgaatgttaccgggaactggactaagaaatttgggaattctttaaacgcaagcagcacgctcaactaagaaaataataaaacgccaaatgcaaagccgttttcaaccatggcaattagcttaatcagggacatcgccatagatgattatgacattttaaaactaaaccacagtcaaaatatctttaaccaaccgtcaacttatatcgagggtcagtgggagatattggttagtgcattcttctcaaacaatcgaatcattctcccgtttaatttgaataccacgttcaaacacaacttgaatcacgtaaatggtgaaccatgccaaaatttcgaagcccaatgagtgaccatcagaaagtgatccgctggtgaaccccatattgtcaagcaaggctgacacaccatcaatggtgacgattcccgccactgaataattgatccaccgaatcacattgaggcttctgtcgttaaaaacctgattttctgaaagccctttgagcaattgactaatccagtaaatcgctgacatgtgcagtatgagaagcccaacggtcaatactgttgtaaacagcgaaacaaatagattatttctaagattgatactcgaataggaagtaaccatatttaataaatcattaaacgacttaccatcaaataggttgaccagcaaaccaatcccaaagatgattgccagcgtaatcagggcaatgacataccccgctaaaacaactaaacaaagcacatacaacaaatgtaaaaacgacttggaaaccttctgatctaacattttatcccttctcaaattatcatttaaagttttgcagatggctaacttcggcatacgtttgattgtttaaccgccagattgtcctaaacgtggccgggctggacatgtcatggtggggatgaaaattaaggaccgcgtacttattggtatagatacgccaagttgccttttcgtttttaattttttgatgaatcacataccgatagttgatttgtgaatttaccggcaagctggccttcttcacattgccggctgcttttttaggaaaatcagaaaagtaattgattgctttttgactggtaaacgtcgcaatcctttttcccgaacgattataaacatcgcaccagttacgcggctgtttggcagttactgaagattgagacgaacggcaaccaccaagcattgttaataggaaaacagccactaacgccttaatcacttttgttttcatgagattcgccttcttaataattgttgccaaattttcttaaggttcccaaacaacttttatcgctcatcatccaaatcatcgacatattctaaaatatcgccgggctggcattccaacacctgacagatcttatccaaggtttcaaaccgaatacccttagccttgccggtctttaaaattgataagttggcttgcgtgatcccaatttgagaggataacgacttggacgtgatctttttttcaactaattgacgatcgagattaatccgaatcatcgcgcatccccctttctaaatgatcgagtcattatctttttgaatttgcaacccgtactcaaacacaatgtaaatgacatagatagtaaaccatgccaatacttcaaaactcaatccgtgaccattcgaaagcgcgccacttgggttatgaaccaatttaaaaataattgctgaaatcatatctaatccaataaaacccataaatgaataattgatccatcgaacaaatcgtaaattggtctcattaaagatattgttcactgtgatctgctttaaaagccggtaaaccaggtaaataatgagaacacgtaatgtaaacatcatcatcgttaacccggtggcactcactgacagccaaatgggattgacgccaacaccaacgtactgattcgctcgacttgtcatcccgactaaaaactttagtaccgaaacttgactaacaatcggatttaaccaaccgccgataagcgccgccattaataccacccatgctaagacatgaaccgcaaataccaaaaagctgattttttccagaatactcaagatcttttttgatttattttgagttttcattgtgcctcacctcttcaaaattatcgtatcacgataattatttattgcaagagaataattcaaaacttgaataaaaccgatatactgattccaaaatgaagacacaaaaaaacgcaaaccggttgctaatttcggtttgcgcttgtcgtaattgtcttgatatgatgtcgctttttatgaattcaaatcaatccatcataacgccttaatcatatctataataaagctgagcgggctgctatttttgtttcaatatcaatcacattaattattttatgatgatacttgagtcatcccttcaatcaatcgacccaagttcatcaaattaatcgccaaggcatgtttggcaattggcgctattaatttaaccggtaacccgatcttagcggtatcagcaaacagggtttcctgaatctgcaaatgatggtctgcctcggttaacgtgaacgccaaatcatatgccaaccggccttggcgactatggtaaatgatccgtgaatcaactgcctcaactgtgatcacttcaaaatgattcaacgctccctgcgaccgggtaacagtaaatgagtgctcattttggttgaccgtctcgatttccggaacccatttcaataagtgaacgggattagccaagattttctgtgcctgatccgcagttgcgttgatcgtaacaatgttcgtcaataatttttccataaagtgaagcctcctcttgtttgatggcttcaccttatcaatctttgggtgatctaaaaaatcagaatcctgatattttaaaattgatcataaggttcttctttaaataattctgcgaataccttttcacgctgccgagcttcatcccgcaagtccaattgttcttcaatctcggcaactcttgccagcaaatgataaaaattagccagcatataatgcgaatcatgctccgtggcaaaatcaatcccatcgagcacccattttgtcgctgccgaccattgattcagctcaaattcaatcatcccagccaagtaaaaaataacattgagattttcttcgtatttcgcaatatctaattcatcggttgcctgctccaaccatttagcagccgcctgacgctggtccgcctgggcttttattaaccctgacgaaaccatccccagtcgagtcaacgttgaaaggtggttgtgattcgcattcgccaatgacatctggaaatccttaccggctcgaatcggcttgctatcgatgtgccattccgcaacggccaaatagtaatagtaggcctgcatctgcgcgtcgttttcaatccgatccaaaacagccggttcctgtaagaaatcatataactgttggtattggtgggcgttgcacaatttatccaacttctgattgaattcagccgtcccactgatttcaaaattatttgaaagactaatttcgtccaaactaatattgagtcgctgacaaagggcaattaacagttgggcattgggtgtatattgattttgctcgatagccgaaagcattgattgcgagcagataccatctgctaattgtttttgagttaaacgctgtgattgacgcgtgtgtttaagaattgtaccaagttcggtcgccataaatgcctccaaataattattgttaccagaaaagggtcaggttaagccaagatggctcgtgcaacctattttacaccaatttccactaaattttatcaaaaatcgcgtgatttagcctctgacgcccaaggaaacattcttcgaaaaacctcactaaataaacaagaaaaccgatgtatcccatatgcaatgtagaatcgtgctcggccacaaattcttggactgatagaaaatccatccaaaaattaaacctaacggtaacacagtagcaacattaaccccccatcccatcagtgataatccttccgcaaaataaattggaaaatgaatggcttgaaacaacaatgcctgaataatgatggcgctggtcatgtcaaacttcgccagcaagtagttgcaaaagaacccccgaaaaacaaattcttcaatcagcccggctgccagggtcacactaaagaaattaccgccctccttggtgaagggcatggccgtgatataaaacgaatggtgccgaaaccacgttgaaaatcccaaatacacaataaatatggctaaagtccaccaaaactgaactggaaaatgacgattatataatttcttcttagataaccaaagctgtccctgagttttattcagccaaaataatcccagcggtacccaaatcaacaccttaacggcgacattaatcagatcattagtcatcccagccgtcatctgtctttgaaacaatgttaaataaccttgggcgatcagccaaatcacccagaaaatcgcgtaattcagataaactatttttaatgaccattgcttatgcaattaaagacctccttgtaccgataaaccttaccattttcattgaatcttaaatttcgtttttattgtcattagttcctccaagataattccgtaagtatgctgtcatttccgatcgtaatcgaccctgtttctgcggatcatattgatactgcgcgtcaaaccagtaatcctcaggatacagccaaaccggcttttccaaccgttctttaggttctgatcgatatcggggaaatacgtgagcgtgcagaaactgatcacgattgcctaaaatatcatagtttaccctaagcgcaccggtgacttgcaataccgcatcgcctaaaatactcatatctttcagaaagcgaactcgctcgggaactgataagtcattaagcgatccaaccactcgtttgggtaataatactgagtacccgggtaagaattgcgtatcaccgaacaccgcaaaaccaccgggcatttctgccattaccattggattagtgccatttaaagccgcgctaattcggttctgctgccacgccgtcatcacaatcaccccatgttgtttttctttattatcggcgtcaggttttcatttatctagctttacttgatcagctagtcaaaataaccaatttggcgtttcctaaatgctccaatacatttctgatgctgttgattgaaaattggtggcaactgatccgaaggaaaataagctaaatcaagggtctcatcattcttggaattcaatcggccacccacttgatgaaccacaaatgaaacgaccacgcattgcaccacgtcaccattaggatagtgccgaatttgatcagtagaaacgcctaataattgatcaacggtcacatccaacccggtttcttccttgaactcgcggatgcaggcttggatggccgtttcaccatattccaaagcaccgccaatcaagccccactgaggaaaatcggctcgtttctgcagcaaaatccgattgtcgggatcagccaaaatcccaccagcaaataccaagatcacaggatcatgccccactttattccgaattgacttaatataatccatttgctcaccgccttaattaatatcatagctgaaaacaaggaaaactgaggaattaatcacaatttgtgacccgattccccagttttttaatatcaactatttgctaaaccaagcataaacccagtgccaataacacgatcatgatccgaatcacatgatgccagacatggaactgatgccttagaaggccattcagaatagcacacccaatcatcacgaggcaagctatcatcccgacaaccaagaaatcaccataatcaagggcaaagtaggtcactgcggtcaaacttgcgcaagccatcaggacatttgtcaagaatattaacgtattttgcttacctttttctttgattagttccacgaacgcggccgtcccggttaataacataaacgcgattaataagatggtgccgatggttctcagcatttatcgcagctccttagtccattctcgtaattaaatatatccacttagaatctataccttaaatattcatcccccaccaagtgctgtaatggccgcttcttaatttccgtaataactccttggttggttaagttctcaatttcacttctaatcttattcttgtgaaacttctttgaatcactcgcataaagcacattaattaattcgatatctttaatccctgtttcagaattttcactaaacaacttagattgggcaagcagatacataatattgcattggacagggtcgtgaaacgcacttttaattttatgaagcgtctgttcgagctggtcagatagctgatttaaattaataatcacatcagtttggccttcactaataatttccattattttctgaataaataacgtaacatcagcccgattctcccaattatcagcttgcttaaacgctttataataagcggattgatcggtgtgaatagctcccgaaattgataaaccggtatagtgatccaacttattggccaaatacgacgaaagtagatatctccctgtccggccattaccatcgttaaatggatgactattttcaaacatgaagtgcgtcacaacagctttagtcagatcttgaatgtcatgctgattcataaaccgaatgagtggtgtcaactttgattgaatttttgcttcgcgagcaggtggcgtatgaattttctgatcggcagttccaatatataccggttgatcacgaaatattttgccgtccggctgctgatctttcgaaatttccccttttaatagtttattgtagatttcgcgaaagtcttgaagcgattcaatttggtaggatttgccggtcaatgtgtcatgatacagctttaccgctgatgccagtcttcgaataggccgatcttttcctttggtggcaagttgaccaaccaccgtcccaatttcctgcttattagttttaacaccttcaatttcattcgtgtagtagatttcagatgtcaataattttaacgtgtaactacgcttggcaacaccaggcaacttctcagcaatcgccgtaatttggcttgaatttctcgtgatttcattaattagccgattgattgcattcgtttgaacaaagaacagcggataatgatcaatttgttcatactcatttttatccaacaccgggtacatgtccgtcacaatcgtggaataccctgctaaacgtcgttgatattcagcgtccacttcagcattgctcttggaaggaccgctgccattgtatttataaactgagagtaattgataatccaatttgattgccttctttcgataaatacttaactagttgatattatacaccgttgtaaatgccaaaaatgcccaaaaatcaaaatatatcttacatatataggatgttaatccaagaaacagtcaaaaataaaaatatgcaagaaatttgggcgctatttattgcgaaatcgttaaaatatcgtttatttagtaagcaggtaattatttaaaaaataatatgcctgcttttatacgattaatatcttccatacaccatattatgaacggtttatttcccttttcaattcctgccaataggcaaaataaaagccatcattccttgcatattcagttaatttgttatactgtactaggtgaataggacagtggtatgaaaagaagggatgaacatgaacaatattctagttgttagcaatcttagtaagaattttggcaaacacaaggtattggaaaacgtttcgtttaaggttccccgtggtaaagtcattgggctggttggtccaaatggtgccgggaaatcaacaattatgaaatgtattcttgggatttatccttattcgcaaggtgatatctggtttgaaggccggaagatgaccgcgcagaccaccggcacaatgggtaaaaagattggtgcgttagttgaaagtcctgctatttacccatttttaaccgggatgaagcacttcaaactttatggtatcaagccggctgaccgacagcgggttattcatctactgggaatggaaaattatattaatcaaaaagtcacccagtactcatttgggatgaaacagaaactgggaattgccttagctctggtaaacaatcccgatttggtcatcctggacgaaccaatgaacgggctggatctgatgtcaacgttggctgttcgaaaaattattatttcccaagccgctaagggaaccacgtttattgtttccagccacattctgagtgaactggaaaagatcatcaccgacgttgtcttgattgaccacggtaagattattttacaaaagccgctccaggccttaagggaagctggtcatcaatgttttacaatggtgaccaatcgcaattcagacgcacggcaactacttggcaatcatcactttgatgtttcactgactaacgatcaacttcagattcaaatttcgccaaatcaactgaccaatgttttacaaattctgcttgatgatcacatcaccattaccaatgtcagccaccaaggaatggatttggaaaccgcgacgttgcaatttttaaaacaagctgagggggtcgtcaatcatgcttgatttaattcgacaggaattttataaattgtttcaaaagaaaagcgttctactttcaccgcttgtaattttagcattaatgctgtttatgggaactggtggtaacctttctgatcgaaaatatttctttactcaaggtttttccggatttcaatggttggatatcgcaattgtggttatcggcgccaatatgatggcaatggaatttgagtacggcaccattaaacacttggttgccagccataacaataaatttttaatttatatttcaaaaatgattgtattgactatctatgatgtgatcatgcacttcttaatttttatctttacattcggcattgccattctagtttatggttcaaaacttcccctgcatagtctctacaatggccgaccaatcatcaacaccttcatcactgcaactttaggtgaccagtttggcacaatcttagtcattactcttgtctttctgattgccggtttaagtcgaaccagttcaatcgcggcaaccggcggccttgctttactcatatttggtaccagtgtttccagtctaattatcaaatcttttggatcagcatttccattcgttaaatggaatccggggaatatgtttaacgttggctttcagtttgctaccccgggcattattaaacaatcattcctcactgacagccagctggtaatcggtaatctcgtgtatattgtcttatttatcatccttggctacatcgcatttagccgaaagcggatttaatccagattggaggttcatcatgacaagcagcagcccgaaaaagatcattaccctcctcatgacattattagcaatggtaatgaccatcccgattttatctgggtgcagtggtaatcaatcaaaagaacttaatcaactcatgatcaagtcaaagaaaatgcaaaaatcgccatttcgcaagtatgactgggtcagcatctccaacgtgaaaggcaaagagatcgcccagattacaaatcgccgggacgtgatctatatttctaatattgtcggtgatgcggccaacgttgatcaagtgggaatcggaaagaaatatctcaataacgctcacctcacttatcgttatactttttatcaagctaagccaaaagttgcgattcatatgtcggtttactcaaactccaaacacgcacaggtatctaacatcccaattattcatgccgttcactataaactatcagatgctaactatcagaaattaaatcatccgttcacgagacttaatgcggtgaatttaattcactaaattacagaaccgtccaagagctttacgacaagatttatcaatattaatttaaggaggcaatttttatgaccgaaaccatcataaaagttcaaaaattgaataaatcgtttggatccaaacaagttttacacgatatttcttttaccggtcaacaaggccacgtcattgggttggttggcgcaaacggtgctggtaaaactacgttaatgaaaacaattttaggcctcacctctgctcaagggcagattacaattgatggccaaccaagctcattcaatcatcacgaaattttaaaagaagtcggcgcgttaattgaatatccaagtatctatccgtttatgagtggtcgggatcatctgaaattatttgctaaagagcctcagcgaccacaaaaaattcaaaatgcaatcgccgagctacacttagccaaatatgttgatcgaccagcgaagagctactcccttgggatgaaacaaaagctcggaattgcgatggcgattcttaataatcccaaattagtcattctcgatgaaccaatgaacggattagatccgcaatccaataaggatcttcgtcttttaatcaaagctaaaagtcaaacaggaaccaccttcctaatttccagtcatattttaagtgaattacaaaaaatagcagacgacttactagttctcgatcaaggccgaattattcaaaaaacaaccatgcaggatttattagcagcaagtgaccattatttagttttatcaaccagcaacgataatttagcccgacaaatcctgataaaagcgggttaccaattagtaagcagctccgaattaaaacttcggattagtccaaatacgagtttggagccaatcatcaaaatgtttgatcatcaaaaaatctccattttggatattcaacaccttgacgaaggattggaagattcagtactgaaactattagctagcgatcagaaagaattggagggacagaaatgagaacgcttctacgacaagaaggatttaaattactaaagaaaaagagtacttatctggtaacactcgtcataatcataatcattttaggccaagcatttttgggcaaaatatatccaaaagcaattcctgtaaaaatgtttttcacatccagttttggcgctaccacaatggttgtcttcgttttaatcgcagcctcggcaacatctctttccatggaatttcaatatggcacaattaaagaacttatttatcagcaatattcccgcagtacaattttattgagcaaatggctaattatgtttgcctattcgctatatctatacattatgaccggcatagttgctctgatcggaaaagttatttttgcaaataataagtttgccttgggtgataacgacatctactcaaaccatctgacattcctgcaacaatggttatctcagatgggtagcagttttatcacgctatggttagtgctaagtgttgtttttctatttgcaacgcttttcaaatcatcaacggtcgccgtcaccgcaggaatcgttggcttctttgcccttaatgcgattggtatcttaatgtttaaagtcatcgataaatttcattggtttaggtggaatccctttaacttccttaactatgcgaatcaggtgacagatcctgcacgtcaagcgttaactaaactaactaataatcagctattaatcggtagtctaatctatacagtcatcttttttggaattggcctaacatttttccgaaaacgaaatgtctagatgaatttaaaataaaggagccatctaacatgaaaacaccacttgtattattaatacctcttgtcttggtcacactaagcggctgcagtctcaatcaagccgcacccaagacccatcatcatgactggatcgacgtttacaacaaatccggcaacaaagtcgtcagcctgaccagtcgaaaagcagtcgcctacgtttctgatcacgttggggatgatgctggtaattcaaccagccataaattgccagccggatcaaaacttcaatacaaatatgtcatgcatcaacgtcggaataatttaagcttcaatttatacatctactccaacaaatacgctaaaactggcattcatcccctaccaaatagcacatggaaattatccaaccatgaattcagtaaattcagcaatccgcgtagtcttgaatagcatcagcaatcactgacaatccggttaccaagacactccaaatatcagtttgtaaccggcaccatggttttgatcttgaagacgaggagacgataatatgacaagatcaaatagactcaacttattttttggaattggaagcttggtttacttagttttagggatcattttttactacttgaaaatcacaaggtattttgtgagcatgactaatcccattttaattgccttggtatttatttctgcattaataatcgcttcaaattactttgctaacagaagtgatattgtcagcaaaagcattcaaataatcttaaagatcgtgaactacctgttttatatctattttttaaccatgattattaacgctatcttagaaatcgtttggagacagacccaaatttcacctaccgttttcttttacctggggatcattttactcgctacattaagcgttcccttgctatccaaacttgtgatttctgaggagaataacattctaagaatgattggaattttcctcttttattacatgattatcacgacgccgcttacccttaagatcggcaggacttggttccccgatttagcattagtgacattattatcctttatttttggaagtgctttagtcatcttcgcaatgagaaaatggggctatcgttttccaagatttaaaattaatcacaatgttaattattggtggttggccggattaatcctcccgagtttcctctttatgggattttcagtgggaagttggacaagactactttctacgccatttacaattaatctaatcgctccttttcctgagaaaagtgtgttaccagtagtcttctacgtcatttgtaccattctgatgacctgtttcaaagaagagctaatcttcaggtatttattcctggcacaactgcttaacatccagaaaggcaattccaaacgaaaggtattgaaatcagtattaatcagttccctactgttcggcctctggcatctaaaaaatcttaatcatcagccattattttcaacattactacaaaccctcgctgcttttgcactcgggatgattttcagtctagtctgcctatacaccggaaccatctggataaccgtcatcatgcatagtatttttgatctcttcatgattgacagggcgatccctatttcacctttccaggcacagcctaatgctttctttgttgaatatatcatactggcagcaattatcgaaattggccttgtcctatttatactcaataaaataaaccttgaaccatttgaacaaacaatccgggagaacagattcttaaaagtttcaaattaatctgataaataaacaactaattgaggtggttatcatgacaaatcaagtcattaacattcaaaacgtcaccaaaagtgtttctatcggcaacagtaagcaaactctggaaattcttcacgatatttcgttaaccgccaacgccggtgaatttctcagtattgtcgggccgtccggctctggtaaatcgacgttacttaacgcaatgtctgggttatccaaaccaaccagcggtcaagtaactattttgggaaccaacccttatcagttgcgccctgccaaggcagccgcgtttcgccgtgatcagattggctttatctttcaatcttacaacttaattccagcactacccgcattcgataatattgtgcttccacttcgattggcccatcgaaaggtcgataaagaaaagattactcaactgctcaaacaaattaactttgaggccaatcccagtaattttgtttcagatttatccggtggtgaacagcaaaaggttgccatagtccgtgtcttagtcgcaaacagtcgggtcattttcgcggatgaaccaaccggagccttggacaccgtttcccgaaaaatcatttttgacttattacgtcacctggcaaatcaaggtgtttgtatcatcatggtcacccatgatattgaaatggccgccgcaaccgacaaggcaatcaccttgagtgacggccacttggaaaaggtcattgatgaccccacggctgaagaaatttttcaagcacttaacgaagaaaagagttgatgatcatgctacgaattatttggttacaattcaaacattcctggaaagcatggttcgctgccctcttcctattcatcgtcaccggctttttaaccggaacctgtttaaacgggattttcaccattgctgatcacttctctcatttgagccgaatggaaaatcccagtgatattttttactacccgatgattttcggcgtcatcaccttgtttatcgtttccagtggcgtcatcaaattagtgatcaacagcatgagtaaagaatacacgttatggacgattttaggcgctaatcccaatcaacttgccattctaatcggtggccaattagccctgcttggtgcgatcggtgcctttatcggctttatctttgccgtcccgtttaccgttgcgctggatacgtgggttaccaatctgacgggatttgttcacatgccgataatcccacttgagttctcaattcctgcctgtttctggacagttgcgtttatttttaccatatctggaatggcgggctacctgcattcgcacaaattatttgttaactcgcaaactgatattttgaactttaagaagcgtcgttcaaagtttcaatcaataacccaccttctactaatcctgattagtgcattgggtttgatcgtttcctacggcaattcactcatcgtcacatcgcaagcccaacactatctagcccttggtaattcccatgaggctggtaaaacttacacccaaaatttaatgattattatgctcttatcaattatattattcgcattggtcgcacaactgattttgccaaaaatcatcaaattttggacgcagattttaccacgacaaacatccgcaaccgttaataccgcctactggaacacaatgtttgataagaactacctatcatcattaatcgccccactgtttggtggttcatttctattaaccggggttacgtacatcacttccgggatcactaacggtgggactaaccaagaagcgaccgctaattcaattgccagcttagtcatctatcttggcgcaccgttactgattattttagcgaacgtgttggtcattaccgtgattgttagtaaacaacaacgaactaatttaaatcaactgttcttactggggttcacgtcaaccaacgcaatcgttgaaagaataatggaagcggtcatttatgcggttactttcttcatctgtggtgtgattggcaacttaccgttgtacctgactgtctaccggatcgaagtgatcactcataaaccaatcaccgtatcatggttgtcaacgatggcttggccagccggtctgtttgggattatcttgatttttgttgcggccgttggcggatggcacgtgcttcgatttgagaaaagcgctgagaaacagatgtaatcaaccattaacaagtaggaatctctaattcttgtgaagaaaaatgcaacaatttattatcattcttttagatcatttagcactcaggttgtcactacatgtaagtacaagttatttggaatatacttgtaagtaaagaaggagagcgattattttgattaataaaaataatgaacgagtcttaggagaatttgtcactcgccgttcaggaaactcactttctctcacggttccagctgatgcaggaattccagaaggaaaaaagtatgtcttggttgtcaccggtgacgacactttagaatatcgcgccattcacagtaatccttggttagatggtacttatagcgacatcaacttccgtgccgaattggctgataccggtaattatggtctggaaaagccgattggaaagcagcaaactgattgataactcctaaacagggcgaccttatctttattgatgctgagccgcatgctgaccatgaagaaggtgagcatggtggtctgtatgccaatcacttctaagcttaaaaaagacagacgaatttacttgccaattgccgatcatcctagtgggattcatggatcaattattacatttcagattccaaactatgattactttgcccggcacggcgaaactgttgggaaagttagtaccgctttgttaaataacttaatcgaacgtgctaagggcatcttttaacgcttgtttcaatttcatctgaagcaaccacgatatttttcaagtggctgctccttcagtaataattaatcaaatcgtcccatttaaaacccaaccaaataaaaattcaatccaaaaaaatgttacggcaatgaagttctcactgtcgtaacatttttttagaatggattcccatattttctacaataatcataaaagcctaaccgatacaagtccacttcctttttagcagctttctcgccctcaccgatcagatctaaagccagttcagtaaaatccaaggctgctgttccgtttgcagtcactaaatttttatcacgaaatgcctgagccttaacaaagccgttttgattatggtaattctgataagttttccacagatactgcgcgttaccggtatgtcgataatcatttaggaacccactccgcgcaagataatcgaccgatccgcaaattgcagccaggggtaagccacctgtcaattgtttcctaacaatctgatataaagcacgattctcaagcgtccatgatttgccaccaacgagaaccaacagatcgatttgattcaatgaagataactcagacagctgatagtcaacttttgtcattaagccaccaattgagtgactaatagcctgattggatgcatatttaactgtccagtctttcttttgattcaagattccagttagataacctggttcccaatcagcatagtgatctagtaatacaataattgcatttttcaaaattagcctccaggaaaatttagcgataaaacaaatcgcactatacgaacacacgtttgaataaactttataccattagaaccctaaactcaaatttcgccaatttctggattaactaattatctcaaacagcatcacattaataagcagatacccatctaaataaaaaaatcaaatttggggcgttatccatataaccgaaatataatgatagtgtaaaaagttgtttgcttgctcctgtgaatggagggataaacatgaaaaagatcatcgttattagcccaacttttctattattcatcggcttattagctgggttactgcttcccagattggcgttttcaactagaaccgacttcattgcctatagtatgaccggcttggttctctactgcttcttcactatttttatttatggtttggggctcagttttcatggtcagaaaaaatttgaccgacccactaagcttttgtttggttacttatccacggtattagtattagtcgtttttgctgccatttttttaatgggccatcactaaacgattagttttcaaagaccacctactagatttacaatctcactcgataatttgcataaaaaacgagatcgaagcgaatttctgctgcgatctcgttttttgtatagcgctattttccaaaagcaacagcatcacgatttttcgataactgtcagtcattcaagcgaacaattcaactcaataatttgtttcgactgtcgcttacttaccgccatttgcctcatatttttgaaaatctgagtccggcaaataaagaatactcaagtaattggcatcatagttcttgcttggaaaagttaaatcaacgggtagcttttgaggactggcttcgcttccaggcgcttgagtcgttcgaccatttgcatcataaaaggaaacgctaatcgagattgatttcttatcagtcaattcttcaccataattcagcctaactgaaaaaaccttctgccatttaccgttttcataatggtattcgtcaaaactgtaattctcagtaatttcccgatagacctttcctttattcggatccaattttgaggaatctcttgccggatcaatatcatcgtattgaatcccgtttttaacaatcggaccgttcgaaaaatcaagaatgtttgcggttcggacatagcataacctatcgccgtcttggaacacggtgtattgagatccgggttttaaatataaacgatccccataatagataccctggtagttgcgcagtaacgattgattaggcaactcatagcttaatccggcgtaaacaacatatgggaatgggtgatcaaagttggtcgcctttggtgcttgcttgaccgtggtcgcagtagccgcatcataaaacgcttgaaaggtgccagctcggtaccactcaggttcccctttctcataaccagtgccaatatcttccaaatcgtagtacatgtattcaacaaaggggactttgggcccagttccattggcatcaactgaccgcatcacaattcggaagttctgccaaccctgggcgttattatcaaccacgcccatattattaatcccaagttcctgatttcgctttttgataaaattaacgactgtttgaatctggctttgggtcggcaccttcgcataagcatcgtaggattccaagccactcagatatggcgccttatgccgataggtactgatatccgtgtcatattcgctggtatcaatttttttagcatccgcagccgagacatttgaataaataacaccatcatttgcggtagttgaactgccgctcgtatctgaactatcactggtggaaccactactgcttcccgtactcgtactgggcgtggttccagaacccgctgcgttagggttaacacccggcgtcaaataaccacgccaaatgtagccagcatgtttttgattaccactcaatactttgtagtatattcggctcttatatcctgaagtcatcttaacagcttcagtcttgtaccacgttgtccgtggataatgctttaaattgtgaacgactctggtgtgatgcgcattccacagataaatggtaccgctatattttgcatggtaaggcacgctcggtgaatacaatttggtctgagtccaacgataatatgccgcgtgagccggatgcgttaccgtaatcgcacccagaaacccggcagccatcaaaccagttgctgccaaaacaatccgctttttcatgattccaactaacctccaagatagattgccccttacgtagacccagtgtttagatgatcagcaccaagtttacccccttgtttagtttgattgtacacctcgcttattttgctgaccagatgcaattgacaaatgatcgtccttagcagctgcagttactcgaaccgttccttgacgatcgtatgcgtaaatccgcttttcacatatcagcattgtgaccaatgcaaagatgcccaaaaaggttagtatcaatgtcgtatttcccaatgcttgggcaatccccgccaaaactgtactaaagccaacgtccaaaactgaatcgccaaattcgacaaagcttgcctgtgctgactgaactgaaacattagtatttttaattctggcttttgaagctaagttagatagtgggatagtcgagaccatcacggcaacaatgcttaaacacatcaacaataatgatatttgaatagtcataatcaaaaaggtccctgtcaaaaatagtactaacgacagcatgagccacgagtagcgctcaaaacggattaatacaaccccaattgaaattccaaccgcatacgaaactaggagaagcgcaattttgtcatagtgaggatcaattttattccagaagtaaattaacaaatcgtcaaataccgtctcaactaatgaaaatacaatactgatcgcaatactttcacgtaatcctggatttatccaaatcgacttagcaactttttttaaatgatcaatcgtactaaatcttaattcagcgttatctgaagatgctttttgaaccagtaatattgctaaaatacagttgacaaagtacgcaattccaccaattaacaagtagcatctaaattccttggttagagatacaacgataaaaactgctcccagactggcaattacccccaccattcctaacgaagaattccaattaataaccttgctcaaatcttgcggttcaactaattgtttaataatccctgaaaaagaaagcgactcaatcagggaaaacaggctgacaaatacatccgaacaaacgtacaggatcagaaataactgattatcactaaaaaagggaattagtaatgaaataaacattaacgcattgaataggatcaaggatctccttttatcaacactatccaattttgaaccgataaataaggtactagcgattaaaccgatagaactaatactcgcaatggaactgttgacaaccaatgagtcggacgcacttttaataatcagcatcccgcccacgtatacttcaatacttgcaaaagagctaatcattgccataactggcaataaataattattaagatgacgtttaaccaattcaaccacctcgaattaaatttcgttactgttaaaaatgaatgaccttatcaaacagcttttccgtttgcggatgcggcgtatgactaatcataattaacgttagctttggatttttgagtaacgccatctcaatttgaactgccgtttgctcatcaattgctgaggtcccttcgtcaattagcatcaccggaatttcccgaattaatccccttgccagtgccaatcgttgaatctggccgccggaaaagttcttaccgctttcaccaatatccaaattcaaataatcttttccttcatcggtgctttgaatgagtttcatcttcagcaaagcctcgattaattgctggtcactaaattgtgctcccagcgacagattatttctcacagttgtctgcaaaacttgcggtgattgatctaaatacaggagccgccgactaatttctgcgggacgatattcagtgagcgacatcccatccaaaagaatttgaccttgataaccaggaatatatccagcaagcagctttagtagcgttgatttgccagccccgctttcacccaaaatcaaatacttcttgtttcgtaaaaaagtcaggttaacgtgatttaaaattggtttcttggcatcataagaaaaactgagatccttcgtttgtaatacggctggtgctgtgaggagctgtttggcgtgcggtcgcaaatcagtatctgccggctgatcatcaatcaacggatattttgcaaaaatcggtcgggtaccgcgaatcattccaaggaaattactcatattccccagtgaattaaaaatattgccagccaaactaccaaccgcgttaatcgtgccaattttaaccaacctttgaaaggctaagattccgctcagtccaatcagaataacctgcgacacaacgttgcccataaatccggtcacttggacagcgatttgaaatttacttcgattgacgtatgccgttttaattaactttgaggattcctttattccatcaaccaaaagatgcagtgtttgaaacgcatataataaattaaatgccgataaaacatcctgcgtccggttaacgaaacgttcgttcccctgcgttaattttaaatttttctccgccaacttcttatcgaatattttgggcagtaaaataattaacccagctagaaccaaagctacaagagccaacgaccaatgatatttaatcaacgttaataccgcgaagaccgtccccaccgcaccttgaatgacgacaaacaacggtgataatccctgttcattaatcacctgaatatcattattaatccaagactcgtagacgccatatggtttagcgttatattcggaataggatttttgaatcagcagcttggcaatattgtttcggatcgaaatatcaatattttggatcacaacttcttgatagacgccttcgatatattccgttagaacaaccagcagccacactgttaacagtaatgccacatttttcatgaattgtgcaaagttgtgggcaatcagcgcatttaaaatatcggcgttcaaaactgagccgtaaacggtcaatgcttcgatcaagacgatcaatccagatagaattgccatttcagatttatgtaataagacgtattttttcaacccaatcatctctaattaatatttaataattagcttctgttttatacttgtttaaagctcattacaagactgggttgacatgtaagcggttatttgttcacattgaataattaaaattctaatattgtttattaatcagctccttttcaattaaatgattgctatgataaaaagaaactttaacttctaaacaggtgattggatgcaagcaaaagagaatcacaattttaattttgaaaaagcaactgttgatcaagtcccaaccattgttaagatgtatcaggcgagctttgcggaactctatcaacgatatcacgacgatgcaaccagtccgtataaggaatccacggaatcaattacccaaaaactgcaacactccaatagttcctactacttcattatttcagataagcttaaagttggcctgattcgcgtagtgaccaccgtagcaaaaaaagaggcaaccatttcgcctcttcttgtattgcctaaattccagggtcaaaagattgctcaacgagcccttcaacaaattgaattacaatatccgactgtcaagatttggtccatcgacaccattaaacaggaacccaaacttgttcacctgtatttaaagtgtggttataagttaattcccgataagattcaaacgattaaaaatggcatggacattgtgttttttcgaaaatttaatcaaaccagttagttactatactcgcaaatttcaagtacaacttagccactaagtcagccacggttcattaattgttactataattatgggaatcaaatcattactcatatatttttgctaaatttaaaaacaggtcaaagtccacacctaatgagcagtttccagttatcgaaccctttctaaaaataaaaatgacaatcttccaattaaaaattcagaagattgtcaatttctctaatataaattagtaatgcgtcactgtctgttattgaggttaaacaaaaactttcttagcccatttacatcgtcaatttgtaatttgccaaacacagcaattatatttaatttgcttgcgtcaattttaaaagctgtatctacccatgattgttcctgcaagcctgcttcatgccagtgttttattttataaaaaactcgttttaagtaatccggtttattggcatatttgctggtaatcttataagcaattggaagacgaccaggcatttgaaagattaaaacaggccttgatttaccaccctgcttatccttaaatcttacatacgcataaacaatgtctgcatttttaattttcatcgtcgtccccggctaaatatttctggatctcctctggattagtcaacgttggcacgtcactatcataaacagctttagctaaactgagacgtgctttttcttcccctgttagtttaaattcaaaagggattcgtccctcagctgcaactcgtttatataaagcagtaatcaccgccgtgggagtcaatccaagactgtcaaatacggctgtagcatcgctatcaagggtgcgatccatctttacctgaattctcttttgtgttttttctgtcatttttaagttcctcctttatccatacataattttactacccatagtacttaattggtagcatattgtacacggtactttaatccactttattgtttaacgatccagttacatactaaagttaacatttccatccaacaattcagaaataaggatttgtaacaagaaagcggcccgaaattaaggaatttatccttaactcgagccgttccattttgaaacttataaagtatctaggaaaccaggcaaaaagcgttcaaatatatcttgattgagagacacaaatttatttagcccaactttgcgagttgttgttaagcccgcttcacgcaatgttttgaaatggtatgacactgttgatttattgatatcgagtttttcacctatctctccacaactcatttctttattctctgcgtaaagcatcttaacaattttaaggcggacctcatctgccaatgcctttagtatctgtactcttgcctgatcgtccgttatttgtttgataatcataaattcatcatactattgaccgattttttggtcaatgatatactcttgcgtaaagtagttttaaaactatcgaactactaaactaacaaagaagaggcaacagaatgaaaaaatattcgataatctttttcttaaccatgtttttaattgggacagatacctttctcatttcaccacttttaccaacattaagtaatttgtatcacattccaaccgcaatttcaggttggatggtaagtgcctacgcaattggttacgcagtttttgctcttttttctggtccaatttctgatggccgtgaccgcaagaaagtaatgacttggggattattagcctttgcattgtcaacatttctttgcggatttgcttttaacttccagctgatgctcctatttagattattagcaggaattagtgcctcatttgtgaccccgcaagtttgggcatcgattccagtagtcgttgatagaaaagctattgttaaagtgatgggatatgctaccgcgggactgtctgtttcacagttagtcggcatccccatcggcagttatttagcagccgtttcatggcagacacctttcttcgtcatttctaccatgtctctcattctactggcattactagtatttgttttaccagaattagaaatcgggcaacgggaacgcttctcctttttcaaaacctattcaaaagtcatcactaatagacgcgcaatcagttatttgtttgcctattttgtttttcaaactggttcatttacggtaatgacctttatttctacttggttcactaaaagttttggattaactttatccggagttggcactgcaatgattgcgattggcggtggcaatttaattggttccctttttggcagccaaatcgttgaccatttaggattggaaaaatcatttatgtatgaactgtttgccttaatcgctctgtatctcatcatcccatttgtacatactttctggctggctgagagtttactaaccattgcattcttattcaacggcttcattttcccattatttatgacaacactccaaagcactgttaccaatgccagaagcactatctcatctctctcaaatgctgcgatgtactttggtgagacaattgccggaattattggcggcattctctttaaccaattctacggattttcagccatctcactattcgccttcatcatgattggcatttcattgatcttatacactgggtcaggcattttcaaaagaacccgggaactcgatggatagcagacaataaaaaggaagaggttgggataataatcgttttgcttagtctctgtcagtgtaaacgcaataattgccgagtaaaaacgcagggtaaaggcaacttccagccgtgtaaccggattatccaaatattcagattcaggatatctcgctgaacaggttacttagaaaacgtggaccaccaagcagaccccggccatataagccccctaacttaatattccaaaatcaggaatatcttgttggactttttacttagcagcaatgtggaccaccaagcagattccggccatataagccccctaacttgatattccaaaattgggaatatcttgttggacttttacttagcagaaacgtggaccaccaagcagaccccggccatataagccccctaacttaatattccaaaatcaggaatatcaagttagggggcttatattctggggtctaaccgcttggtggtccactcttaattctcaataacttgccgacttgctcgttgattgtatgttttcccccaaacttccatcgctaaaataaccggtttaagtgttaaaccaaatttagttaaagaatactcggttttaaccggaataaccgggtaaacctttttcctaattacgccgtcaacttgcaattcttttagttgcagtgccaacattcgccgagaacaatccggcatttccttctgcaaatcattaaatcgctgagttcctgtcaatagatggtaaataatcacacttttccacttgccggcgataatttgcaaggtactctcaaccggacagccagactggcaattataaatatgccgtttcacataaatcccttctctcgtaatcacatatgctacccaccaccttctagtctaccaaattcaccactcatcgcatgaatcaggtgaaaaaaatgtaaccaagtgacattaaattcacgtcttgtatccattttccaatgggttagactgaattcgtaagttgaagggagatatcatcatgcaaacaatgacagcaatcggttttacaaaagctggattaccaattagtgatccagacagttttaaaacatttacagaagttgtgccgaccccaagcggccatgatttattggttaaaataatcgccacatctgttaatcccgtggacatcggggtccgcaacagcggtcatcgtgacttgaaaaagccaaaagtaattggctgggatgcttatgggacagtaaccgcaattggcgatgacgtttcactttttaagccaggtgacaaggtcttttacgcgggatcatttatccgttccggcaccgacagtcagtatcaactggtcgacgaacggattgtcggccatgcgccaaccaagctaacaccagctgaaattggtgggatgcccctgaccagtttaaccgcttgggaagcgctattcgaacgcctgcaaattgatcgtcatgccacgacgacaaacgccaagcggaccatcctaattatcaatggctccggtggtgttggttcgatcgccacccaattggctcacatggcaggccttaatgtcatcgccagtgcttcaaggcctgaaaccatcgcgtgggtcaaacaaaacggcgcggatgaaacagtcaaccatcgtcgaaatttggttactgaagttcgaagcctcggctatcattacgtcgactatattctgaatctaaatgatttagacggccactggaacgaaattgcggaattaatcaaacctgccggaaaaatcgcggccattaccgagaaccgacgcggcatcgatttacaaaagctgactaaaaaatgcgcctcatttcattgggaatggatgtattcaaaatcgtattaccacacatcagacatggttacccagcataacattctggatcaagtggcagctttactcaatcagggaatcctccattcaacagttacccaaaccttgaaaccaattaatgctgataatttacgggaagcccatgcggcagtggaaacaaaccatatgatcggtaaagttgcgatcagtaacgagtaatgtttcccgtattaactcaaaaccgttgccctcaatctccaacaaatctataattaatttattaatctggatgaaaaatatggaggtaacaatgtttacgctaaaggagtttcaattaggcagccgaaccattcgtttggaattaccggaagaaagtcacgccaaggccctcttcaagattgttgaaaatgatcgtgaagaactgaagaaatggatgccgtgggcaaaaaccaccaagcatcttcgagacgaagtgaatttcatgaaatacgcccgggagcaaatgatcaatcaccatttgtttatgctgaccatcttgtgtaatgatgaaccagtcggaatgatcgacctgcacgagattgatccaattgaccgccacgctcaggtcggctactggttatccagtcagtatcaagggctgggcattatgacggcttcacttaaacaactcatctcagtgggctttggtcagctaaatcttcataaaattgtggtgatggccgattccgtcaacgaaaaaagtaaagcgattcccgaacggctgggctttatccacgaagccacactaaaagatgaagtttacatgaacggcgactttaaggatttggacgtttacgctaagtttgcggataaaaaaatgcatcaatcataaaagaaaagtctgaaaaaagccccgcaggctcggcccctgtcaaggagacagtcaagtaattaaaaattctatgcacatttttaaacggcgtgatttcgatattccatcggagtcatgccgtttagtgttacttgaagccgttcaaagttataccagttaacgaactgattaatttgagcggttagttcggttttggattgcgctactctaaacgcaaaaaattcatctttcatgtgactccagaaagactccattgggctgttatcaccgggggtcccagcacggacgttactctgcttgggaaagacacgtacaaatgactttttaactcactgccatttaaggcgcagaatcaaccgttcacgaaatatctaatgcactatactcatactggtatataataactaccaaaagtataatggaggacaatacattatgggaagatcaagaacaaataaaggattcaagcagttgtttgttgcgtttttatcatttagtattttctggatcagtgcagccctaagagcgggaaacgtgatgctaactattcagttagcaataattcactgtgtaatggtcattattttcctagttatgtactatcttatttttaaaaccacaaagttaaagattagacaaaagatagaacttagatgggcagttacactttcagcactgctaattttatttatttttcttgcattcaatggtatttatacccacatacacattgtaataaagtcagctaatttcttagtaattctgttaattgctgtatcgtcagcactgctcgaggaatttcttttcagaggaatgttttttcaagcaatacttaatatattgagtaaaagtaatttacccctgacctattcaggcatcatctcttcattgctttttggtttttggcatttgtcaaatttcctctggggagggcaaccactagaaggcacattgcagcaagtaatatttgctattggaatgggactaatattagtagctgtcagaattatttcaaaagatatatggttaagtgttttgatccattcatggatagatttagttccaagcgggcctatagtgagtaaggttgctccatgggggtcagccttactcatatacggaataataattacgtttttaattttcattatatttatctacgaacaaggactatttttcaaaaagaaatcgttagtaagcaacaaccacgaggaggggtaaactatgcaattatttttaaacgattttgattatgcacgggatcaggggtccccattttacacggaattaaatgggcggttagaaaattttatgccgcacactaattactttcagatacctacagtagattttaatcatggcgaaatgatacgtaaaattgatagtgaacagtaaacattggcagattaaaatcaaggcctcagctaaaagagagtcgcacaaagtactgaaagggccacatcagtgattcttttaaaactataagaaacgctcgaccctccttatacaccacttgatttcaactgcaaataatacaaaaaatgcaagtacctaaaagaggtcacttgcatttttatatttctgctacactgcttcgcttagtaatatgagtcggtataaataacggtgctttcttgcccatgaccttgttaacactttcaacaccaatagtatagaagtcttgtgtcacactagtcaatgcaggtgtcgcaatctgacaaataaccgtgccatcaatactaataattgataattgatcaggtagctggatacctttttgctgtgcagcatttaataatccagccgcaaccatatcactagcagccacaattccggtcactcgtgtcgacaaaaagtctcccagtaattttaatccagagtcatagctataatctcccaatttaatccaatcatcctcaacgttaagctggtgttctttcatcgccaaacgatatccgtcaattcgctgactgccggtatgatattggtcaatcccagccaagccaattttcttatgaccgtgcccgattaaatagttggttgcttgataagccacatcccgattatttgagcttacggctagaatattgttctgttccaagtataaagaaacaaaacaaaatggcgtccctgccccctcaagtaacttcatatcctcctgatcaggttcaatcgctactaataagattcctgaaattgcgcgttctaaagctgttaaaattgcttgatgttgtagttcagggcttcgattaccggcatataaaatgatcacgtgttgcccaaggctattagcttgtttttgaataccgtcaataatctgagtagaaaagttagttggcgtggcattaataataacagcaatcacattaccttttttcttcactagttcaaccgcagtattattttttcgatatcccatttctttggcaattttaaggacttttcgaccagtctttttactatatgaatcacccttgcttgccaatactcgagacaccgttgcaatcgagacacctgctttatcagcgatatctttaatggttggtttcattcaaaattcacctgatttcatatttcttattataacctactctctcaaggaaaaaattactttattttttgtaaacgtttaccttatcgtcgtatagccattgtaaacgtttacgtaaagtgctaggatgaatttgttgaaatgattcctaaaaatattttatctaaggggatggattaaatgaatcaatcaacaactcatttagcaggaaatcataaagttttatcttcaccagttaaaagggaaactgcgaagattaagaactcattaccaaatttaccgatgaaaacattgtttgcaattacctttggcttttgtggtgttaacatggccttctcattacaatcatcacaaatgagccggatctttcaaaccattggtgccgatccaacaaagttgggtttattctttattttgccaccattagccggattaattgtccagccattagtcggaaagtattccgacctgacatggactcgctttggccgcagaatgccttatctattattcagtgcaccaatagctgctttagtcatgattctcttaccaaacgcagggtcgtttggattcggatttgcctcatttgcagcgttactctttggcgcaattgctattctattcatggatctttcaagtaacgtctgcatgcaaccatttcgaatgatcattggtgatatggttaacgaaagccaaaaagataaagcttggtcatggcaacaggctttcagtaatctgggcggcgtgattgccacactcttaccatttgtcttaacttatctgggtgttgccaatactgccaagcgaggcgtcgttcctatgtccgtccgtttagctttctatattggcgcagctattcttctcggaatttccgcttataccattcacacggttaaagagtatgatccacaaacctatgccctttatcatcatattgatccacaggctcataaagtgtctaaatcaatttggcaactaatcaaagaagctcccaaagctttgtgggaagttgcagttgtccaaatgttcgcctggattggcattcaatacatgtggacttatacaaccggtgccattgctcaaaatgtttggcacacaaccaacgttgcttcttcaggttaccaagctgccggtaactggtacggtattctaacctttatccaatccattgcagccgttttatacgggttccttattctgtcacgcactaatccttacaaacgtaagaattggtaccgtttcgggctattagcctttgcaattggattaatctgggtattctttattcataatcaatatttgttaatcgtaccattctgcttaattggtattggcttcttcactatccacgtcgaaccatttaatatcttcacttcatcattaaacggctcacatgaaggctcatatattggtattttcaatggcacaatttgcctaccacaaattattgcctctgttgccagcttcatcgtctttcaactagttggcaactcaatgccaggtatgatgttggtagctggtatttcaatgttaattgctacattagcaatcagtgttattaaacaggacaagcctcaagaagacctgtcagatagtgccaaataaataataaattaaatactgaaaggaaatcttactatgttggaaatgtctaaaaccaaattaccaaattatgaacagcatggacaaacaatcacctttgattattcgaaccatcaattacaattaactgtattaaccccggaaattgttcgcgtatttgaatatcgtggaaatgacggatcatcctatgccattgaaggaagtaaagaacaaaagaccgacttcaccattaagcagattgacgaccattatgagctaaggacttctgccttgaccattaaattggatgctggccaacaccttgacgtttacgaccaaaaaggtaatcccttagtcactgattatcgcggtaaacgtcagttgctgaataaaggaatcgacaaggttcatgaacgcttggttaaagctgaagggcatagtgtcagcgaatcaacagttaaatcagattccggttactatcaaatcgttaaatcacttgcggctaatgagcaactttatggtttgggtgataaaaccggttacttaaataaacgcggctacgaatacgataactggaatgtcgacaatcccaacccacaattggaaaacttcactaaactctataaatcaattcccgtaatgctggggttaaaaaacggtcgaccttatggcttgttctttgataacacctataagagccatttcgacatgggcaaggaaaattcaaactattatttttatacagctgtagatggcaatatcgattattatgttttaggcggtcgttcgttaaaagatgtcgttaccaactatacttacttaaccggacgagtcccattgcctcaaaagtggacactcggttaccagcaatctcgttggggatatagcgccagccaaaaggaagttcaagatattgtagatgggcttaaaaaatatgacctgccttgcgatgcaattcattttgatgttgactatatgcgtggctatcgcgttttcacatggaataaagataattacaacggcaatcctaaaaagtttgtttcagatctaaagaatcagggaatcaaagttgtgccgattattgatccgggtgttaaaaaagacccggaatatcagacctatgctagtggtataaaaaatggttactttgttacttcaccagacggaaaagtttatatcaataaagtatggcccggcgattccgccttccctgattttggcaatcccaaagtacgccagtggtgggctaataacaataaattcttaacggatatggaagtatccggcgtttggatcgatatgaacgaaccggcttcatttgaaggtcaaattcccgataatatcatctttagcgatgaaaacaaaaaatcaacacataaaaaaatgcataatgtttatggtcataatatggcgcgtgctacctatgcaggattaaaaaaacaacaggataaacgaccatttgttattacccgtgctgcttatgccggaactcaaaagtattcaactatctggacaggcgacaaccgaagcatttggcctcacattcaaatgatgattccacaactatgtaatctgggaatgagcgggtttagttttgtaggaactgatattggcggatttgcttcagatacaacatcagagctgctaacccgttggattgaagcagctatcttcagcccactgctaagaaatcacagtgcaatgggaactcgtcatcaagagccatggagttttggtgaaccaacactttcaatttaccgtaagtacttgaaattacgttatcacttcatcccttatctgtatgacttatttgcccaagaatcgaagaacggattaccaatcatgcgaccacttgttttaaattatgataatgatccaagaacccgtgaaatcaacgacgaatttatggttggcgataatgtattagttgccccaattgttgaaccatcacaaaccaaacggttagtttacctgccggaaggccaatggattgacttctggaacaaccgtgaatatgaaggccaacaagatattgtgatggatgcaccacttgataagctaccgctatttattaagaaaaacacaattcttccatggggaaagtccgttgatcacgtttcagaaaaagctgatcaggagataacctttaaagtcttcggtgatcacgcagattatcaacattatcaagatgatggtactgacttcaattatcaagacggcgagtttaaccagtatcggattacagttgatggtgacaatgtaaatgttcaattgaagcatcatgggtttaagtctgcttatgagaaaattacggttgagttgccagatggcaaaaatattttcaaattatataataatggaaaatatcaggatcaatagcgccttaattaatcttagagcgaatttcaatatccgttaatttaaagattaaaaatccaagcaatttgagagaaccatgtctcgagttgcttggatttttaattcactggaatttatgtctcccatactacttattttaccttttcagatgttttgtgcttttatgtaaaaggcacctctattttaatcaataagattaatccaaaaacgttcaataaggctgagtcacttggataactaatgccagtataattaagtagatatattgtgctgggaggacgaaaaaggtgcaaaaatttggcattatactcaaaaattatcgattcagatcatcaaaactcctctagaagaagtatcgcaactaaactcagcatttaaggaatacaacagaggcccaagatcacaacgccataactttcaacgccggccactcactctgccaaccttttcgccggattcggtcctgataaatggttaaatgggcgttatcatttcgaaagcttggcaccggccgacaaatcaaattaaccaaatcatccgttccatatggtgcgatcagctgaatctgattattttttaaataagccccaatacaggttggcgtttcaacaaaattagcaatggcatccctaaccgaagtaaacggcggccggtcagtgaagtcataatggtgcatatgggcttcgtttttcacctgccactgaaactgtggcgcctcatgattaagttgttgatcaagtcgaccatcatcgctttttggccttcgaggatcaaagaaaacaacatcaacatcactggtcaaaccggtgggttggtgatttaaaatttgccagactgtatttcgaatactcccagcggccaaggcaccctgacgaagatgaagccattcaatcatctgcaaaatggtcatcaagtcaggtgtttcggcaatcatttgaattacctgttgatcactttcactgctcatattggtcactcgccttttgtaaaattgctcacacccaattaatcggctcactcatgacttcggcaaacgatccattccaaattgtttcatggtgcttgataatttggttcgccgataagtctttcgtgtcaaacgttgagtccaagccactgataatcgccattttaaaacctaaatcatgtcccactcgaatagcggtatcaatacaatattcggtttgcaggccacaaacctcaactgccgaaattgaccggtgatgcagaaaatctgccaaaccggtttcaaagaatgaatccgaatgatacttgagaatcactcgatcggcaggcagttgatgcaatcctgtcgtcaactgccaagcctgactgtcataaggcaaatcttcatcaacatgttgcacgaatacaattggtcggtgagcttgacggtactggtcaattcgctgattaattttagttaccaactcatcaaagttagccactgaactgagaccattttgaacatcaatcaccaacaaaatatcttttagtcctgaattaactgccaattttatcccttcaatccacgtgcttggcgatccatatcttcgaccacaatatcaaagatctcacctaatgatgcacagtactctagaatttcccatggcttgttggtatgaaaatgaattttgatcaacgtctcatcaccaaccgcaaggagactgtccccctcaaagtgtgctttgatatacgcgtcaattgcatcttcatccaaatcatgaccatcaattaaacattgggtatcgtatttatattcaaccatcttattttctcctcaatccattattctttatttatcggttaacgaatggggcttaccttcctgaatcaatacacgttgaacacttggccgttgacgcatctgtttatcaaacgcctgtaggttcggtaacccttcaaaaccaaagttcagccgtcgcagccaatttgtcataacaaatagatatgggtcagcaagtgaaaattgatcaccggttaaccacggttcgccagtcccaaactgagcttccacaaattttaatcgcgaataaacccgttggtaaactaatttttttgactcggctgtgttcggcaaccaattaccatgtcgaaacggcgaaataaagttcttatgtaactccgtggcaatgtaattcaaccaggaccgttgctgccaatattctggcgactggtaaggtgcgattaaatgatcatcaactcgggtcgctaaatattccaggataaccgcacactcagtcagaacggtcccatcatctaaaatcaacgttggcacatacgacttagggttgatcttattataatcccctttagcccaaattttgcgatctaaattcactcgatttgctgtataggataatccactctcttctaacacaatatgtggcgccattgaacttgctccagaagcataaaacagttgaactgtcatcttattcttcctctctttttaattcgacgcttatcgaaataaacttcaaaataaaaggattcacagggaatccaaaaaatttggtaaatacttctgaaatgtctcgcgattaatcgacaacaatttagcttgagccatttgccgcgtgttggtcagcccagccttgcgcaaagctttaaaatgataagaaaccgttgatggtgaaatatttaattgccggcttacctcaccacaagtcagctcacggttgctatgctggagaatccgcaaaatactaattcggtttggctcactcaatactttaaaaatatctgctaatttttgatcggttctttgttcgatgtccatagaattaacgtagtcctttgaaattattttgtcaatcctattttactacttagtccaattatcgatcacttatttttatcgaatgacactgctcaatttattttcatgttccgccaataattcaaatagtgcctaaccgctaagccacttgccaccacaactaagaccgtcgcaattggattaataatgagtgccggataactactgagcaatcccatatagatacccacaacaatcccaccagcaaccaaaacgcccaacattataatcccgatcataaagttaccgctgccacgattaaataattgggtcacattggtccaatttaaatccaacaattgccaatcacgggtaaaacagaaagcactgcttaagatatttccccaagcaacccccagaattagtccaatattattcagccaaaccatttttgcgaaaattccaaaaacaactgccaggataatcaaaacaatggtttgaatcccaacgatcagcttaaatttcaaactaagataatgtttaaagtcaattggtaaggaccggataaatgacaggttttcccgctccagggaaataaagacgctaataaccgaaccggtattaatcgtcataaaactcacgccaacaccagcaacaaacattgcgccagcatatttagccgttaaattggctaacgaaatgccgccattcaagaaaagcgaaacaaaaatgaaaaacagtggaaacatcgtcattgaaaatgactgagttaacagcgtcggattcttcaataatcccaaattataacggataaactggcgatccatgcccccattgcgatgaggccgccgaggcttgcgccgcaccggctttccagctgatgcatcaataactaacatgcgtggcagcaaccatttttgcatcactaaaatcaaacaaataatcgcaatcaccatcaccgccatcgtgatcagacttgtttttcccaatggattaattagaatttgctgcatttgaagcagaccgggaattgccccagccatccccagctgatcatcggtggtattgattaccagaatcgcaacccccattgccagcatactcaccacgttcaacacaaaggtcatcattttttcatgacgctggaaaaatttagtttgggcaaagctaaagacgacaattgtgcaaaccagaaacagcaagatatagtaaacaacaaaaaggagggttccaacagtgaatccaaagggaatgggatgccccgattgaacgccggtaatcatgaataataaccaaacgggcaaggccgtcggtaaaatggtcatggcgattactgaaaattttgctaaataaatggcccactgattgaatggcaggggcaggtaatcctttaaatccttgctttcaaagaaaacgttattgatggtgttaacgctttgcgacaggccgataattgaaaataaccccaccatgcttgtaaacatagctggatgatgagcgaagttaatcgtcaataacaggaatccaaacatgacggtaaaaatcacgccaacggttatgtattgttgaatcaaggcctgaaataattgacggccggttttaccattatcacgtgcctttttcgtattttgtgggttcacatacagaagctgtactttaattaattgccagagttgagaactaaacatgcggatcatccccttcaaggctgccaattacttgatcgtccccactacgaccggccattttaagataaatagtttccaaattgtcacccggaactgtagccaacaattgtttgactgatccattataaattaactctccttgtcgcaaaatcgctaattcatcgcagagttcctgagcagttgccaacacatgtgtagaaaaaataaccgtcttccctttggcggcgtgggccttcatcagttgtttcaaatcataggcagcttgaggatctaaaccggtcatcggctcatccaatacccaaatatcaggatcgggtagcaacgccccaatgataattgtcttttggcgcatcccgtgggagaactcgccaatcggctgatcaacatgatcctgcatatcaaataaattaactaatttagtttggcgctgttcacgactttcctttggaatttggtaagctgaggataacaaatcccagtagtcattggctgttaattccaaaaaaatatcaggtgaatcgggcacatagccaatttttcgtttgattgccaatcgctgttcctcaagggataagccatcaacttgaattgtccccgccgttggttcaataatgctcaccagactctttaaagtggttgatttcccagcaccgttgtggccgagaaagccaaaaatttcaccatcgggaatcttgagtgacaggtctttcaacgcctcagtgttgccatatgtttttcgcaaatgatcgaattgtatcataagcatcctcctatttgaatttgtcttagtataacatgacatctcgtaaccaacttagtcaatgtggattaaggaatccgacttaatgaccatcccgattcacttgattaatccatctttaaatgcccgcaaacattgagcgggttattgaacggtgatcaattaatgtgataaagtgtggcaaaggagttgttaatcttcatggatcgttccgagttaatctattttccaatcttcctgggtatttatcattttatcctctccggcagctactcactaattgttcaccacagttatcctttctgggaatatttgaccaatacaatcgaaggaagcatcattttttggattgtctggagtgtcgtttatttctacaagaggtatcgaaagaatcggtttatgtagtcagtcctgattgaatactttaatttaaaggccggtcataattatttttgcatagaagggagttgctgatttagatgaagggctttttgattacaattctatcaatcttgttcatcttgtttttatataattttggcatcctgggtggttattcagtcttggttaaccatacctatcactttatggcctacttatccgatacccttggtgtcagtttctttgcggctcttttttatggaattggtgctaagataaaaaagatctactataagcatcaagcacataaaaacggttaaactttcactggcactggttattttgagatgagattcaagcgagtcatcatttaaccaacttattttgaaactaaatcactaccgttttcacttaaaaggggtggctaattcaaatgaaagcctatttagcaacggttttatcaatcatcctggcactatttttatgtaactttattgtgttgggcggctactcgtttctcgtacaccacacttaccactttatggcctatctgattaatacgcttggcacgggcgcctgcgtttttgttctagttggaattggcatgggtatccagatgctttatcgtaaacataaacagagcggagaaaaaaacgcctagcttttcagcgtaagggacttatcaaaatattcaaggttagaatattttgataagccccttacactggaaactgttttttctccacattttcgttcggtcacaatcgtgttacatcaggtaatcaatactcccagcgacttaaatccggcccatcgggaataactcggtccaaagaagtcaccggttcgtcactcacttgataaaaatgggccttaatggattcaaagtcagtatcctgcttaaatgctggaatttggtaacaatctctcgcgtaacgccaaagattaggatactcatccaaccgttttcggtttaacttgtctttaaagtagaacaccacatcaaaccgaaccaaacttacaaacaatcgaatatccggctgcgtgatgtgatcaccaagcaggaagcgattattgcctaaccgttcctcaaaccaatctaaacggtcgaaaaactgcttggctaatttttcataagccacctgcgaatcaaccgccattatctttcccggaattgatgtcacgtcgttaataatcatccggtttaaggctaaaatggcttcactttgatcatccggaaaaatatccgggacatcagccgtaaaagaggacttccaagtagttgacaactcattcatgatttggtccgatgaattgttaaccactttgcccgttttaatatcaaccagtgctggaactgacggccgctgatcgaatttaggatctgcctttcgataattttgcgataatcttgtcgtttttaaaatgggatcctgatcgctgtcggcctttccaaagaaccaatcatcgtcaaccccggcatgccgtaatgaataaatagcaccttttgaaattaccttatttagcccggtataatccatcaaaatggcaattggcgttgcccaaggacagaagcgcccccaaataagccgataacgattcggctcaattggtaactctccagttgtaaatttcttttcaagaattgtgcttgccgttggtttgggctgccaagcacaggcagcggaaatagttttgtctttcatatccttcctccattcgttattatgctactgattgtggtactcgcagtatgctaaggacaaaaacggcaatcattaatgtcatcaacccttccagtaaaaatagttcgtcaattccaatgacatgagaaacggcaccaccaaccataattcccaatggcattgaaatattacatccagcgagaaccgaaccgctaacccgacccaataaattggcaggggtttgcgtttgaatgattgtgtagaccgaaacattaataaagccggcagctaaccccattgtgacaagcgtgaagattgtgccaattgggcttcttaacagtgccattaaagacaccgacgcgcccatgaccagaaacgtaaacaccagttttcgtttcaaaggccatttcaccaagttaacaaggatatttccaagaatcacgccgctcatcaatccaatctgagtcatactatagatcaaagcgctggaatgaagcgcgccacgaacccaaataatatccagcctcataaccgggccaagagtaaagttgatggtcagggcaagaaaaatcacgatttttaaaataggctgccggaagatatagttaacaccggcataccatttactatcctgttttgccaccactttcggcaccttttcgtggaaagttaacgtcaacgcgtagataaagattatcgaaataataaacgtgccgccgttaatcgccatgaaccaagataagggtacaaaggcaaccatcacaccacccagcaacattccaatcatttgcgttaccatctgaacgccctgattaaggccattagctttacttaaggaggcgcggtcaaccaattgtggaatcaatgcatcaactgccggattaaagaacgttcccaagacctttgaaagaaacgaaattaggacaatggacactagcgtgatgtcaccggactgataaatgatagttgccagaatcattaagccaatctggacaccatcaaccaacttcattatgttcgttttcttaaatttatcggctagaaaccccgtatagatattcaataagacgattaagttgaatatcgctgttacaattccaatagtcaacgcgttagtcgttactttatataagtaccacatgatcgcaatatcaaataaattattgccaatctgtgacatcgattcacctgtgagtagtaaataaaatccttttttcacgcgatcatctccaaaaaactatgtaaaattaaaagcaccgctgattatagcgatgcttttaatcacctgtcataacagttgaactattatttaggatttgcggcagttaaggataggttgctccagaactcattattttgagcattaacatcataaccctttactcgatggttaacgggtgtccatgctaaattaaactgttctggaccgtaagcggcttgactgttcatgtatcgttgccacttcttgaattgttgtgcccgatacttggcattccatgccttgttgctattcaaactgttcaataattgagtgttcttcttacttgcaaaatgtcccatattgtaaggtgcatcaacaccataaatttgagttggtgttggttcggatgaagttgaccatgcagcaaggaagacatcaattttattttgttgtggcttttgaagaacagagtagaaactattcatttccattggtttaccagtagtcatcttaacgttcaacccagctttatgccattgttgcaaataatattgataggttgcttcggttgcagcagagcttgccatagctccaagatgaatgactaacttcttaccattaggatcagtccgccacttaccttgcttcttataaccagctttgttgagcaatgacttggctttcttcatattatacttaaaaccaggtgtctttgaatcataaacattcttgaatgttggtgggatcaaagtatttgcacgccagctgagtccattaccgaatttcttcgcaacagcatcaacattaaccgcgtacatcatagcccgacgtaaattcttattgcccattttagaattcttatccatgacatttaagcctgtcttagtgttcatatgcccaacattaaaaccaaagtatgaatacctcattgctggaatacctgtttctgtatagtcttttaatactttaactttaggatattgactggatggcattacaacattaggtccgccagcagcgaaatcatattttttcgatttaaaagctgccacaatattattagatgaaacaacttgaatggtaatattcttaatctgtggtttcttgccataataatatttattaggcgaccaactggttgattcaccctggacaactttgtcaagtttatacggaccagtaaaaatcggattctttcgaactttaggtgacgaagcaagttttgaaattggtgtctttccataatattcatatggctcgacagattgccaaataaacgagttccctaaatattgcattgaaggcgacattttggtgaagtgaatgacaactgtccgacctttttgtccatctggatatgtaaatcctgaaatggtttttgcttttccagcatgataagcagccattcctttaatagcggcaaaatctgatgaatattgctgagacgttgtattcttattaccgataatttcgtatggatactcaacatctttagcagtaactttcgaaccattagaccactttgcatcctttcgaagtgtaatggttgccgttttagcctttcgatccagcttaagattagctaaaccaccattaataatcttataatttttagttacgttaaacaaaccatcaattgcgccccattggctaccaccaggtgcaaaaacatcttgatcttcagcattagtgcttaaagttggtgatgaaatcccagcaaatggggcgtcattaacttcagcgactttcaacgtactattactaccggcggtcgttgctttaccagaaccggtatacgatgctggtaacgaaatatgtttggttgtacccgaattactactcttactattcgaacaagcagccaaggtcatgactgacagcatcgcaatcccagctgtgagccatttctttttattgctcatgaacatccctccaaaaatttaatagaaaccaactaaactaacaattgaaactcacctcaatatgcaaaaaacacatcatctcctttaatgatcaatcgttactttttgtcttggccacgacgttgggcagcattggttgtccgtctcatgacttgaccgatgtaactaatggataaacataaaataataatttcaacagcagcaggaagccaagtccaccaataaccagtaatgttttccggatcattggcgttcgcgattaaagtaccaagtgatggggttcccattggtagaccaaagcccaagaatgaaagtccggtttcaaccccgatattttcggcgaatgacaatgtcgtatcaacaataatcaatgaagaaatgttgggcataatttcacgaaagataatctttaagttaccagttcccgaagttttcgatgctgcaacgtaatctttttgagattccgataaggttcgtgaacgaatcagtcgggaagttcccatccaatagaagatcgacaaaattaaggttaatgtgatggcattgtaatggggaatgatcgtcacaatgacaatgatcgtcatcagcattggaataatcatcataaagtcataaacccgttgcattgccaaatcgaccataccaccaaagtaaccggaaaccaggccccaacaaatcccaaaggttgatgaaataatcgttaaaccaatcgcgatacaaattgagtttcgcgaaccaacgactaactctttggcaatcgaccggccaccagcatcagcacccagccaatactctggtgtaaatggttttgcgtagtatcccataatattggtttccatcattttagggacgtcaataaacatcgacgcaataatgacaaataggataaatgcaatcaagatgaacaatgaaatcaaagctggcttatcagccacaaattcacgccacataattttagcggcagatggtgttgcttcttgattcgcttctttggttaatttttccaaatcagcttcagaaattgatgttgcgtcttcaatatctcgtttcatttctctgccaccccctattcaacccgaactcgtgggtcaacgatacttaaggcaatgtcagaaagcaacgttcccattaaattcaagaaaccatacagtagaaccaacgcggtaataaccgtataatcccgataattaatcgcgtttaagaatagcagtcccatacctgggtacgagaagaccatttcggtaaaaatggaaccacccaacaaaccggtaatggaataaccagcgaaagccgcgattggcaacagtgagtttcggaagatatggtgtcgataaatgtccttcattggcacaccctttgaccgggcagttcggacataatcggaatgcttggcgtcaataacttcagaacgcaaatactgaacaatattgacagtcccaaacaatgctcccagtaaacccggtaggataatgtgtcccaaacgcgatattaatgtctcaccgagcccactcgcttgagccgatatggacccactcgttgggaaccaattcaaggcataaccgaaaatccaaattccaataaccaacacaacaaagaatggaattgacatggtcacatatgtataaactcggaccaaggtatcttgaaatttaccttcatgacggcccgcataaatacctaatggcaacccaattaagtaagtcaagaccattgtgaacaaagctagccaaagagtattggcaccccgttgcttaattaaatcaacgactggttcctgatactcgtagctcatgcctaaatcaccatggaacaagtggacaacccagttccagtattgctgataccaaggatcgtaaagcccgtgaatctgcattaaatgatgaatttgagcttgacttgcgcgtggattaatcgatccggtaaagggatctccaggcatcgctttagcaagtaagaaaaccaagatactgaggataatcagctctggaatcataatcaagatccgccgcaaaattgttttccacatcagacatttacctccttgttctcagcttgctgctgaaattttttagcttcttctggtggcagggcaactgaatgagttggcgaaaccttaaccaatggaaaggccatcccatccttgtcgtaatatttttgctgttgttcttgatagattttttcaatttctaatcgatgttcccgatgttcttttcgatgattcacattagtttccggaattgcggcaagcagccgtttcgtataaatgtgcattggttcattatagatatcttctctggttcccacttccacaattcgaccacggttcataatcgcaatgttattacacatatgacggacaacccctaaatcatgggaaataaataggtaggaaatcccaaagtctcgttgaatttttttcataaaattcaatacttgggcttgaactgataagtccaaagcggaaaccggttcgtcagcaataattaattttggatgagtggcaactgcccgggcaacgccaatccgttgtcgctggccgcctgaaaattgatgaggatatttatataacgcatcggcatccaaaccaacaatatccagtaattgcaatacccgtaacttttcagcttgtttatcaagcttttcaaaatttctgagaggctccgcaataatgtcttcaattcgttttcgtgggttcagactggataatgaatcctgaaaaatcatttgcacgtcgtggttataatccaatttacgacgattttcagctttcgtaacgtctttgcctttatatgtaacggttccggaagttgctttttcaagcccaataattgctttggcagtcgtggatttaccagaaccggattcaccaaccaggccgtatgtttcaccagcctcaatgtcaaatgtaacaccgtcgacggctttcacattgtccacaacccggttccagaaaccaccccgaatcggatagtggacctttaagtccttaatttcaattagactcattgccggcaccctcctttacttgatctggaaaatagaagttctgatagcaggtgcagcgaaccatgtgaccaggttcaagttcatgcatcgtcggatgagcttcatgggcagaggccggaatccaaggaatccgtggtgcaaaccggtcaccatccttaggcatcttctgcaaagaagggaccattccggaaatgacgtatagatcatcgttttcgttatcccgttgtggcattgatcgcaataatgaccgtgtgtatgggtgcttaggttcgttaaagatttgagcagccgagccggtttcaacaatttggccggcatacattaccgcaacccgatcggcagtctcggcaacaacgcctaaatcatgcgtaataagaataataccagcatgattttctttttgaatatcacgcagaacatccaagatttgggcttggattgtcacatccaaggccgttgtcggctcatcggcgataattaaatcaggtttgcaggcaatcgcaatcgcaataataatccgttgccgcatcccacctgataattgatgaggaaattgatgcgcggttctttcgggatcaacaatcccaacttcatttaacagctcaattacccgcgcgtgacgctgcttttcatccattttggtatggtaaaccatcacttcttggatttgatcttcaattcgtttcaacggattcaaggctgataacggatcctgaaagatcatgccaatttttgctccccgaatttggttataacctttctcatcaagtttcagtaagtcagttccttcaaagtcaatttcaccggaaatcttagtttcctctggatcatggagccccataatggtcgttgccaaggtgcttttgccacaaccggactcgccaacaatcgccaagatttcatcgtgattgacttcaaggctaacatctgaaactgcatcataatattgaccgttaatcttaaacgcggtactaacatccttaatgcgcaagaactggtcggatttagtctcaaccaagataacttctccttctagaatatcatttatgtacgtcccacccggcaaattagattgcagtgagtggcacaaatatccgtttaatttaaaagtattatattctcattgtattctcatttcaaactgaattaaactgctttttgaaaataatgtaaatttttcacataagactgattaggtcccaaacaagcgttcagttagtagtaataattcattatcgaaactgcaaataatatgattaaccgtcaccagatcggctggtatttaacactaataaaccaaacaaatttgtccttgatttgctgatttattttattacttttcaactccggaacgatttaattgatacatatatttaactatcccggcaaaaacttatggctagttaagcccgaatagtatcatatagtatagaaaagaagttaacttggcaggtaaagataaaattcaaggtgttggataaaagcagtgattttgttattgttaaggaagatgcagtagccgtatacattaaggaggtcgttgacgactatcatggcaattaaaatgtatgaagttcagccggactatatgacaactccaggagaaatactccgagacaccataagaagcaaaaatctaactcaagagcaggcagcagaagatctaggcacatctgccaaaactttatcaaatatcatcaataataaagtatcgataacgcctgaaatggcgctgaaacttgaatatgttttagaaacacctgcttcgttttggaataatttagcaaaaaattatcaggaatatcaattaagaattcactataaatggcatatttaatttaaaaattaggacctgtaatagccgagaggttgtcccttccgctactacaggtcctatttatttaatctgactatttatttacggcagtaaatcgttcattacgatgagctggattgataatttcttcgacaatcaccctgccaattgttcctgaagttacctccgacttgccagccgcgtttttcattagtgtattgttgccaagttcataatccgcaaacgcgcctggcttgaagttggcgcttggtgaaacagcaacccagttaacgctcgttgtattcttcagcaactcgtattctttagcttgctgccgcggtgtttcaatgaaggtttccttattcgggtaagtttccagtttgtcaattaatcggtggccatcacccgtttcaagactaccagcacctaaaataaagaatagtcgtggcttatcttgattcttggccagttcaactagccgagcagctaaatcgacatgttgataggctttattacgatcacccggagcgaaggcgtcaacaacaacatctaaatcatcaatatcttgatgttgaatatcaaaaacatccttggcaacatattcaacttgatcaccaaacatatctttggctttatccaaattatgaataaaagcccgaacttgtaatccatggtccagtgcttcctgcgtgatcgcacgaccagccattccagttgcaccaattacaccaatttttagtgccatgaaatcatcccctagttattttataatctgacgcttaatttaagtatctgttatttggcgggggtggtcaatgaattggtttggaaaaacagagtggaccagcaagcgtttagactccagaatataagccctctaaccttaatgttcccgattctggaatattaaggttagggggcttatatggccggagtctgcttgctgggccacggtttaacttagtaacaagttcaacttgatattcccgattttggaatattaagctaggaggcttatatggccagagcctgcttgctgggccacgtttttacttggcaacattcactatctcacccaaagcaaaaaagagaccgagcaagaataatttgctcaatctcttttttagaaaaatcaattcagactactttagttctaatggttttcctgcgacatcaatggtaatcgggtcaccattaatcagtttaaagttggcaccagtcttatcaacgtcaacctcaatcaatcgaccacggaagacctgacggaatgaataacgagaccatttcttaggtagaaacggtgcatagtgtaattcgccattgcgaacccgcataccggcaaatccttggacaaccgcgatccaaccacccgtcatggcagtaacatgcaaaccatcacttgtatcattgttatagttatccaaatccagacgagctgttcgttcatacaattcaacagccttatcttcgtaatgtaaatcggcagctaaaactgaatgaatggcagctgacaagcttgattcgtgaactgttaatggttcgtagaaatcataattagcctttttctgctcaggggtgtagtcatcgataaagtcccagataccttgaagaacatcaccttgtttaatataaggtgaccgaagaatcttatcccatgaccagtgttggttaattggtaattgatcctttggaattgcggttaccggttgaatatccttatctaagaaaccgtcatgctgaacgaagatgtttagtttcttatcatatggtaagtacatccgttcaacaatatcttgccagtgctgcttttcttcatcactgacaccaagtttttcagcttgcttagaagaaacttctttaagaatctgcaaggtgtatttcagtgtccactgggccaaaatattagtgtaccaattattatcaacgttattctcatattcatcaggaccggttacaccatgaatcatgtattgttgtttccgttggctaaagtgaacccgatcagcccagaaacgtgaaatctctgtcaatactttagaaccttcgttaaggacatacgaggtatcgccggtgtaacgagtgtaattatagatcgcaaaggcaatgtcaccgtttcgatgaatttcttcaaacgtaatttcccattcattatggcattcaatcccatcgaacgtcaccattgggaacaaagcaccttttaatccctgttgcttggcattgtgataggcgccgtccaattgtttataacgatacatcaacaagtttctggttacttttggatcagtaattccgagataaacgggaaccgcaaacgcctcggtatcccaataggttgcaccaccgtacttttcaccagtaaagcctttaggaccaatatttagccgagcatcttcaccatagtaggttgagaagagttcaaacatgttaaaacgaattccctgttgggcttcagtatcgccatcaatttcaatatctgatttattccaacgctcttcccaaatcttagcgtgggcgtcaaacaactggtcataactctgtgccgcaaccttatcgcttaattgatgcatggcagcagtcaaggcctcgtttgaatcgtaatcacgcgaagtaacaacaatcacccgcttctccaactgagccgattgatcaggtgctaattgaccggcaaaagcattaacaacggctttatcattgggctggtcaactgccttactcgttaaatcagtaacgtgacgcatttccattgctgacgtaaatcgcggtgttccaaatggatttggtgtcgttttggccatcacactgccggattcagtctgttggtcagtatttagaacttcccagaagcgctcgttatagttggcatcttcgtttttaacgtcggcatcaatggcagaatcaaccacaatgtcagctgacttctgaccaacgtttttcagtgttaatcgctgaacagataattctggttgcgccacacttaagaagcgttcaaatttgacgttaacctttgcatcgcccttggtaatcgtgaatgaacgggttaataaagcgcgcttcatatcaagatcaaggttgaagtcactaaacgtatccttggcaagatcaattttttcgccgttaatcttaacattcattttaatgaaattaaccgcattgacaaccttaccgaagtattccggatagccgttcttccaccagccaacccgggtcttatcaggataccaaacaccgcccagatataaaccggcaagactatcgccactataatcctcgtcaaagaatccacgcatccccatgtagccgtttcccaagctggtcattgattcctggagacgtttatcctccgggttgaactcatgggtcacaatattccagggctgtacttcaaaaattcgtttcatgttttatattcgtcctttcctatgctttatacgtttctttaattagaccaactgaaagtgcaccaattgccatcacaattccggcaaataagaacatgttttcctgggcgttgccaagcaatgggaataaaccaaagctggccagtgaggcaacaatctgtggtaaacaaattgacccgttaaacagaccaagataggttcccatatgctcaccagaaagcgcgttggtaatcatggttaatgggtaggtgttcattgctgcccaagccattccaacaaagataaacgaaacaaccaatgtgtattgagtatgaataaagaagactgataagaaaccaagggcacccagacccaaactcaatgcatagcctaatttatgatgattgtttggaacctttgccaaaacatatgaccaaataacggcggcaattgattgaacggcggctaacacaccgtaccagttaccagctgcctgatacccagttgatgcggcgttagtggtattccaaacgttgtgggcaatcgcgccagctgaataagtccaaaggtactgaaatgcaacccaacagaagaattgaactaatgttaccgtccagaaaacctttggtgctttctttagaagtgcaaaccagtttccaccagtcgtgtttgcttcctcagaaataccatgatacttagcatatgtggctggatcatattcgtgaaccttaaagatcgttagcaaacttgtaaatagtaagatgacagcgccaacgtagaacgaaataacaaccgattgaggaacaacaccctttttagcagtgttggcaatcccaaaagcagtgaataaaaatgggaagatcgctgcgattacagccccaccatttgataagaagctttgaatgccgtatgcataactcttttgtttatcattaaccatgtccccgaccatcatcttaaacggctgcatggcaatgtttgacgagacatccaataatgcaacagtcactgcaccaaataaaagtgcggtaattgaggcgtaaccgaaaccgaaactacccgaattaggtaataaacacattacaataattgcaattaacgttcctaatgctaaataaggtaatcgtcgaccacctaatttaggtgcccaggttcgatctgaataatagccaataatgggttggacaattaatcccgcaagtggcggtaaaatgaaaaaccatcctaatttatttggatctgcaccgattgtttgaaagattcggctcatttgagaactttgtaaggtaaatgccatttggacacctaagaaaccaaagttgatcatccaaatcgtactagccggaagtttgggtaacccagacttctttgttgctgcttcagcactttgctcctccatattcgttcctcctagatataaatcaataacgtttacgagaacattatggcatgattttacaattaatgcaaccggttgcatagatataagtatcaataaaccgatttcactcttttaccgacagtgttggtagcggttacagttaagtgaagtttcaaacatatccactttatcttccaatgaacctgacaatctttgaacttttcatggtcgaactgagtctctgcgcagtaacgtcactggtaacacatatcgatccaatagtggatcatcagttttatttaaccgattaaataatagtcgaaccaccagatccacaatatcatcaagtggctgaacaatcgtactcaattccggatgatactctcgaacataggttgagccatcaaagccaatcacttgaatatcatcgggcacccgcattcccaaacctttaacttcttgtagacacagcagcgctgtcaaatcatctgtacagaataccccgtcaggatggtgattgattaattgctggcgaatattagcccgcttaatgcctggcgttgcgttaaagggcaatctaacagtggccgaagttaagccggccttcttaactgcatctaaaaatcccgtcagtcgatctgtattgtgaggcagttgatccaagctccctgaaatcagcatgagattttttgaacccttttcaatcagcgtattcgcggctaatcttgcacccgcaatgttgtcacagctgaccgttggaatcaaatttgcaaaataacggtcataggaaacaatcggtagtccagacatcttataagcttcgattgcttcattatgagaaccggtgataataccatccacctgatttgccatcagcattttcaagtattgttgttccttttccggattattgagactgttacaaataatcgctttatatcccacccggaacagttgatcttcaatcctctcgacaacctccgcaattaatggattctcgatgctggcaaatatgaggccaatcagtttaaattgcttaccatgcaaagctctcgcagcagaactcggctgataatttaattgctgcatcgcttgaaaaactttttctttagtagccactgataagtagccgcgattattaatgactcttgaaacggtcgttaaggatacccccgcgactttggcaacatccactagttttggctgcattaatacatccccagttttaatatttccccaattgatagtatctttgtcatagttttggcctaagtatatcacaggatccaactttttagagaaaaataatgttaaacgattgacatattctaaaaagtgagtagtataacgtatgaaacaaattttcattttgacaatttaattatgaaaccttttttacaatttttttggactcgtttgtgatcaactgaacgatttctcattattttttcattattatcttacggaaatcttttttaaccaacgctaattgagcgtgatttaggtttatcccctgttttaaatgagttgtttcagtttaacttctatttcacaagacactgatttatcaatttaaaggtggtgacaaattaatgttactaggtagcgttgaagccggcgggacaaagttcgtttgtgccgttggtaatgaggattaccgcatccttgatcaaacttattttccaacaaccactcctgaagaaacgcttcaaaaaacggtcgactattttaaaaaatatccagatttgaaagcaatttccatttcttcgtttggtccgattgaactgcggcagaattcacctaagtatggttacattaccgatacaccaaaacctggctggtcaaacactgattttattggttacattaagaaaaactttgatttgccaatcttttggacgactgatgttaatggatctgcttacggcgaatatacaatggcaactttatttaatgaaagaattaattccctggtctattacacgattggaacaggggttggtgccggtgccatcgttaacggcgaatttgtcggtgaccttggtcatccggaaatgggacatgtcagattaaagcgccatccggacgaccttgattttgatggtatctgtccatttcatggcgactgccttgaaggattagttgccgggccaacatttcgggccagaaccggcaaacgtggtcaggacgtgccattaaccgatcatgtttgggacattatggcattctacgttgctcaggcagccattcaggtcacgcttacactgcggccggccaaagttgttttcggaggtggtgtcgttagtgaaccattcctaaaaaaggttcgcgcacactttacggaactattaaatcattacgtggatgttggcaatattgaaaaatatatcgtaatgccacttgttaaagaaaatggttctgcaaccgttgggaacttcgccttggcactaaatgaacttaataagtaataacgccaatctacaaatcaacaaccaactgatatagattaatttatttacaatcactcacacattacacaaggagattatcaatataatgaaagcactcgtattaacagccactaaaaagatggaaatccaagatatcgaccaaccaaccgttaagcctaacgaagtaaaaattcaaactaaatatgccggcgtttgtggcactgatcacgcgctttataacggccttcccggttcagccgatgccgttccccctatcgttttaggtcatgaaaactcaggtgttgttgccgaagttggttcagaagtgaccaacgttaaagttggcgaccgcgtaacggttgaccctaacatttactgtggccaatgtttctattgccacaccgatcgtccagaactctgtgagaacctttcagccgttggtgttactcgtaatggtggccttgaagaatacttcaccgctcctgcaactgttgtttacccaattcctgatgacatttcatttaaagttgccgcaaccattgaacccatctcatgtgctgttcacggtgtccaattattgaacttaactccttatcaacgtgcattagtaattggtgacggctttactggtcaattgtttgctcaaatcttacaagcatacggtgttcaccaagttgatttaactggtcattcagataaaaagcttgccatgaacaaagaaaaattaggtgttaccaacacttacaatacaaagactgaaaagatcccaactgattattatgatgttgtcatcgaagccgttggttcaccggaaactcaatcccaagccgttgaagcaactcgtaaaggcggccaagttctgatgtttggtgttggtagtcctgatgctcattttgaaatgaacacttatgaagtttaccaaaaacaattaacgattcaaggttcattcatcaacccaaatgcttttgaagattcaatcgcattacttcaaagtggcaaattggatgttgattcattaattagccatgaatttaacttggatgaagttgaaaacttcttacaaggtaacgttaagggtgtttcaaaggcagtcgttaaagtaggtgactaaccgtgaaacacggtcaggaggaaaatatggaatctacaagtcaagaactaaatggtcgaacaatttcaatgtcaacgtcgatcttttactttgttatttcgttagtcattaactccgcaggaaatgttttgacgctggtcaccagtgccaagattcacccttcttatctgggatccgcctactggaccgccgctgaagccaacttgggagtcgcttttggttggaaccttttctgggcattcttaattttcggaattctaatcaccgttttaaacgcggtcttggttggtaaatgggaatggcgtcgcgcattgggaaacctgatcttcatggtgcccttctcagcgctgattcaaatctttgaagacttcttcattggtaaatacccaatttttagcggtcttccagatgccaatacgccatttatgattggtttctacatcttattaaatttctttggggtcgccctaatcggaactgccatttcaatctatcaacgagttaatttagtcttacatcccgctgatgatttaatgcagattctccgctttaaatattttaaagggaatgccaatatcgcaatgtgggcgtcttatattccaccaacattaatggcaattcttgcgtttattatcaccaaaaacttcaccaacttgggaattgggacaatttttgccttcttattccaaggtggaattactggaattgccgatcatcgggtattcccatggttgaaacatcagaatttggatgttggtgatcctaatagtgccaaaagtactgactaaccctaatgatttagaaagaagatattaataatggcaattaaagacgatattaccggaatccaacatgttggaattccttcaaaagatttagataaaaccatcgaattttatgaatcactcggttttgacgaagccggtctgtttcataacggcgccaaccgttgtgctttcatgcgatttggcaacctaactattgaaacttgggaaggcgatccggttgctatgaaggccggtgctatcaatcatatttcattaaacacgcccgatgtggaaaaagcctttgccgacgctaaagcacaaggattgaatctcgttgatcacgagattcaatcaattccttcattctgggataatggaattaagtattttaatattcttggacctaaccaagaaaccattgaattctgtcaaattttgtaatattaattcaacaaatacgaccagattaatgatacgattaatttgatcgtatttgttctataggaggagaaaaaatgactcatatttcttttgatagttctaaattatccaaatttgttcacgataacgaattaggcgaaatgcaggccatggttaccgctgccaacgaagaattacgtaacggcaccggtgccggcagtgatttccgtgactggttgaatttacccaaagattacgacaaagctgaatttgagcggattaaacaagccgccaagaaaattcaaagtgactccaaagtcttggttgtcatcggcattggcggctcttacctaggtgctaagatggccgttgatttcttaaacgatactttctttaactacctgcccgacgaccgtcgtcaattcccccaagtcatgtttgccggcaattcattgagcccatcgtacgtttatgatctgctcaacttgattggtgaccgcgacttctccgttaacgtgatttcgaaatccggcaccacaacggaaccttcaattgcctttcggatctttaaagaccgtttggtagaaaaatatggcgaagccggcgctaaagaccggatctacgccacaactgatcaagctcatggcgctttgcgccaagaagctgatgccaagggatatgaatcattcattattcccgatggcgttggcggtcgttactccgttttgacgccggttggtttgttgcccatcgccgcttccggtgccgacattgaccaattaatgaaaggggcagccgacgcggccgatgcctacactgaccctgatttaagcaagaatgaagcctatcagtacgctgcctatcggaatattttataccgcaaaggcttcacaaccgaattattggaaaactacgaacccaatatgatgtacttcgctgaatggtggaagcaacttatgggtgaatccgaaggcaagaatgaaaagggcatttacccatcatccgccaacttcaccactgatttgcattccttgggccaatacatccaagaaggcttacggaacttaatggaaacggtcgttaaagttgaccagccgaaccatgatttagacgtccccaaagaagccgataacttggatgggctgcaatatttggaaggccacaccatggactttgccaacaccaaggcctttgaagccgttacccttgcccataccgatggtaatgtgccaaatatgagcgtccatattccggatcaaaccccttataccttgggctacttgatttacttcttcgaggtggccgttgcgatttccggttacttgaacgggattaatccattcaaccaaccaggtgttgaagcttacaagcaaaatatgtttgctttattgggcaagccgggttatgaagacttaaaaaagaaactcgaaaaagatttataatataaagaatcatgactattaaaagtcgtaaccgtttttaggtttaccaaaaggagagtgggacgaaaggcggttacgcggcaggaagttgccttttggcgcacgtttccactcggtaataatcgtgattacacaaatgggactgggacaaaagtaattttgtcccagccccatttattgtaatctactaattatctaacagattatggaacgaaaagtgcgcataaggctactgcgacttgaacttattgaacaacttttcaaaattaattgttcccaagccggttgcctgattgtagagtttgccaggctggccagtgtaatataaattattattatcatcagcatcacttagaacattaaatggcgtatcagcctgggctgcaaattgataaatttgggggttccagaagccggttccagcttgcaagccactattcataacggcattggcggcagccatctgtggcgacgcataacttgtaccaccgccaatcgtccaaatcttaatctgaggggccttggcctttttcttcgtcccgctaggagccgaaagataagtcgcgtagccagtcacgatgtccgcattacttgaaacatctggtaaatttctggagttgccggttccaaaaataatccgaggatgcttgttaatgaagtaatgccccttcttatatcttagaagatcaattgcccgaaaagtattgacgcctgaaaaaccttgttgatatcttggcgttggatttaatgcagaaaaaccaccaccactacctggaaagttggcgccctggtttttggctggcacagcggaataggtatccccccaagccctttcttttttaacagtgacaactcgctgattaataactttttcgtatgggagtgtcgtcccgccgacaatgacttggtatggtgaagttgtcacagcatgattttcaattttactgggcatatcacgcggaccattatcaccactggctctaaaaacagtgatcccctgagcagccgcctgttccagaattaaattaaaagcatgattatactgacgaagagttgaactatgatcatcccactggttagctaattcaacggttggtgcaatacttgtggaaatctgctgatctcgattgtccgaaatggcttgggcaaatgttgcaaaatatgtcgatgggcttcccgttgcgccattagccgattgaccattataaaaatcaatatctgcatcaggtgccaaagcgctggccgattgaacgtcaagcgtcgcctcgatttgagattccgttaacgatttattcaaactatttgtcacttttttagcattatcaattgtatagactttatgaattcggcttaaattgtcattaacacctgcttgtttccaatacgttcttaaatcactattatgaaaatcgccatcagaaataatcccaattcgctgacctttgccggttaatccctgctgataaagcggattaaggtgataatgatcagcgaattttccagcaccatattttttggaaaactggttggcagataaatttgtttgtggcttttctccgttagttgggacatcggtacttgttgcccgtttttttccactctgcttggtttgcttagtagtcggtttctgagcatataatccaatgaccgccacgacccggttggataatttacccggcaatcgatacttggtgcgtgaaaggcttcctttcgccttagtatactttgctctaaaggctttattcatatccgctcgatgcccgctaaccttaatcgccagatttccagcaaacgtggttgttttcaaatgatacttgtttaagtattttttaaccatgttaacatacgcgtttgattggccaaatttttccgcaaactgcgtcggtgttaaatattgatgataatctgacgcagaaggatcaactgtatcataaacatagtttgttaagtctgattcgctagtgggtttaaaaacaacactagccgtcataacatgattattcacctttttcggtttaggtttggcattaaccgtaattgtgatccccaaggccagcaaaccgctcacggtgctaacaatgatttgttttcctctcatgtaaaagcccccaataactacctaaattttaaactgatttagtttatctagtccatgttaccgtattataacagttcaataaatcgatttttgttttaacactcattattttgcccaacaaattttgaattcgaccatcatatcatggcaaacaaaaaaggccggacaaaataatttgcctcagccttcatatcacttaaatgaaatcgattaatcagcaacatcttaataaccagagttaaaagttatctctaggatctccaattagcttgttgtaaataactaattaacgtttcgccttgaacgaccattagtttgccctttatccaaaatttccggctcatcatttttagcgcgggcatactgacggccaaattggtcgcttctgtttttagtttgattgttattaaaacgtgtcaggacatagtagatggcaacggatgctagtaaaagtaatgtaatcatttagaaagcctctctttattagtaaacttaattgacgacaacataaaaatcaattttttaaagattgatgattatcagattaacttgataattgattttagtttaccttcaatcaggaaacagtcaagatatttgacgtcccagctaccatcccaatctgcaaaccgctattaaacactatcagggcggacttggggaacggtttaaggaagggtaaagattagctcttttccgttcgctattacgactactaccgattctttacaaggagcttgccactaatgatacaaaataccgccagtaaaacaatggtactgacaattagtcccaagacacagcgaaacgtatcgtgcatcccagaccggagcaccccgataagttaatcgcctttcaccccattctccggaatctaatcgcttcttttggcactttttccgaccgaatgcgccacaatcgcccttttctttaccgcgctatttttatcttgatttccctcaaatagtaagtttacagctgcccgtcccatttcgattggatgtaaatctaccgaatggaaatgctgatccgttaattcattgggtaatgaattattatagcccaccacttcaattttcttatccggatataatgccttataccggttgtaaattcgcagtcccgtgtaatcatcagtagcgaccactccatccattttcggatgttcttgaataaattggttaactttctgctcatcgttttcaggaaccgaaaaaacaactgcctgtttatcacgtcgatgcattgcctgcaaataaccttcccggcggtctaattcatacggccagccattttgggattcagcaaagaccggattttgaacatgcaactgatcaattaaatagtttgtcccatcagcaccagccttaatgttgtcgttatccacatagagccatttttggccggcagccggtttcccaattgtgacaaattcaaccggttgctgtcttaataacttgatgacgtcatcattgatgtgcgagtataacaaaataaagcgcttaatttgcgcccgattaatcatcgatttaacattgtctaaaacctgctcagttgtgttgccaatcgcaatcgataacacataatttcgttccgttaactgctcgttaatccctcttaacaaacctacgtaaaaaatattatcaaccactcgattattaactgggaagataacgccaaccgcattagcttcctggttcgtcaaatttcgagcattgtaatttggttgatagcccatttgctccgcgacccgcttcacttctcgtcgagtcttctcgctaattcgctgattgtcgttaagtgcccgtgatacagttgaaactgacaaccccatctgtttggcaatatcgcgaatcgttgccattttaaatcacctctcatcttttgaattgtgatcatgtcgtccgcattaaaattttgtatcttttattaatattcggccatagtactagattttgcaagtgttgtgtgataatttcatcatatgaggtgaatattaatgaaaacaagcaagtcattagccgctatttttgcagtggttgcatcagttacgcttatccttgccggttgcggtaattcttctaagaaatcatcaaatcctagtagtaagaccagcatgcagaatccgacggcggataaatcagccaaagaagcattaacatcaaacaataatctttggtatatgaacggaacaattaactacaagagtaagactggcattgatgcctacaaatttaataaagagaacaacaccgtcacgatctatagtgtcgataagatgtacaagacctacaacgatgccaaaaaggctaatgatttgaataagcagggaactttgacctattcctttaagaatacatcaagtgataaccctgtcctttacatgaaaggaaaactttcagacattccaatggatcaaaccgtttccgttaaagacaaagttgccggtaaaaatcacgaagccaatttgaaagtcgctgggtataaagttgtccgcgacttggataatgatccagctaagcaagtcctggtaacaccaaccgattaaaaaatcatcagtattgtccaaaaaagagagattatgacaagagcatcttgtctagtctcttttttttggacccatgacgatcgtcgccaccaaacttacgttaatgtctgaatttcccgttattcagcaacccactcggcagccaggtcggcttcacaaaaataaccaataaagtaattacaccaatgatgaacggcaccaccatcccaacttttagccctgaattatggtactgcacatcaactcgataggagccactcgttaaatgattcaactgaatcacgcctgatggggagatttgccacgacacatttttaccgttcaacctgacttggtagcggtgatcataggccacaaacggtaactcaatattactccgcttacctgtcaagttgaattcaaaataaatgccatcaggcttgggtcgatagctcatcggaatcgtttccccattagccaaattaaccccttgatgctgcatagttctgggtaaagttgtcccgttacaagtcttaaccgggtaatagtcccagctaatactataccccaataaattttggtactcagcctcattggttaccttataaatctgctggccattttgatccattggaacccctcgttgtgcgacaacgcgatagttaatttcctgagtgttaatttgtgatttgataaactgctcggaccgcagtaatgctgatccaacaaataaaaccgtaccaatgacggcaattccaaccggcgaataatgaaaatcaagccttctaatcatcgcaatcgaattaacaactaacaggtaactgaagcaaactaacggtatgatcaacaaacgccatggaaactgaatgacacttaatggtgtatcagccaaatttttccaaggaataagctgagactgcaataaaatcagcaacaggcccaacacaaataagtcaatttgaaatttactcattcgcttaaaattaacgaggctcaccacaattccaagcagacttcccagccctaaatacattgacgcattattaattgtgaaaaattgaaagatgtttttaaatgcagttccggttaaaccatacggaactgatggtgtccaatacctcactggcgttatcagcgtgaagtaaattaagggaacccaggttaagctggaaagtaatcccgctaagactgctcccttaaatagcgactgccagcgttttaaactaaacaggaccttgtaattaaacagcgtcaaaaccactaagctaaagagaacaataacgaacgtgaggatatggcttaataagatgccgctaagcccgatggccaaaccaacccatttcccagttttcaaccattgataaaagccagcaaagaccaggggaatccaaatcaggctccacataaccccaatatccattgtttgataatcataggccagaaccatattggaagtcatatacagcagtgcaaacaagtaggcagaaagattatcctttttgatacttttaacgctgtaaaatgcaattactaatcctaggaaggtcttgatcatatcggcaataaaaattcctcggatcgaatccttaaacagcatttgagcaaatgcatagagatataacggccattttggataaagggagatgactgcattaccattattattaaatgcaaaagtcgcaattaatgggtttaaacttccgtgactgatattttgacgtagttcattgatttcatggagatggaattgcatatcatttgccgcgaacaaccaaccatgccataaaaatagacaatggatcgcaattgcaattaacgcaaagctcccatatacaaacgacccctggtgcttattgataaatagtctcatgttttacctctcatctatgtttcgttttaaaaaacgatttgatcaatcattgacgttatgtaatttagtgcagaatttagttttactcgtttactattcttaatgatacggggtgaatgatcagttttcaattgtcattttataaaaagcctttacaataattatgtaagaagatgttgaaaaatgacccgaataaatccaatcaacaaattaacggtgatcaatcaagctgcgtttcgcaaatggttggccacccatcacaacacagaaccggaatgctgggttaacgtgacgcgtgggattccaacggataaccaccatttttggtatgtagacgccgttgaagaagcaatgtgttttggctggattgacagtacttataaagtaattgaaccaggtaaaccggcagctcaaaggtttgtgcctcgccgaccgggaagtacctggtcagagctcaataaagcccgctgcagacggatggagaagcttggactcatgactgatgccggcagaagggtcttaccagatatgacgataactgactttaaaattgatagccgaatcaaacgagctcttaaacgccgaccgggcgcatggaacttttttctcggttgtccaccactttatcaacgagttcgcattgatacaatccagattaaaaagaatcagcccaagctgtttcggtcaagaatgaccaaatttgcgaatgcttgccgggatcacaaaatgattggtcaatggaatgacggtggccgactatcgtagcgttggtaacctatgctgccgatcacgtcccttgataattgcttacaaaacacaaaaatcgcttaattgacatccccgactcaagagatgctgattaagcgattttagttcaaaaaccgactcattatttctttaaaacttggtttaatgcagccgccgtataagactttgattgcgtcaaaatgcctttgggcgcgccttcatacaaaatatggccaccaaaactaccagcatccgggccaacatcaattagccagtctgcctgcgtcatcaccgtcaaattatgctcaattaagattaacgtattcccttgttcgactaactcattgaacaggtttaatagtttatcaatatcctgcatgtgcaacccggcagttggctcatcaagaaaaatcatatttccctgaccgtttaattgtgttgccaatgataaccgttgcaattcaccaccggacaaggttgttaatgattgatttagtttgaggtagcccaagccgacccgctgcagatcatggattcgcggtccaataaccgaatcgtcggcaaaactctcactggcggcatccacgctcatttcaagaacatctgcaatggtatggccttgataataatagctcagcgcttcaggactataacgccgaccgtgacaggcctcacaggtttgaacaaccggatccataaacgccatgttggtaatggtaacaccctttcccttacaaaccgggcaggcacccttaccattatagctgaataaactactggaaacctgattagctttagcaaatcgttggcgaattttatcaaaaattcctaaataggtgagtggcgttgaccgcaaattaacactggctgcccgctgatttaaattaataaccggcgtttcaatactattcattaaagattctgccaaagaacttttcccggaaccggcaaccccagttaaaaccgtcatcacacccaaaggaacttggacatggacatcgtttaagttatgagtcttaatatgatcgcgttttaaccaaccatctttaggggttcgcggtgcttttagcgaataaggtcgacgaagatattgcccggttaacgtgtccgatttgagtaatgcgtcaaaagtcccggtaaacgtaatttgaccgccaccactaccggcaaccggaccaatttcaaccgcgtaatcggcgccagtcatcattagtgggttatgttcaacaatcagaatcgtattcccctgatcttggagcttatgaagggcctgttttaccagccgaatatcgtggggatgcaaaccaacactaggctcatccaatatataaaccaaatccgaaagcgaactattcagatatttggcaatctttattcgttgggattcaccaccggaaaggctactggttccccgatctaatgacaaataacctaacccgatattaataagtgagtttaacatcgtcgtcaattcacgaataatcgaagcagccagtggcaccttgatatgatttaaaaaggtaacaacctctgaaagattcattgcgcaaacatcagcgatatttttatcatcaatatggtttgaccgaaccaaatcattaacccgagttccatgacaggctgggcaatctttgtgggtcacaactttggcaatctcctgtttatgatgttttgcttccgccttatgaagaatcgatcggcgaattcggggaacaatcccctcatacaaagctgtcggatgccaatttgccggtgcattgtgcaattgttgctggggcgcatgcatcaataattcccattccttatcagaatagtcttttaacggcttatcattatcaaacaacccactgttcgcatatcgtttccagcgccacgtatcgacaccaaaactaacaaatgtaatcgcaccttgatttaacgatttattcttatcaactaacgcagattcatcaatctcatcaacatagcccaggccttgacaagtggggcacattccttgaggcatattgaaagaaaaggtgtcagaatagccaataaatggtttgccaattcgcgaaaataataatcgtaacaacgaataaatacctgtataagtcgcaactgttgagcgagcattttgacctattttcttctgctcgatgacaatcgcaaccggcaaatgatcaattgctttaacttgaggttgaccatacttgggtaaatactgctgggtaaaactaggaaacgtttcatttagttcccgacgtgattgggccgcaatcgtgtcaaacactaatgaagactttcccgccccggataggccaacaaaaacagtcgtccgcttcttagggattcgaatattaatgtcttttaaattattttgcttagcaccatgtacggtaatttcaccatcggcaaataagttatcttgagtcatatcatcattcccttcaataaagtcagtttatccagtgtagaacagtggttgggaacaagtcaagcgcctcaagggccgttaaatgccggggttgattggtaacatgaggcaatttggagtgggcaaataaccaatccaaatattaccaaactcaggaatccagattgatcacaaatttaaaacatggtgtgtccctccgcctaatggtaaatttcaagaacaggacccggccatataaataacttcagcaatattttgacatttggaaaatgtttagattatttagattggctatcgagctaaaacgtgcgaaaagagaagcagatcccggccatataagcagtttagcgggtaagctccagaatcaggaacttacccgctaaactgcttatattctgggatctaaacgcttctttccgcactctacgccaatgaatcccacgccggcaattcaatcggtgcctgcttcaataatgcttgttgctcgtcggtcaaatacttcttgtgaaccacgacctcataaacataatcatccatccagtcgtcgttcatcgtgaagtaacccttggtaccattcttatcaccccaagagttctcaaccttccacttagttggttttccgttatcatccaagtcaacaccggcaaaagtcatcgcatgtgagaccatggcttggtgatattcaagccgtttacctttatccatttccaaatcaacattgaacaagtcggaatatcggtataaatggctatccaaaaagcccttttttcgatccatttgctccagcacatcgttaccaaaccaaactgtttcgccatcttttaattgagcgatggttgtctgtttcaacacctccattggcaggtttaagaacgtaatgtgcttaccgccaacaacgttgtcttgacttggcagcgagaatactttgttgtatgctttgtcgggcgaattggaaagcaccacgtaatcatccaaatcggtatcaaaatattgatcataaaattcctttggcgttaacccagaaattttgtgatactttttatcatcatcccgataagcaaaattaaccgtggttggtggttcaccaaatgaataagccacaattcgataaacttcgctcaacatttgtttacgtgctgcattaatctcatcatcggacttattcgcgttgaccatatcacgaagtttcattccgtcaattcgcagtttgcgatttaaaaccgtcccaaaagcacccgtgttttcagtattaacagtttcaggaaaatcactaactggaaccacgccatatttttgaacaagggcagccgccattgcccattggccaccatcatcatcgggcatgcttaagtagtaatcaacttcccgatcatcggccgggcggctggcagttgcaataatccgatcatagtaaatgtttgcccgttcaattttatcccaaaagaataaatacttttgcgataaatcaaaatcctttaatttgtactttttcgcaaacttatggcgtaacgtattaaccaatgaaaatagccagcaacggccactttgcttttgattggtcacagcacccgtttgtaaatccactgaaaaaaccgggtccaaacgaacttgggcatcgggatcctgagccgcttgattaatcccattttgtgtcacaattcgtgataggacatcactcttaggttctttttttaaattgtcatgcaactgaccgaagtctttctcgctcaatgtaaaatcagtttcactcatagtctcgcatcccttctatgtaattgctaactattgtagtgcttttactaaatttcggcaatcagctttagggccacaccaaagttaattttttcaatgattgggtccagctcgtaataaatactgaatcgttaatccttttatgaactataaaggcatgacatacacttgacatggattccacgtgtcccacaatgttggaaaaatttccaattttttaaatcccattgcttggtaaaactgatttgttttgtcataagcgagataatgtccctccgcaaccgtcttaacttgcaaaagggaatagccatgctgccgactgtatcccgttatcgtatgaatcaattgccgacccaatccctgtcgatgatacatagggaggatacccataacgtcaatttccgccgtatctggactactctttttgacggtcgcgaaaccgacaataatttgttcgttaatgataaccgcccacagtggcaatctttgggcatgatcaacgtactcagtgatcgcttctggaatcccaaaccaatccggcagctgacttaaaacatccttggcaatttgttgtttttcgattggggttttaatttgtctaatttgggacgtcattaccatccagcctacctttactcattacttttccgattaaaacatatcaccaacaaaaaataaacagcgacccaccaaaataccaatgatatgaaggccatcaaccaaaactgccaatcccaaaatcgaaaaccgacaacataacatgcgaacgtcaaaaaagctgcgatgagaatcatcggtaataatgttattattcgcagaacttttgcctgtttggggttccgccaaaatccgacaatgtttcctgaaaagaaaaatgcaagcgaactaataatgtcttgtaatataagcatcttagcctcctaaaacccatatatattatctgtatattaacataatacttattaattagaaatgggctttaatactttttgaaaaagggcacaaaaaaacaggataaccattaccctgtccctaaattagttttaattattagattctgccctttaatcgtggcgtgacaaagtaagcaatcactgcgcccacaattccctgcagtaaattagtgccaatgccgacaaacccggcatagggcgtatataatactgagtcagcaacaaaatagcctgcaaccatcacaataatgccaataataactgccaccgcctttgtccatttggtatccaccttcttatgggcaattaaaccaacaatcagtccttcggcaccatgaacaattaaggaaaaccacatatactgcgtataaccggatgttaagtcaagcagtaagccactggcacccccgacaacgccaccaacaaccggtcctaataaaatagcactaataaagattccggcatcacataagttaacgtttccgtgagtcatcggaaccggaataataaagaatcggctaatggcaactgttgcagcaataaacatcgccgtcaggattactttaaacaaatgttttgatgcactcccgccaacactttttcgatccattccaaaaccttccttctaattaatttctttatagtttgtttctgaaaattgatacattgcccgctcaccaccaattaacttgggtcgggaaaccaacccgacaacgttagcagcaccaacttttcgatgggtcattctgacaggaatctggacaaatttaacatgcatcccaatctccgtgcccccaatatcaatcccaccgaatgccgtaatgtgttccacctcaacggggtcggacatttgttgataagcggcaacttgcgtcccaccaccagcatgaatcgccgggacaaccgatacaatctctaaatcgtgtttttcggccacctcacgttccactaaaagcgcccggttaatatgttcacagccttgaacagctaagtgaatttttcgtggctttagaaagcttatcaacacgtcaatgattgtttgaccgacatccaaccgcgaagatgttcccttccaagcgccactaacctcgctcgaactacagccaagaacaaaaatcccgttttcagggaatgtggtcttatcaaaatactcagttaggactgcttttaggtcacgcttaattgtctctagttgcatcaaatttcctcccgatcttttccaagcgtaaacttggtcacatcatttaaagtcttagttaaatccaaaccaaatttccgcttattttcagaaacctgaccagttcgtgacacggcctcatagacgccaaagaccgatcgctgaactgccgtttcaaagctaacaccaaagttcagatagccgcataataacgcagaaaaaagatcgccggttccataaaagtgacctgaaacaaagggtgaactaacccatttcaattgcccatggctgagaaaacaacaaccaattccggcatcgcgtttaataccagtaaccaccactctcgcattgagatcatttttctggcgacacgcctcaattgcacggacaacctcagcatctgatgcattgtctgtcaattggtttccacttagcaactgtaactccgtaacatttggtgtaatgaccgttgccgccttgatcaactgcttaatggcatcaagataaccgtcgccaaatccatcatacatgacaccacgatcccccataaccggatcaaccaatacatgttttaactttagcgtggttaaataatcatgcagcaacttaactgttttgggttgaccaacatacccaactaccgctgacgccaagttcaagtcagtgatctggttccaatgaccgattgtcttctttatccaatcatcattgtttgtggttatcggcgtgccaaatccttctgactgcgtggaaagaatttcagtcgggattgcagctgtttgaatcccaaatccggaaaagattgaaatcgcagcagtcatggacatccgtccaaccgcggagaagtcttcggcaaccagtacattcgagtctaacatgttaatcttccttcccactagcatctaactgaattgtaacgcgcctcgactataattaaccatttaccaatcaaatgtcacaatttcacataaaagcaaatttattataacaagttttatgcaagaaacaatccccaatatcccaggaaaccgaaaaccgtgttgaagaagatggttgccgaccacgttatttacacgatctcgcaagttgaaccacatctgaacctaaccgttgacaatctggtcaaactagtttaaagtaaattaaaattcaatttgaacaacttacgaattattaagctatgaggagaagagtagccgcttgaatcattttcagagaacccggatgatgagaatgggcaatgattcagcgacgaagatgaactctaatcagcaattattccgttcacgcgaaataatcggtaggaaccgttaacttcccgggtattattggtaccgatgaggcattgtttgtaaaagcaatgtgaattaagggtggtaacgcgagcattcgtcccttggctgttaaagcagtcaagggatgaatgcttttttcgtaagttgcgtaccaattcatttcagttcatttattagtcgttaacacgtattgatattctaggaggaattcacccatgacagaatcagcaacccaaatcaaatttccatatcgttacgatatcgttggtagtttactaagaacccaagctttaaaggacgctcatgcaaagtttagtgccggccaaattgatgccagccaattaaaaaccattcaacgtcaagaaactcgtaaaattgttgctaagcaagtcgatctcggtctgaaagatattactgatggtgaatttaaccgcagttggtggcaccttgacttcttatggggcttaaccggtgtcggtcactatgactatcacaagagctataaatttcatggaagtaagacgcgaaccgacaatgcggaattggtcggtaaaattgcatttaatcctaaccatcccttctttgagagctttgagtatcttaagtcaatcactccagatggtgtgacccctaagcaaacaatcccatcaccatcaatgcttttccgtgataacagaagtgataactggtcagactactatgactcatgggacgcttatttagacgacctggccaaagcctatcacgaaacgatcttgcgtttctacgaacttggctgccgctatatccaattagacgatacaacttgggcctttttgattagtaaattaaacgaaacagccagcgccccagaagcgcacgccaaatatattaagctcgcggaaaatgctgtgctggttattaacaaactacttgagaacttaccagaagatttaacagtcacaactcacatttgccggggtaactttaaatcaacttacttgttctctggcagctatgacgacgttgctgattacttgggccaacttcactatgatggcttatttctcgaatatgacagtgaccgagccggtaattttgatccacttgaccgaatctggaatggcgacaaggacaaacgaattgttttggggttaatcacctccaaatccccagaacttgagaatcaagataccgttattgctcgtattaaacaagccgctgaaaaagtaccattagaaaacttggcgctttcaacccaatgtggatttgcttcaaccgaagaaggtaataaattgactgaggaccagcaatgggctaaattaacattagttaaatcaatcgctgagaaagtttggcacgcttaatttaacaattctaaagtaaggccaggggaacccatactcaaatttatttgaaataggttccctttattgttttattacgacactagcaaggaatccgaggtgaactatcttgctcgcatggattagcttacaacacagcattatccagatccaaacacttcagtagctggtcacgtacccgaacgtgtgcacagacttagttaaaatgatgttccaacttcaaaatacggctgagaaactgtcacgcgctcatgaatactggagtgtttaaaaaatgaaaactaaatatccaagaaatattaatcatggttatgcatatacctttttctcatattttggtattaccggactgtgggtaatgtatctgcaaacccagggactcagtttggttgaaattggcttgtgtgaaagtatttttcacatcgcaagttttatcttcgaggttccaaccggcgttctggccgatcgcttcacctaccgatcagtgttaattatgggtcgcatttcagccatcctgtccgccattgtcattttactcggtcatagtttttggtggtttgcgattgggtttgtactaagtgcactttcctataatcttcaatcagggacaattgatgccttgatgtatgactcactaattaagtccaagcaaactaacgtgtttcccaaaattatcagtaatgtcaacgtgatcatcgaatttggtgacacagttggtgttgttatcgccgggttctttgttcattggcactttggcctaacctatgttatcagtattctaatcggtttcctaggtttagtaaccgttcttttgatgaacgagccaaaacttaacacatcacttaatgaaccgcatcaaacaataaaatccattgcagtcaccgcttaccaaacgctaagccacaaccgacaactgcgtggattaatgttgtttcaagccttttttacgggaatctgtaccacttactattattatttccaatcactgatgagtaaaaatcatttttcgagtatattgatttcatcattgttaattgtgtcagcaatcgttaacattattggcattaaattaactccgacgattcaaaagcaattttcgaaacgaaaactgctcacatcactaagtttttgcttaacaattttattattaaccagctggcttaacctgctgcctttgctaatcacattatttttagcttctcaattgctgggatctttagttgagcccatttttagtagttactataatgatcttatcgattcacagcagcgagcgacgttattaagtgtcgccagtgttctgttttcagtttcaatgatcgccctttttccaacgatgggatggctcattcaaactcacaatttttcatttgcctttggatcggtggggattattttattaattggtttaaccatgatgtttcgcaatttaagattaacaaatcacaattgaattagtcatcaatttatttacggaacagagcgggacaaaaggcgcttaacttccagccgtgtaatcggattatccgaatattctgaacttgaatatttggataattcggttacacggccggaagttgccttttgtcccgcgttttttctcagtaataatcgcgtttacattaacagagactgagcaaaatcacttttgtctcagccattttttgtcttgagattttgttatcttaatgaccatccacccccatcagaatcattgattaccatccatccgtaaaataccgccaaacaaattcagaaactaatttttacttcatcgcaaataatcatcctcttttataatagtctagtatgctttacaaactagtagattatgatatcctactagtatgcaatgcaaattagttgggaagtgattatttgtctaaagctgacgtttccagccagatgcttaaaggaattcttcaggggtgcttattaattttaatcagtgatcaaccttattatggttatgccattagtcaggaactttccaaatatggttttgcgaatgttcccaaagggacaatttatccattattaatgaatatggagaaaaagggccttattattggcaaaacacaaccatcaaaagaaggaccacaacgaaaatactactatataacggatgcgggtaaccaagctcgacaacactttctcacacaatggaaatctttatccacgggcgtcaacgatctaatcaatgaaagaaggcatgaacaatgaaaaccgataacctcatagaaaccaacaaccagcttcgtaaacagttaaatcctgaaaatcggaaatactatgaagacctgttacgctacattcgcggtaaatccacgtttagtcgggaaaatgttgtcgaacagctcttattagatatcctacatgatttaatcgatgcccaagacaacggtcaaagtgccgaggactactttggtaaaaacccccaatccttagccaatgatattttacagacgttacccaaatcattctccgagattcttaagcttgcttgctatatcgtcgtgggctatgtgcttttatttacagttcccactattattctgccaacaagcaagtttgatattggtaatttgatcatcgtgggtacgactgcttttattttttcattaggtcttctatgggtaattggagaagaaacttatcagaaaaacaacttgaagaaatttgccagctataccgtcagcatactcgtttatgttggcctcgtcatcgtcagcgtcttcttaaaaacaccattatctgtaagcttgcctggttggtgggggatcggaacaatcctcattctcgttatcatctccacagtcatttatgtatctgagcgcaaacgactccccttcctaatcattatttatatgatgatcattatcgatgcgttattaggaattggtacccgaatcccgggaattagcgacttactcacaaaaccaattgctcccaaatcactgcttctatggatcttaattcccggttgtattatcgccgcactcatcggtggttttggtacttggttttatttgaagaaacatgaccattaatcttacaatgccgaactagattttatccattgactatcttgtaaacactaatctgacttacgataaaacatgggacaaaagcaactttcggagtgaaattgttttttgagccacatttttagccacgttcgtgctaaagcatgaagacgttatggttcaactctcttttaaaatcaatccagtttcacagttctcttttaacaattgaaaatgcccattgccattttcaactcattttcaaaagcatcttattttaatcacattcacgggttatactttttatgtaaccattttgcgaaaaggagtgatgatatggcattaggtcaactaacaaatcaaatcgtcctgatgttttgcttaatgctggttggcgtgttaatcaacaaacttaatttcatgcattcacaaacttccagtgatttaaccaatatcttgctttacgtggtctccccctgtttgattattggcgcttttgaacaaaaatattcagcaaacaggatgcgacaattactactggtctgcttaggaattgccattttttatattatcgaaattatgattgccaaattggcatttggccgaataaaaagccataaccttcgccgaattgcccaatatggcagtatctattccaacgccggttttatgggtgtaccgttaacaagcgccctttttggtaactcgggcgttttctttgctgttgcctctttagccggttttaacatcttcagttggactcacggggtttcattatttaaagataaggcaacaactaatgatagatggcaaaacctccgtgaaatcatcatcaatcctaacattatcgccattatcttgggactgattatctttagcgtttcatatcaattgtccagacccgttaacgaagttgtccactacgtcagttccattaacacaccactctcaatgatcgtcattggcaatagcctggctaatattaagatcagccggcaactgattgattggcacctttggttggcactagtctttcgaaatctaatttttccagtcgttgcgattttagtacttacgttactgggcgtttcaggaattgctcttgatacaactatcttaatggcagcatgcccagtcgctggcatagtggttttatttacattgcaggccaagggagatgccagtccagccgttgcactaatgagcctatcaaccgtccttagtttaatcacgattccactagtatttgcgataatgaactggtgaaaacaacaggcatcattgtctataaaggtttaatccagacactaaaaaacaccgatttcgcaataaaatcagtgcttttttaatatctatatttaagtttgaaaatagaaactaacgatactctcaatagttattcatactgattacttttccgccaatagtgctttaccctttgcataatcaactttccgctcactttccggcatcatgttaccaccagttgcccagacaatatgagttgcgttggctgtattaaaagcaggaacttctttaataacgggcgcaatagccgtaaatccggctgcggcagaaggttcaaccattattttttgtgtatccattaactcagtaacgtaacgataaatttggtcatctttaaatgtcacactgccgaataacaaggttcgcatcacctttcctgctaatcgagacggtcgaccaactgccaatccatcggctgcagtcaagccatccaaaccaatatcatagacagaaattttactgttaagcttcgtcatcatccccagcgttacagaaggtacatgggtcggttcgcaaaaaatagcgtgaatatacggtccaataattgattttagcccaaacgtgacaccgctcggactgccaccaacgccagccggtagataaaccagtactggatggtggcgatcaaccttaatatgttgatcctttaactgtttttgcaatcgtacatcagcaaccgcataacccaaaaataagtccgatgagccctcatcatcaataaaatgggttttagggtcggcggcagcgtcgtttctcgcaatcggaatgacatcagaaaaatcagtatcgaattccttaacggtcaccccattcgctcttaatttgtcttttttccactgacgagcatcatgggacatataaacggttgttttaaatccaaacgttgcagcaacaatgccaacactcaaagcaaggttaccggtagacgcaacggaaacaccatagttcgcgaaaagtttgtgatacttttcagacgcgaggacactataatcatccatataaaccaaatcacccttagttgtcgcaatcttttcagcaaatttcaagacttcatagatcccaccgcgtgattttatcgaacccgaaatcggcaactggctgtcagctttaagataaagtccaccagccagatcggaagtgtgatcattattccattgcttttgcattcgatccaaacgaaccagtggtgattcaataatcccatgcattttagctgtttctggaaatgcctgtgctaaataaggcgcaaatcgttcccatctggcaacagcatcaaaaatatcagcccgactaaagggtaatggcaccttttgtccataatcaggattccgccagaagataggcttctcatgtgccaagtcactaacttgtggatactttgtcataagcgtttgatcaattgtcatatcgctgatctccttatatgtctgaaagatttcgcgactattatatcccgctaaaattgcgactaactgtgaaaagttaaaaactttgctaataattaaacatgctcccagatcaacgttagtttacgaagttacattggtgtgcttgtagatgcccattcagctgatgttttcacagattttggaatggtaaacttctttacttgatttaaatattgatagttacccatcaacttttcagttactgcttttttcgacgaacccatcgtatatcccatggtaatggccagctttcttggtaaataatctgttttattaacgacatatagatagctaaatttggtgatctttaaatgtttcaccatctgcttggctgctgatgaatttccagactcagccaggatcagttgcttggcggtgtgagtgcctaacttcccaataccatggtaggatagacgataatttgcttgagtctttactattttcagatgatgcccgagcatccccaatcctttctgaccacttttagctgtcatttgggcctttaagtttgctacaatcggacttttcgaattaactttttgtttaatccattggtgcttgggtttgctataaatcatgcggttggtgatgtaataatgaatccgactgctgccaccattagccaacttaaccttcatcacaagcggatttgagccaaacttcccactaattgttccagatattgtccgctgattggcaattgttcgagtcacaattttggcctcgccgcttttgattttttgggttgcttgttgagacttttcaataactgttccaatttttgggtcaacggtttgcgtttggcctttaacacaccctgtcaaaagcaatcccataccggcaactactggaactaaccattttttcatcataactattctcccgcagaattatctggaaatgatttaatatgattaagaataccacaaactgctaatccattattaatggtcaccaacaaccatttcacgtaaacatgaaaataattgaaaccgggttcgctaattattatttggcctctaaaatgatattaatcacgctgtagataagcgccgatccaactaatggcaaccaattcgttttcaatttaatccccaccgtcaccaaccaactcaaaaagtagttgccacgccaatgatactgaacgttgagaataatctgaatgctagttagcaaggcataataggcaaaaacaatgtgcgcgataacggcacaaatatccaagataatgccaaccagattaccagtcatgataattggaataacagtcagaatcgccaaaacaattgatcccagaaccggcaaagatggtaaaatcacgatatttctccatggaacaatcgaaaaaataacgtaagcagctaacaggatgaaccgaacccataaataaccaaatatattggtaaaatgaaacgtaaaatgcagtggaatcggtttaaataaattttccttggcaatgctaagccaaaagatgatcattaagatggtccaaccaatcaaagagtattgcgtgaatttgcttaacttgagttttgtcatttttagtctctcctaagtttccggttttcattcgttgtttgaaatgtgagaagtcatgcgatccagtaaatactgaatatgaatttgcattgggtccaacacaggttcctgtatatcctgcggcttaattaacattggtagttccgtacatccaagaatgacactgtcaataccatccgttccccgaatttcgttaattagattaatcaattgatccttggtactatccttaaattgacctttttccaactcattcataatttttgcgccaacgaacgcttgttgcgctgggtttggtaacctcacatctatcccagcttctaccagggtgtttgtaaagaaattatttgccattgtaaatgaagttcccaataataacggccgttgatactgacagttaacacagcactgagctgttagctgcagcatacttgtcattggtaaagatgacactttctgtagtttatcaaaaacaatgtgaggtgtaatcgcggacaaagttgcaaaagtggcaccagcaccctttaagtgatcaacggctgccgccagtaaacgaacggtgccatgccaatcttgctgttcgataccacgtaacatctcataaatgttgatactttcgatagtcattgagggaaaaacatcttgacaacttaatcgtttctggtagccataatttaactgacggtagtatgccaacgttgattctggaccagtaccaccaatgatacccaacttttccatttcaatcatcctctctaaagtaacttcataatctctgcaaccgtctgaaaaactgtttgattcgtcacatcaattttttgcgaattgacagcggcatataactgtaaccgtgccactgcgccattgactgcttgattttcacgaatgcctttggtgacatccttgttaaaacgtttccttaaggctgctggagttgcaaccagcgaaattgaaacaaaatgataatcatcaattaggcctgccgtgattcggtaaataatagcttgctgatgcatcacccaaacaaagacaatgttttcaattttagaattttcaataaatgaatttaataaaaattgaatgttccgaactaccatctgtttattctcgtcgttcacaatgaatggactcaaatcccaacaccaatcgccatccaaaaagacggcatttgctaattcatttttaactaatgccctaccaatcgtcgtcttaccaatccccattgggccaccaataaaaatcaaccgcttcatcaaatcactccaatcgcaatcggctaataaaacaaaaaggaggactcaagcaactttagctgcttgaattcccccaattattttaattactgatcctcatctgttttaatgtatgcttgaatcaaatcactcgttccctcacgtttcaaaaattcggatggtgatccctcaaaccgaattttaccgtccttcaaaaaaagtaaatgatagtgatcattattaatattttgaaattgatgcgatgttaaaataatctttttaccttcagaattcaattgctgaatccgctgcatcaccacctgtgccattcgtgggtccagcccgctttctggttcatcaaacagatacaactggcgatttaatcgtgagaaggcatcaataataaccaactgtctttgaccacctgataatttaccatattttacatcagcaactttttggagcacgtcaggtaaatcagccttggtaaaccggttatttggcgtttgaatatccataaccattttaatcgtattatagaccgttgcttcgtaaataaagggcaccccttgaatttgatacgcaatctgtttgaatgccggaaacccttcaaatgatgatgggtctcgtggcttaaccgttgaaataaaatccagcaaagtcgttttaccgacaccgtttggtcccagtaaaatgttaaccttgtcgtcttcaaaatgagcatttaaatgatcgtacaactgacgcttatccggcaacgtgtatgtaaaatccttaatttccatgactttctcctcttaactaacgactgattaccgaatttaaactcatttttgctacaatcacattcccgataatgacataggcaagcccggcaacactcaccgtaatcagtgtcgtcattagatcggtctgcgcaaagaagagactatatacatctacaacaaagctgctcgggttaacaataaccaacaaaatgttgagcaatttggaagttgtcccatatgacaacagcaatgccaacaacaagtaccccatcatgaacacgcccaatgtttgagctctcattggaatcgccaataagaagctggtatagaaggccactaccgggatgataataaagttcagtaaccagcaggcaaacataaattccaggatttctaaatctggtcgatagaagacagccgcaatgatatcaaaaatcagaatttcagcttgaataaccagagtctgaggaattagattggcataaaaaattaatcgtcgatcacctgagataaacgtaaacatttttaaaaagctgttttcccgcatactaatcattgccgtaatcacctggtttaaaacgccagtcaagatgatatagctccagaatcccagcaaatgataccgaatggcggtgttagtaagatcatgattactgctaaaaaacgcatagataaaataaagtgccggaaataccaaggtataaataaagaggcctttattatctaatgctatattaacctcaaatttacttaaagcagagagcttcttgaacattttcacatctcctatggactatggacttacaaagatcaatatcgactaaagtaattgaaagtaaagtaattgaaagcattagcgtttagtcacaccatttctcttaatattaaagcattatgagaaaaaatcaatgggcttactgaatcaattcgttcgagaataccatcggcgcgtacaaacgttcctacaatttggtaatatctattacacataatcttctaaattaaagatgagaattaacgtgaaaacggttagagaaaaccatctccaaccgctgatcaaaaactatttagctggcgcttgcaatacccagtgatccggctccacctcaactaatttacccgttaggttgaattgatcacgatcataagttacaaatttcttccttcgttcataatatagatcagcttggggggcagcagacagcaaagatcgtgtatattgatgcaatgggtgctgatatacttcttctgccggccccgtttcaactattctccccttatacatcactaaaattgaatcactaatatagcgaacaattgacagatcatgagcgataaatagatacgtgaggttgcgctgcttctgaatatcttttagtaaattaataatttgggcctgaatagaaacatccagagcggaaaccggttcgtctaaaatcagaaacttaggctgaatcgccaacgcccgggcaattccaattctctgcctctgaccaccagaaaactcgtgaggataacgatcgatggcgtcaacgggtaagccaacggagatcagcaatgcctcaacctgatgaaatcgatcatgcttgtttttggcaagatgaaaattatcaattccttctgcaataatttcaccaacttttagtcgtgggttgagtgattcaaagggatcttgaaagatcatttgaacgttacgccgaaattttcgtttatctgcggaattaaactgttcaattgattttccttcataattaactctcccagacgtaattggtccaatttttgaaattgctcgagcaatcgttgatttaccgctccctgactcaccgactaatccaatcgttctcccacgtggaatttgaaaactaacgtcattaaccgccatttgccgttggcgattcttaccaaagaccactgacaggtgactcacatcaaacactgatacttgcttcattcagccgccccctctgtcttgccttaaaagtctgccaccgcttttggattgtttctggaggggtataagccggcgttcttttatcaagtaaccatgacttcacgaaatgagtgtctgataactgaaatacagggggcttttgttcaaaatcaatatccaatgcatatgggttccgcggtgcaaatgggtcacctttactaattgttttcaaatccggtggcgtccccggtaatgtgaatagtttttcatccgggttttgttcgcttggaacagcttcaagcagcccccatgtatatggatgctgtggatgatagaaaatttcctcagcggtgccaacctcaacaatttcacctgcgtacatcactgcgacccgatcagcaatcgaagccacaacacccatatcgtgcgtaataaaaatcatggaaagaccatatttttgcttttgttgttttaataactgcaaaatctgggcctgaatagtaacatccagagctgttgttggttcatccgcaatcaaaacctcaggatgatcaattagtgccatcgcaatcaaaattcgttggcgctggccccccgataattgatgggggtatttttgatatgtttgtttaggattggggatcccgacctccttaatttgctgcaaaacgcgttgttttaatgtcaaccggttaatatgctgatgatggatcaaggtctcggcaatttgttttcctacccgcatagttggatttaaagcactcagaggatcttgaaaaatcattgaaatcttagcgccacgaacttgctgtttttgtcttttagttagatttaataagttagttccgtcaaatgctaagctatctgcagtaacattcgtatttctcggcaataaccccactaatgagtgagttgcaattgattttcctgatccagattcaccgacgagcgccaaggtctcacctttaaaaagatccaaattaataccgcgaaccgcgtaaagtggaccatcattggtttcaattgtcacattaaggtttttcacctcaattacttttgccattaaatcagtaaccttccttccaataaatttgttaaccagctaaacaactgaacaaaaattaagctgatagcaattagaattgataatgtagcagtaggtgaaagtctcccattttgaaataattgataagtagtcctcagccaatgaacagggtgccgcaaataccgttcgttcattattaaatggaccgtaaccaacagtatcaacaccgcactaacaactagataaaagcgtgtgactccagctgttaaactacctaatgataacgactgtttaaggagatagtcccccagaatggataatataaagcttataaccaacgaataaccaatcacttgaataatttgcctggtttcggaaaacggttgtttggtttgcgttttaattttcatttaatcttcctttatttgtcttggtatttaggatccaacgcgtctcgaacaccatcaccaacgatgttaaatgctaagaccaaaaggactaatacaacaatcggcacatatagttggtatgggtgctgtaacatttgatcttgaccaacagaaattagaattcctaaactggtattaggtgcttgaagtcccaatcccaagaaacttaaactggcttcagcaaaaatattatcaggaatactttgtccaatatccaggattaaaatactcatcatgttggggatgaagtgacggatcgttgttcgccaaaatggtgtatccaacatcttagccgccgttacataatccaaattccgtagttgcataactaagccacgggtttgccgcgctgcatccgcccaagacgtaatcgcgattgcaaacaacaacgccccaatcccattacccaaaacggccattagaatcattgtaattaagagactggggatagagttaaagatttcgataattcgcatcaatacttcatcaacccagccacccacaactgccataatgactccataaagcgtcccaaaaacaattgataaaatggtgctcacaacggcaactaaaagggaaacctgcaaaccagtgcaggttcgcacaaacaagtcccgccctaatttatcagttccgaaaagatgagcaaaactgggcgcttgattttgaagggcaccatcaatacggtttgggtcataatgaacaactaacggcccaacaattgcaattccgatcactaaaattagaataattatccaaataatcgtgattggttcactgaataacttgttaacagccgttttccaaaaactactatccggacgaggagatgtttcttctagtgatcgacgttctgctcgcacattattcctatcaggggaaacaaaataaaatgatcgcggtgttcgactctcatccattaatcaacatctccttcctattcgtcataaagcttaattcgtggatcaatcagcgtgtacagaatgtcagtaatgaaaagtgtaataatatacaaagccgccagcaaaactgtctcacctaaaacaatcggtacatctcgattggttaccgcttgaacaaagaactgaccaacaccaggaattacaaaaatgctttccacaaacacagaaccagtaactccaaacgcaatcgaaactggtagcgaagtcgtaatgggaataaatgcatttcgaataatatgatgcaacacaacactccgacctgacaatccttttgcatacgctgtttgaatgtaatcactaccgagaacatccaacattgaattttttagcagtcgggcgtatcccgcgatgtaaccaataccaccagcgagagttggcagaaccgtataagaccaaccgccccaccacaattgattgccttcaggccacccaatgatcgggaaccaaccgagtttcccaccaaaataactttgcaatagtaacccaatcacaagactgggaactgacattaacagcaaactcagcactgtcacaaaacggtcgatccaatgatttttataaaccgcggcgagtatccccatgatcagccccagaggaatgccaaacagcatttgttggatcccgagtcgtgcggaagccggcagcttttctttcaaaactttcgacattgtctgtcctggtgtcacaattgattcaccaaattttccatgagccatgttatccatagtaatgacatatcgagtcataacaggtttgtccaaccctgaatttttgtaaacttgttttcgagcctgttcgggtaacctattagtttgcgctgataatgcatcaccaggaatcgccgataatagaaaaaatgttgccgaagcaatcaaaaacagtgaaataaaaagctcaacaccacgtcgaacaatcatctttaacataacaaattattaattctcctctcaaaaaattgttagcgcatctactttttataagcataaacataattaacaccggcaccaaaaagaggagtttggaaattgtgtaacgattttgaagtaaagatagttgtaacagggactgtcgttggagcaaccccataatctttggtcaccagcaaggtttccaactctttataaattttcaaacgttgtttcacactactgacaccgctcaatgaatcataaagtttatcgtactttgcatcatgataaccaccaaagaactgttgaaaaccgccttttgaataccatagttccaaataggcttgtggatcatttgcaccaatccagccattcgtaagaaaatcgtatttacctttatttctttgggcaataaacgatgcatcatcgggttgcgcactagcattaactgtaatacccagtttgtctttatactgttgtttaatgaatgagataatatcactatcactactatcattagtctctgtcagataaataagtttaaccttgctaagatcagttgactttccttcttctttcaaacctgcttggaacaatcttttcaattttgctgaacttttatattctttttccggtcctgccaaaatattacctgcatatttccgatagtttacactgccgaaattggcacttgccgggacaaacccctgagccggcttttcctgaccactggcaacaattttgttatatgctttacggtcaatcgctaatgataaggctttgcgaattttagcgttttttaataatccctgcggtccgcccgtcttctgattaaagacgataagatttgcagccgttccaggcattttattaatatttaatttgccgctttttgcaacttttttaaagtccaatgcttgtgttccacttgcaacgtctgcgtcaagctgaccagattggagcaatgatgaaatcgttgagtctttagatgttgaaatgtaagtaacctttttcaacttgacgtttttagcgttccaatatttaggattttttgttaaaacaagcttatcattggttttccattgagtaattttaaatggaccattagtaacttgatccttccagtcggtcttccattccttattgccatgcttttttattaaatccagtcttaccggataaaaaaccgcgtctgaaaatgactggacaaagtttggtgttggatggccaagcgtaatcacaaaagttgatttgtttggtgctttaacccccaccgaagatgccggtacctgtttcgagttatattgcttggcgtttttaatatcaaatgcagacattgcgtttgcaaatccgtttttaggattcagttcacggataacagaatcaacatattgttgagcaacaaccggtttaccgtccgaccatttagaactcctcagcttaaaagtatatatcagtttgtctttggataatgtatatgatttagcacccgccaattgaagtttatctttaccatctttatgaattgtcctgaataaaccttcctcagcattgcttaaaatctcatcttcgttagaatttcgaatatcattcacatccaaagttgttggatctcccgcctcgaccaaatttaaatcctgtttattactactactggacttttgtccacatccaactaataatacggacagtggtaatgccactgcggccgtccaaagaaacctttgcaatttgctagtcatcattttcgctcctcaaatttttgttatcaataaatttttcacatcaaaaacactcgatcgacaatcacccactttaaatctgcccaacaaaaaactccgcccttacacagtcaaattaactgtatagggacggagtacttccgcgttaccacccaagttcatgattgcttaacaacaaccacctcaacaactcatcagcaaactgaataagtcagggatcataacgcatccttgcgtaggcatcgctttcacgtacctattgctacgagctcatattcgttatcctttcaattcaaccttctcagcaactggttttctctttagaatctaattcgaacaactactcttctcgtcaaagcaatatcttaatttgttaaaaatgagtatactcatcattttcttaaagtcaacacagcgtgtatcatccatgctagcatagtataattccccttaaccgtggttacatatggcatcaatcaacttattagaagtaagttagcgttggttttcatttggtttgcgaaccagtcataggtccctaaaaaagggtgattaatgcaattcaaaaaaatttttatttaatttgaaaatatcaacgaaaatccatttatcagaataaaacattaagaaatcgccatcatttccaaagaaaaaaggcccaagttgcatttattggcagcttagccttttcattaataattcgatgattttaaattcataatttgttatttctgataagccagtccccgcttcaatcgtttccagaaactcgtatcatctgtttgtaagatcaatccttcatatattcgactgatatagatgaccagtcccgcaatgcttgcaattagaatgaataatgacacaccgatctctaacccactggcattataattgatcactcgcaatggcatgaaatacgatgaaaagaatgggacgtaggataaaatcttaaccaacaatgcatcagcgttattagaaaacggaatcgtaataaagaacgcgatcatgctcaagtaaatagccggctgagcagctttaggcgcgtcttcggctttagcaaccagtgccccactaaaggctgaaataattgtataaataatgacgccaagcaagacaaatgccagattaacgtttaccaaattacgaacaactgcactgactaatgaatggtattcggtcataaagtctttaacttttccaagctgcatcgccaactcaaagaaagcatagccaccaaccaaataaaccacgatctgtgtcaaaataaccattaacacaccaacaattttgccaatgaagtatttcgatgctttcgtactggagaaaatgatttccatgatcttagttcccttttcagaagcaatctcttgggcggtaactgacgagtaggtaatcaaaatcatgtatatcataaaggtcaaaatccaaaacgatgccattttagctaaactagcgccactagccttctttttgatttgctgcttaaatgcgggtggctcgtttagcgactttagttgacttgcacttaatttagcatttgaaatatttagttgttgttgtgtctttcccaaaaaggtattaatctttgttctcatgccgccgcttaatgagtcattagcatggtaaacgccggaaacctttgtggcatcagaagaaatcaccagatagcctgccaggttatccttggccactttctttttagcagcgctgacagtcgtcacactcgtcttaacatcatcttgattatctttaataaactgtttccgcaacgccggctggttagaaataaccgcaattttagtctgatcaacgcttgacgtcgcgctaaaataaccaactccaagtgaaattgcaattaaaacaaatggtgataggaccaacataacaaagctccacgattttacctggcgcaaataagtttctgctgccacaatccaagttttattcattgtttaatccccgctttcattctaaagatttcatccagggtcggcggttgttgactaaactcctgaatatactggccattggttaattgttgaaaaatttcaggaccagctttttcatcgtccagtcggagtaaaaaccgatcgccgcgaagtcgattcacatccgttacatgtggcagctgacgcagtctttcttctgaccaatctgtcgtaacataaagctctgagcgaccaaattgatttcgaacatctgtaatgctcccatttaagacaacgtcacctgttcgcagcatgactaattgatcgcaaaggctttcaacgtttgccatatcatgactggaaaaaatgatcgcggcaccttgggctttggtttccaaaattgcttgttttaataaatccgcattgactggatccaagccactaaatggctcatccaaaatgaccaacttaggtcgatggattaacgtacagatcaactgaactttctgctggtttccctttgataagctcttaattcgatcggtttttttacctttaaccgcaaacttttttaaccagttatcgatttgcggccgaatcactttggctggttgatccttcagccttgctaagtaaacaatttgctgttcgatcgttaatttaggcatcagacttcgctcttctggaagatacccaatttcatcaaaaacagattcagtaatgggcctaccctgccagcgaatcataccatcatactttagaaaatttaaaatactgtgaaacgtcgttgacttaccagaaccattttgaccaatcagaccggtgatttgaccatctggcactttgaaactaacgtcatcaagtgcagtcagattgccaaattgtttgtggagatgttcaagtgtcagcatattggttaacccctttcatttgatcttataatatcataaccgaattatttattgaagcaatctttattgaaatgaaacaatgtcaaagcatttatacatcaacaaatgagcaccacttgatatttaatctttagaataaaaaacacctcagccaatctctccactactcagaaatactagctgaagcgtcttattataatcgaaaatgagttatacctggtttaaatcatcattattcgcaatcaaaacagatcttcactcgttttagtgatactgtttcatcggttcaacaaactgccagctcttttgataataagcctggtcccaaaaatcccattcgagttcacagctctttaaaaattcttctttgacaacatccaaatgatgctggtcatatttcggtgcttcacgatcaatcaagtcaaacagctgtgataaaacactctcgccatcatcagccatgtttgcatagaaatcaatccacggcttaaagacgttatcatcagagttcttacccagtttcacaaatcggtttgcgatttctaagtaagtccatggacaaggcgtcatcgccgaaacaatatcaatcagatcaccagttctggcagcgttatacatatgttcattatacaggtaggtccccggtgcctgagcttcatgctgcaaagtttcgtatttaaccccggcaacattgcaaaaattgtggtgcggatgaatttcactattcaaaataaaatcaatttgttttgcaaaaatggtcatgtcagctctggttgccgatttttgaattgcagccgcataaactttaataaaggcattaagataattaaaatcctgaccaacataaaaggtcagcgcctgcttgggtagctggccgtttccaattccctccacaaagggatgcttgtaaatttcatttaaaataggttgcccggcagcgactaattgttctgaaaatttcattgtgtggctctcctaaaatgcaaaatttccaaatagcacttcaccggatttggcatcattaatatcatgcctatcacttccctacgttggtagttacttagaagcaataagcaccgtcatataagcaagtttgcgattcataatgtgcaaaaaatgtgcagttattcaattatttgacataatgctgaaattttaatttcaaaaacacatccagttatatgcataaagctgctttttatgcattaaccaccaaaacatgaacatcagaattcctaacaacagcagcagtggtagatcccattaccaatcgatcaaaggcattcgttcctgatttaccaataattattaaatctattcccttattgtgcgcaaattctataattgcctgcttgggattccctctttttacaaaagtctctacatttacgcccttttctgaagcatatttcttaccaacctcaacaattttcttggcacgattatcaaagctttcatagagacttgctggcattggttcatatccataactcatattattcgcaactgataaaatgcttactttagaattaaacgccttgctgtacaatatagcaatatctagtgccttggtagaattctgactaccatctaaaggaacgagaatacttttatacataataaattctcctttcgagtcatcggtatcgttataaactatttatctgtatcattatattttcgaaagcgctttatttcaacttattagattatcttttagtttgctacttaacataaattcagtattgtatcataatacacagaatatcattttatatgagagtatactgtggatagatttactcaataattagagaggagcttgttcatgccacttagaaattacgtacatgatattaaaattgaagacgcatcaggtatggaatcatttccacaactaaatattaactcttattatgatagtgagagttttgaactttatttggtctttgaaaacgcagttacagctgccaactttgttaatagacataaaagatcaggaaatctaactatttcctttgatgattctattatcgctgattttactgctctttatgctaatcccactatcgatcatccagactttgagaagagaactgtccatctaacctttgttaaacgattgaaataaacattcaccaagaacataaacttttataataatcgctgtttagtattacaaaagccccacccgaaattaatcgagtgggacttttgtaagtatattggtttgtcacaattaggataacactttgaaatgttttttcaacaaaacagattggaattattatattttctaacaaaagaaatccttcatagcgataaaatataaattcaacaaaaaagtccaccttgaattaacgagatgggcttctagcaattattttgattcgttaataatcttaacatcttagaagaactcttcaaggacataaatacctaatggaacaactactccagtcacaatgacagcaatttcccaatagataactgttttaagattgctgatatcccgcgtgttatcttgggaaatttgcagggccctttcggccttatcatcggcactatttaagttatccattttagtttctacacgggctaggcgctcgttgatttccataagtgtctcggtaacgttaatctcattttgtggcatctaatcactcctctattttttcagataaactcgtttaacataggcgctatttgacgtgatatatccgttggcgtacttcaatttaagacgagtgattttaccagccttgaccgctgatgcccagactcgtgaacctttagcataactgatgtcactcttgttggttttattgaacttgagcctcttataaacattaatttggggcacaattacctcatataagctcaaagcagtagtttgatagtagttaggctgtgttttgacaattgaattagttttgattcccgacagggacccgtcaaaatcataactggcatccacatgtaatcccctaaagttatcggtatactgccaggcattagcattatcaatgcctggttggttaaccccatacgctgctacccaaattcgctgatcaactaaagctacacgattaatccgaccgtacttaaaccaggaaccacttccataggtaatcacattagaatacccttgagattttaaatactttaaaaagatatttacttgggacgtcgtactggccggtaaatcttgagcttccacatcgatcgctaacaccgttgatttatccagcccgtactttttaacccaagccaaaaagtacttagcctcggccaacccatttccgtgaaagaaatgataagcgcccacggtgccaaatacttgataagcatttgatacctgttcaccagcactggcattcacataagtcgttccttcggttagcttaaccataactgaatcaattccatatcgtttgaggttctcaaaaaaagcttttgacttgctttgataaacagccacatcggcaactaatttaggcatttgcaccacccttttctgttgattgcgacgtttgagaaacgttttctacgttagtgttcaccaaattaggtgattgagtattcattacagattctgtgggagctggtgttacaggggcaaaatgattatcagctgctgtcgctttgtaagcttgataagctttttcgactaaaccggcaatcacttgataatcaaggtcaaggccgttggcttttagctggtcgttaacaaaacgcatagcctctttcttccgatcagatttactcaaggctgccaaaacggctaattctggcacaatcacattagccagtttcaatcccaattctaacgcttgctgggcatgaacgtttttttcagtcgcaatctttttttgcaagtacggattaataagcttgtaaactacaggaatgacggcaacaaaaaaggcaaccacgccggttgccttcaaagaattaaaaacatctaaaatatgtgtaaacataatggttcctccttaattttgagtaaagaaaaagcacctacccttgttggtagatgcttaaaccctgtattggatgcataacttgtacaaaatgtccaagtgagaataccaagactaacagcgctaacgattagccttgatgtgattatacaccattttttattagtagattcaatttagtaacaaattcaccacttattattaaaataacaatgtggatgttggttcttaattataagcaaaataaaaacttaccaccagttataatagtgtttagcatctaaatgcgtaaacaccgtaactaataataagttgttttgaaaatcatgaaaacttaatcagcaatccaactgatcaaaatgattataacctattttaggttaaattagaataatcatttttgattgcatgataaaaacacctgctattactaacagatgcttaagatgcttagatcatgcacggggatacataatcattatgaaattgatctcgaatgcatcaaccaatgtcttccagggggggtcaaattaaaaaagtttgacctcgataaatattatacctcatttttttaatttgttaataaaaacatctactcattggtcagagacgagtagatgtttaatcggtgcttactaagtcccgtgaatggagaggtttagaataagctagttgtctaacataaatcacaccgattaagttaatcttacagcaaaattattaaatataaacaaaaagcactcgcccttcagcaagtacttctgtattagtgtttataataatctaagagatcatagtttatgagctcttaactgcattatagccactattttcaatttgtaaacttcctaagtgaaataaaaacacccatcattgatggatgtctttatcgtatcgaggtatacaaattacggaataaacatgaaatgcccgggagcaaatcatctatcccattaaatgagattagctgtgtaaagactaacctacatcttattttaacctaacttcctgatttgtaaaccaaagacacctaattataactaggtgtctttggttgattcctatttattgaggaatacttcttgaggagctatggttaggtaagtatagggggttacactaaccatatggaaagtatagcacgttttttgagtatggaatctaattttttgaaaaattcttgacgactggaataaaaagtacccatctacaagatgagtactaaattcacatatgggggtatatgaatcacaaaacgatagatcaatactctaatgaaagagttactatcaggggtatgaatagtatcatgaagagtactattcatacctgaattatagcacaataaaaaacagagcccactatcatgccttaaagattgaaataattaccaatcatctaaattaaaaatataacgcatcctaatttctcctaatttttgggtaaaataaaagatgctcactaagaagtgaacaccctttaagcaagataagttgaatagttttctactcaaattcttaacaacaaatatcattagctacataactagtggaccaacgaaattattccaactaatgacaaacattatgagaattttgacaagtagtttttccgcaccacttatcaaaattaattatagttcattctaaataaattgaaatccgttttttatggacataataagcacctacttttcagtaggtgctaagaatcagtaccagttaactagctgtaaataaggtaatatcaaaaagggggtaccatcttcaaatactatggtttagttaacctaatcaatactgattatagaaatcattctacaacaattttaataaatgtaaacaaaaagcacctattctgaggaaataggtgcccaattcatatatggggtatatgaataatcataattgggggaaatatacctcgaacgaaatatatctcgcaatgcatttggtgggtagcagtatttagaaactattacccacacaaatgaattgtaacaccatctcggaaatgtgacacaaattacttctcatgaattggaattgttaaattaatacctatgacatcatctacaccagctccaaatcccacggtaatttcttcactataagaattattaaaatctaaatagtattcactaccgttagagttctgataattttgatgatattgaatatcattagaaagagaattgtagcccctataactaataattgattgcacgtttagtattttttccgtagtaccattagtgtttttaggttcagcagtccccattgtgtaaaggacaccattgaatattttgtagtaagcattcagatataaatttgaattgctaggaaaggctacccaaccactatcatcagcaaccggcaactgattaacagtagcgacatcaattccagacttttgaagcttaccggtgaagttagtatcttgccccgttcgtgcaagatcagatggcaggctattcgcaagtagcaatgggttcttatcaacagttggaacagtttcgaagttgtttgcaccggatagatgggcaacttttaaatcatcagctaaggatttataagccacaactccttgtactgcagtgaccgtatatgcaattccgtcctcatcaatcaacgtcccaccaccgacattgtgcccagcggatccataccaagtaatatggataaatcctcgtaatgctttaatgctgggactattgattacggcagttgcacaatacaatgtatagaatccaatagttaaattactgataacattcgatagatcacccgaagggacattcactagaacactcccatcatctgctgttattttctgtttttgccagttgacagtatcattaacatttacttttttatctagttgctgattaacatcgattgtcttggcgtaagcattccactcactccaaacattggttgtagaattgaaatagcgagttgatcgaatgttgttaattgtgtcatctaaagtttgcatgattggcaccgtcttatctccactaccaatcgtggtcaaataaccagttcccgaaaaaccacttggagcatttaccactgtggtatcgttgataattctggtaatgctgatatctaaaatggcattgaaatcagtacctatcgaagctgtctcatttggataatttaacgcatttcctatcgactgagaaatcatctgttgaacatcttcacgggacagggtaccactgtttgaaaccataatggttacttgggtaccacgaacgatgtcagtatatagatccagataaatcgaagctgttgtcgcattattttctttagcaatcattgtcgctccggcagttaatggaataacactgaataatacctcttgattggttgaattttgtttggcatagaggccgacaccatagtaaatatagtcttcattcacatcactgttatcaatggtcactcctagccgagacttgttgtcttgtgttgcaatggctttaggtgttcgcgattgcttatagttaacactagttaatgcttgtaattgtgaaaccgaatcaccggtaatatcaccggtaatcgtcactgctttagtaaaggtaattgcgctgattcctaaagcttggttcatcatggttaatgcttgattggttaatgtatttttaccccaagttgctggcattagttaatccctcgattctgtataataaaacggctttgagtcactgccacatttccaacatataggctttgttcatcaatttgactaaattcagttccattaattcgaattgtcgcttccactgaccttgccagttgctctgtcaggaaccgaacggcatccggatcactggcgtattgaaatggtaatcctgtaatggtaattgttcgcgcttcaccaccagtttgccatggttgaataattcgaacatccgaatactgacaatctaagatataagcaactgctttaatgatagaatctgtcgttccgtcagccgtcgccgctaccattgctgctcgaattttaaatttgtagaagtcatcgttcgccccagctcggtaaacattaaactgttcgccaaaatagtctaatgatttacccgtcaaatactccaacgaatgaaagatattcattttttccaacgcggtatcgaaatcattcgagcgctgcagaattgcattcataattttatagaatcgactatcatattgttgattggtcagacgactcattttgctcattaatgttggtgtatcgtccatttcaatcaggttatcatcatgtttgatatcagccattggttgtcgtcacctcaatctcatcagcattgaccactggtgcttgtgtgatgcctaaagtgacatcagtagctgctaacttggttctatccaagcccatttgaacaacaaatgaatcaatgccttgaacttgagctagtgcgccgtatactgcactgatgtaaactggccgtcccatgtgtaggttattgacataattctgtaaggcatttagtacatcgtcggtaccactatcggcattccagttactattcgccttaacggtaattgcgaagtaaatcggaacttctgttgctcgattaaaatagatcgtttcgggtgtgcccgcaatatcgtaggcaactgctgataagctgccgaatgtttgagtaccggcgcctttggctttccgcactgcattggcaatgtcctgatcagttccaccatagacaacaatttgaagggcatgtgctggtgtcccattagcatctgtcacgccgctagtattattatcaatgtacttgtctcgaatcccgttcacactatccaaagcggtatagataccgtcaattgttgagccaatgttagcaacgttggtttctagaatccgttggcgtagtgaatcatccgtttcttcatctgcaccccccacagcaggttgtggattatctacggtatcaacgccatcaaccggcgtcgcaaactcggttatcgtatgggcttgcacattggtatcactcgaataatcttctgaaaccaccgatgcggtagctgtaaacgtgccatcgccatcatcatcagaaagtacagtatcttcaactagcacaaaataagtgccatcgtcagtcatgaattcggtagtcccaccttcaagtaaaaccgcacttgtacccgtaatatttaccgttgcattcgcctgttgagactggttacgaaaaatcccccgattataagctagataatcgagggaaacaccgctggcaaactgcacgtaggcatttagccaaacttgttgctgtttttggttctctttccaattattataagcaatcgacctaatcagtcgtccataggtggattgcggttcatcattgatgtcatcacctaaaaatttcttgaaaatggtggtttgcttatcaacttcttcattgtagctctcgacatagtagccggtatcatcaaatgccactgctatcacctaccgttaactttaaatttccctgatcatcatactggttgccagaattttgaatatcggaagaatggatattagcgaaaatttcactggttcgtttagccagatcgtgtgtaatatcaacaccgtcaaccgcatcaacccgtggttcctgattcattaaagtatcagaaatatcctgagccgcgtaattatcattataggcttttcctagaatgttatccaaaggtagcccacaatccggtgccaactcgtccatttcgccctgttcaatgcctagaacttcgccacaggattgcatgagttcgtcagtaccagaaacttctactaaatcgtgagaaagctcatcttgaacaacatcgccgtcgggttcaatcattaaatcccgcatcagctcacctccgaattaatcgcgacaacaatcgcatcatttaaatcgtgttcccgtggatcttcttcacgaccaaaataccccttaccaacttcatagccatctaaacaataatcatgaaccaccatcgtcacttctgtgcccggtaccagccgtttaggcggtggcgtaatcttcattgtgccagctccatctctcggacaaattggggttaaataatccgccatgtggtcccacatctcatcaatccagtaaacgctaaatggaacttcaacattattaataattcccattttgtcaccagaaaggtcttcgggaagcggttggatgtcagcaatgtgcttggccttgtcatacttaacgattttgccgactaagcaattgtgattatcacgggaagccgcttcggcaattgcttgagcagcttttttataaggatttgtaatctttgccaacttaaacacctcatttagcaacagcgccatcaaccgtcattgtcggctgtgtgccgtcaaaactatacgttccactttgagcaaccagcgtcttcttaatgaaatcgccacgaacctcgtacgtactgtgtacggagatttgtggcaataaataagacgatgattcatatagctcttcgcctgagtcggaatcatctgaataggatggttcacttaataatccagacgagtagtccaaaataatatgagtttttttgctctctttaagatcatcaatcttaagctgatcacgatcgtaaaacatcttacttttgcatcgtttgaccaatttattaatcgcgtccaatggcttaccggaaacggtgtagccttttttaaacggtttatcctcagctaacttcgtggatgaaatctttatacctgattccttagcaatcttcttaatcgcaaccgaaggcttaacgccttttttgaaagacaagttactgtaaaactttttcttaacggtataacgggttcgtttaattttggttttaccagcaatgtgaacatggccttccttgtaatggcccacttttttgccatcttcatcggaatagtaatgaattcgtcgcttaaccgttttgccttttacattgaccttaacccttttatagtgaccgactttcttagtcttttccttttggattgacttggcagaaatgttactgaagtcctgaccggcggagaaagtaattggcacagtcgttgtcacaccatcatactgaatcggttcaaccgatttaattttgccagcaccaatcagcatttttccgaaagcctcataagaaataaaaaaagcgatttgattttttgcttttaaatagttcctcatattctgactggtgttaataaacgatgcgtctgattccggcggtgtggcatccatattaaagttaatatcaaacgtaaacaataggtctgaaccgggacgcaaattgttttctaattctagcgttttgccatcagttgtttttattgtgcagtacagtaccggaaaacgtagtaagttactcatcactatcactctctaaatcaatatcggtatcgtcgtctgtgtcagtattacttgtttcgttagtctcagcaaccggcgtatcaaatccagcaccgttagctggtcgatcatcaaacgttagctttacggtatcgttaaaattatcaccattaacctcagcctcctgtcctgattcatccattggtaccaggtcttcaatcggataatcattagaattaagcgaagcaaataatcgttgattaattacaagcttctcaccattaactaaggcgttgccctcatcatcccacaaactggctgtcaaaaagttggcaaatttatttaaatctatctccatgcggtaggcacgtccgccaagaacaacatcaaacggattgccataatcatcctcaccaacatctaaggtatctaataacaccatttaaccacctcctagtaaactctaatttttacaccgtacggtaatacattaactgccgatttataaggattcatcgaaatcaatttagcaattgttgtgttgtgatcatctgccaaactggcataagttgtcccaagtttagtcgtgacatacttcttagctgtcgacttgttatgcgtcttgctcttagtgccactgctggcacttttaccactggtttttaactcagaccagtcaataaactgcaagccaagcgtaatggttagagccgtctcatccttgttgtactcacggtgaagcgctgtaaacaagcaatgcttgtagtagatgcgtcctttataggtcatttcacagccttcagctttccacttcaatagttggttaaaagccgttcgttgctgtgcgtctgtccccataattcgggcagtaatcgagatatctttctcggtttgctgtgaatgggtggcagtcggttcacctttgggtaaggcgttcggtgtaacttgcactgtattatcttcggactctgggactgacgacataaagacaattgcactgctcttgccatccgtccgatagagcatcatatggccggtattaaacttgggcttgttgttcgcaattttaccggctaccttgttcttatttgcctgaactttggcagcagtagaacgtttcgctaaagttgccttttctgatttaactttggcagcgtacttcttttgtgccgcactatgagctttctgtgaacctttataggtctcaatcatccgccccagtgtcgctttatcgctaccggaagccttatcatacttagcttgtagaactttggtctgtacgccaatgagataggaacgattcccctcatgttgagcgcgcagactattgcttttaattgcactctttaattgtttggtattcaaatacgtggttttagcaaccatcatttagtacctccaaattgttcgataatttggcgagccataatctgacgttctgaatttaccgcctgcttaatcatctttttgattgttcgttgatttagttcaacgccaccgccaatattaaactcaaatttatcatgcgtttcaatgtggaaagttggttcagttttagcaatgtgacgataactcgaagctgaaaccgctggcttcttgataactcgttcgagttctctcagcattttgccaacgcttaaagaagccttcatcatgttagttgccatcaccgcagtatctttggctgtaaatactcttccggaaacgtttggcaagaagagttcggcacctttttcgccaacaattgaagcttggttagttttagggagaccgcctttagcgtaccagccaacatttgtctcatgactccaggcatttttggcattaccataacgacctttgatatatcctttcatccaacgcagttgggtaattgggtttgatcgccaatctgaaccagatgacgccattttggtacctgggagtgcttgcggaattccataagctccggtactagagttagcaattttaggatcccaatgagattctcgattaataaccttaataatatcgggataccaggatttaggaattccggcttgttctaaccaatgaaggtgcgatcctgttgctttagcgctcccaccggcggcactacctccagttgattcttgcaaatgattaccaacccatttaagttgtggtgcgagctctttggcaactagctttgataatgcaccgctatgcttggtgttagttttcttatttcctttggaacttccaccccgtagcttggtaatatcaaaccagccatgagttgaatccggattgtttgaaaatggattactcttagaaacaccaatatggacatgagtaccggaagaaccaagtgcagcaattttctgaccagtttgaacattttgacccatcttggcatacagaggggcgccagaattgtttttaccattaaattcctggtaaataacatagtagccatcacttgatctggtaactaaactttcaccaataccgttaactccaccccaacccgatggagcaccaccttttcgaatgactttaccaccatgaacagcatgaacaacgcgtccgccggagaaatcggcaccatcatgaattgcaaggccgccaggagtagcaccacgatagccaaatccagacgttacagagaatccagaaccgggattatgtgcccagttaccaccggcaccgcttccaccaccattacgagcatctttcatttgtttccaaacttcatcagcccatgggttaccatattttccatacgcacccttagtcgtgttggtagcgccctttgataagtctgtcccatgcagcttaatgttaacggtcatgtttttcttgagccaaccgctagggtctttggcacttgagttaatcagcttcttaaggaatgcattagatacgcctgaacctttggcatagtgagtgataccacgagcctgcgatagacgttgcatttgtgtaccattcagaacagcatccccacgctgtagcccaatcacacgattcttaccctgcggtgcgtatagactattaccacgaatgataccttcttgacgtggtccagactcggcatcgttaaccatagcaatttgatcttcgcttaattggccgttcgagccctgagcataatgaatcggattgataacggaattattgccaccgaattgtcccagtgacttatcgatacctttaatcccgttattcaattgattaatcgtgtcggacattgctttatgcgcataattgtccatgcgaccaagggcatgaccgaatccggttgctgtatcgtcagccgcattggttacacccttgcgaacttgattcatctgaccttgaacgcccttttgcatgctgtcaaagtctttaactgaactcttacgaatgttgtccgtgtagtcgccagtcttgttgtagatgtttgaccattgagatcggttctgtttggacaattgcgacaactgaataacgctacccttctgagtagcgtcataatcatcaatcgtatttttcttgatcttcttggttgatttagatgtgtcggaataggttttctcccaggcgctcttggattttttacttagcttgtccaatgagccagttgcaccagaagtacccagtttattcgtaccattagcatatcccggtaatgattgtccataatcgccagccaaaacccgtttagtagcttgggcgttcaaaatatgctcttcaggctttaaatgagccagttgtggtccattaacacctaataagcgagcttttcgaccacgaaccgtgtaagcaagttctagtccaccttcaccaaccagagcagtttgggcacggttaatcttgccaccaagtgcatggccgggtaaggtttgaatgccaaccgaattggctcgtctttggaccttccgatccgccgcagttaaatgtcggctattagttatagcccctggactataagttggcagtccaggtagtgttgcttcattggctgtctttgcattacgattaccacgattattacgagcaatggtattggttaatccattctttttttgcttagttgatggagttactatcccagcgagtgcattttcagaaaggatccggccgagttgaccgcccaacttaccagttgcggttagtaatgagttagcaacttctgtcgcttgtaacttagcctgatttacaacctttttgcgttgctgttcagcccagtgttttgtcccttcatactgtttttcagcagcagtggttgccttatcatactgacgttgagcaaatttcttaactgactgatattcgcttgagtgaacaccatagacttgtttagcagactttaatgtatgccgataagttgcttcagcagttgaaacttgtccgttgtacgacttccgtgctgatgcgagtgtcgctctttccgctcgattactatacttaagaaccgatcgatactgaccataagaaagattgcttgtgctattttgcagtttctggtaaatttgtcgctgcttgttggagcctttgcttgtgatctttacaatatctgagtccaatcgggcgactaaggctgctcgattacggccaccgttttgttcatcagtcttaatagcttgtaaatcatgattaattacttgctttcggctgtttccccaatgggcttcttcgttataagacttttgagctgtcgcagcatgaatagctccaatcttttgtaaataactaatcgacttattactacttgactgttgccgatttacaaagcgatcaagattctttcctagtttatcgtaaatcaggttttggctttgatagtcagcagacaaatgcttggattttgaccaagtatcgtaattagtcttaatccatcccttattagcttgctcaacatatccaagggcttttttggtagttaactgagcatctttcggcaaactactcaatggattgtaagcttgtttattagtcttccttacagaattttcagtttgactagatctgcttgaaaagctactttgaatatgctttccagctttagaccctagccacgaaccagcggccgctcctaagcttccgcctataaaggtaccggcaggtcctaagaaactacctaatgcggcaccaccttccataccgaccaatgtgccgccaaaatttccgattttagatccagcattgtgcttattcattcccattaaggttgttgaagttagtgcgacatccaaccaaggtattttagatccaaccattttagctccagaaagtagcttagacattcgaccgccctcagctattttaggagctgatttttctacattagacgccgcattgccaaataaaccacttcgaaaaagtcccttaagcgaatgttgcgatttagtacccttttctgaaggcatgttcatcgaattcattgcaacatcttcggcaacattagccttggaatttcccattttcatgttgcccatgccatgactatcgctaagtgcagcggcggctttgcctaacatcttatagctaacataggcagtaccggcagctgcggcgatagcagttgcataaccagcgaccgttttaagcggcttcggcatggcaattaaatcgccaagtatcttgttgccaatcttaagaacttgagtaataccaggcagaacggtcttcgtgaaatctaaccccatgacgttcaaatgctgcttaaaaacgtcaatttgattttgccaggaagacatattcttcttggccagatcagcaatgtaaccatttttgccgtacttgggtgcttgggcaacttgcttattcaacgactccatctgatcaacgtttttagacaaaatcaaagccgactcttgcccagttgccccaaacaacccatggaaaacagccgctttctgagtatccgtcatacctctcatatgccgatttaacagctgaaaaatattgtccaaagacattaaattgttttttgaatctcgcagatctttatcatgcaaaccaatcgaattaagtgcggcttcgccttgacccatcggccccttgcttggagacaataaagagttaatatctttacgtaaaccagtcccggcaacagatccgtccataccattgttagaaagcacaccgatatcagcaatcgttccggataaagattggttaccactatgagcagttgcaccggcataccgtaatgcattaccaatgccactaaaatcagtggccgataggtcagccccgtaggccatttgattaagcacgagtttcgaatagttggccattttctttcgagaactgccggcggcttttttgtagccaaactgttcgagggccggtgcaccatagccaactaccgcactgtacggatcaccagaagctcgggcggcttgaagaaagtatttatgcgaagctaattcttgattccccgaatagccacgccgaatgagttcttcgccacctttggccattgccgtcggtgaaaccccatattgcaaagcaaattggttgttttctttttccattgcccgagtttgagctttggaagcagaagccgactcaccaccggtatgcagcaagttttgaatggtcttgtatcggttctctagttcggttgcttcgtccgccgatttcttgaaggctgccgcaacgggaatcattgccattgcaatcgtgttacccatattggtgagccgactaccagcgtcctttaaacgtccaaaactggttgtggttttgtcggtttcactgcgcgtgcgtcgttgggattctgaaactttattccctgacttgttagctgaattgccaacccgtgacagatgttcatcaaccttattaaggttgtcattcgtcttttgagtagcttcgctcttagtcgctctattccacatgccggacactttttccttggttgaatcagcggcccgacctaaaagcttggtgtgtttagcagcaatgttcagagagttactcccctcgttgccggtgcgcttggtagcatcaccaagccggttcaccgaatcaatgctttgattgatcgaacgattcatttggctgtaattacgatcagctaaatcaccggtgcgcttgatctcggtattagcttgagccattccacggcttaaaccggtagtatctccagttttagcaagctgtttattgacaatcgcccatttatcaaccagcttatcggttagttcattagctttaattaaaggtgcaagatcagcttcaaaacgaacgccaataccttcatcacgcattaaatctccagccattttatctcacaccccttatttaccaaaaaggccagtgttcacaccaccggcagttacgttttgcaatcgcttgtaatgcaaatcggccagtttaatgtagtactccagttccgttgcggttgcttcttttaattcattgatatcgacacccagcgcctcgttaatgtaccagtatgtctcgtcttcttgcgccatcttctcagctagaaaagtatttgcttcaccaaaactagttttgaagaaaagaaattgtttctagatagaagtcttctaaaccagtatgcgtatcgaagtaagcccagttcaaagtttgcggtgaaatcaaaatgttgcttttcttgttaaagaccgcatccaaaaaattactttcccgaatcacaccagcagaaccgcgtgaatcatcaaggattgcaattgcctggcgacgacctggaaattgttctgtgacggaaatctctttctcattttcttgatctacggtgccatctggtttcagtggcgcactcttaaaagtgaatttatgttgtcgtaaacgaacctttacatcattagttgccgttttctttgtagtctcagtcatgataaaaatcctccatttatttttaatatttgtatgtacccaaaagggcaactaccaaagtagcagccctttttgagtaacttagattaccgaatagccaaggttaacacatgttaatccccaatcacgggcagttaaagtgtttgagaatgaaccatcaggcgctttagttacccaactatgctttgattcaatcatttcattgtctgatttagcagtaaatgagaagtacttggatgctgccaacaagtcgtttagatctttcatttttggagaagcttgtgacaaatgcaccgtcacagtaccatgcttgtcattggactcagaacctgtaccggttccttgagcatcaataaccaagttgacgttatcctcagcttgagtccagccaaccatatcacctgattgaaagccaaaaagggaaataccatcgacaataatcgacacattcttggcattataaatactcatcaaaccgctgttatcactgttatccatgttgtatccctccttagttcattaccgagccgttgattgtgacattatgaatagcaccggaacgggtatacgagaatgttccaccgttataagcacgtgccaaaatatcggtttgtgactgttgctcacgagtactgaaatcagtatcataagcgcctttaccatcagcaccggttaagataatgccgttattccaggcatcattaagcacgtcccgaacaatctgttccagtgtatcaatacccactttgtcataggaaactttgccgctcttagggtcttgtaagcgggcctgaatccgattacgcatctcaacctttacccagatttcgccatgcaggttatcgatatactcaccggataatgtgaagccttcggaagtctcaccaacggagctgccagtggtggtaaagtacacaatcacatgcgcttttttcattgctgtaaattgtgtattgttatactgctgaggtgtgatgccggccacatttttgaacttccaagtttgagaaccaacagtaagggaggcaaccgcaccaactagaccagcatccaatggttcatttgccggatgctgaaggccaatcgtgtaattttgggaacccaaagtagctaacgtggtgtaatcctcaacttgtagaagtaggaatttaccggcattagtttcgaacatgttagttaactcggttgccgtattagcgtcgaatttatccagaacagcaaaataccagccattccagaaaaaatcagccaaggtatcagatgctttgcctgttgggtatgaaacaatcatgaggtaattgccgtgttcagtttgatcaaaataacccttggccttggcatatggggctgatgattcatcataatcagtcgctacctcgtcaagcgatgtatattctttataattgccacccgtaactgatgcaattaccccagtgggtgctttatagcccgtagcggcttgctcagtcataattagcagatttccataaccaacattgggtacgggaatgatttcttgaatattgataacaacatcagcaatttgtggcactaacgtagttgccattattaatcacgctccttgttttctttgatattcgtttgagtaatttgcggcttatattgatcggcaaccgtgtagtcgtcgcgaacgatgtaagtcactgtaaatagaaaattgtaatcttgggtttgattcgctagaactgtgttgtctaccaccgaatccagtttgtagggacgcatgttggctttactaaactcaattaatacgtcaggacgataaatcgccttacgaacagcttcaagattgtcttgagcttcataaggcgattgggcgtgcgattcaatttggactccggtaaagaacagttcattttcaaccacgtcaatggtggctaactgatgtgagttaaacgggacaatggcaaagtacggaaacggcggtcgtttatcattgctattgccataggtggtttctaatccagtcgcatctttaatgaccgctataatgcgattcataaaatccagatggctaaatgtttggctcatctttatcacttaccttcaattcatagatcacgacatctgaatatccatgtaggtcgctaatgtacttaatgaggtatttcacccctgtgcgaacatccactaccacagaatctttagggaaaagtttggtgccaatcagctccatatcaaagtctatatcagtaccggtattccgctgataagtcatagcggcatacgttccaaccggaacaagtgcccacttagcttctaggtcgggcgttctgtcagcaattagttgatgcgttttaaagccgccgctagacgcacccttatcactgtcagcactataaatttgaattggcacacccattttcttgacgatgctacccatttttaaatgcatattagaacttccttacttcatagataattgattgagctaaccggccagtatcaaccaggggattatcaacaccatgcttgcgagcctttgtggctggcgcattgtgaggcgttttccatcctatgattgcttttcgaatgtctgctacaacgatgttgcccatatgatgcatacaaccctcagccgtttggcgactcatgacaatctcatggatttggttgcgatattctttagtccaagcattaaaccgtttgtcataagtctcagtaaagtaatgtcgaggtggaattatgacttccttgaccaaatagaacattacttgccccgaatcatcgaccagaatacctttaccattgccccttgtcctaagatgtaagttgtcataatccttagcgcttttgccacgtggcacgtgttcactcgggatagtcagatacttactgttaatcggcttgatatgtgcaccaaattccagtacatgggcaatcattgccaaattgccgccttcctctgacagaacacctacgaacaactcccgatgcatcagcttctttagttcaggaatgcctttttccagatggttataactcattgtggtaacaccgccaaactgatacgtggcataccgttgtcaccatatagcgaccataagcgataataatcagctccccaggtcgttagttgcagccactttaaccagtcctgtgaaccagccttaaagtaagtaacctgaattggcccaactttttcagcagaaactaacgttgaggacgtgccaacaatgtacttatggatggttaggtaacgttctgccatctccagaatgtcagtatcggtagttgagaagccatcatgagtcactttgatatgcgcatcagagatgtattgctgaatggtggcttcggcaacatcctcaaacgtatcaggagccaagtttttaacggcatcaatagtcgtgtaatttgccattcagctcatccccttactttagttttgctttgataacatctacaacgcctttacgatttgcactggtggtttcggattttaatagtgcttctaaaacactttcatctgaaatcgttctaattgcattagtagcatccgcaacattcatgtttgccacatctggcgtttcaattggtgcgtaggtcgccgcactggttgctggtgtatccttagcaatttgtgaaacgtcctcaacgattaattgtccgtcagctaccaatggcttaatgagcggatcggcaagggcctttttaaccttgttaacttctttttgaagcaggttattcaagcctcgttttatcatcacaccattaattacacggttaaattgagttctgttttcaactttgaccaaagtagcacctcctaaacgttatcgacacggtttaccaaataagggcgacgcaagataatgccgcctaatcgctcgtacaaagcaatccggtgagtccagaagttgacaatctcttcttgtgagcgactcattgggtcagcaatcgcgatttgaacggtatcgggttggttatcaaagataattaatgaatccttgccattagttccggcacctttgagttcagggattgaaacaatgcttgagaaccagccatttgcttgaacaactgccatgattgaacgtgagtcgtaatcactgtaacgacgattgagttcttcataagcatcaggagccaagcccagaaccggtttaatattggagaaaccatttactaacgttaaagtcttacgtgccttacggagaacttcaacgatggctgctgaatcagtgattgctgaaaacggaccatcggcatttgtggtaaccgtactatctggtgagttaaacaatccgttaatacccttggtttgatcaccaacaaagcagattgaattttctttctcagcgattgctcgtgcagcagttgcaattttggtgacattgggggttaacccagccaaatgagcttgtttaagttcctcgtccgtccaagttgcgcccacttcaattcggaaaatagaactatcaactggcgttaagtcagtatcaaccatcgggatatcattagaacgttcatcagcaagcttggctttaccaaaacttctagatacgtagtaacgataagatgttgcgccttgagggatatccgtataaggcttaattaaacttcgagctagaagtgattgttgaggcgcttgataaatagtcttatcaatggctttcaaatctctggcttccagcattacatgtgaatttgccattttttaaactcagacctttctatgatccatgtgcaatagtgtaaggtgctccaagattaagttgcaccggtgccgtggaaacttgtccaaaatcagtatcagaaactgacgaagtgttaaatttaccattgtctaggaattgtcctatcaccgtatcaccagctacagcagtcttgaaaataccatttgatccaactgttgctgggtcgccaacttttacatctgcactaatttgaacagtaaccgcaccagaacgcattaccggaatctcatccttggcatcccattgttcaacgtctcgggaatcccagctctgaatgtagtaacgattaagcactaccccgtaaacaccggtaccgttagcggcaggtgcaatgacgttattagtcttagttaccgcaatgccgaatggaacgacatcggctgcatggtcagtattcacaacataaggttggttactggcaattgttccggcacctaatggaccggagacataaccagttccttggggaatataattaggcattacttttcacctccaaatttcttatcatacaaatcgagattgtttccgagcttggtttcgttggcactatctttatggaattcgccaccagcgttatcaaaaccggtattttttgcgacatcttgcatagcatcaaaataagtattgatgtaaatatcatccttatctttctcatcgaagctgtcgttcaacttcttgatcgcatccaccttaatctgtttatcatctttgctctcaaactcgtatgagtcgcctagaaccttcttagctttcttttcgagtgctaaacgattctttacggcttcttgaatactgtcggcagcatcttgcttggctttctcagccttagctttttcagcatccttttcagccttagctttagtagcatcactttcagccttctctttatcgtctttagcagacttaagcttcttttcagtttcttcagcggtttctttgctctgcttggcttgctctttagcatcagtaatctgttgcttataagccttaatttgagcttgaattttgtccgctgcatctgattcaagttcaacagtatcgcctgaatccagcattaacttggtcatttgattccctccattcgatttatgtttatctagaaccatttcggcagaatcaccaaacaaattaacatcatgtccggctctgccatggtcaacaatcgcaatatggttaattttgatgttcttttgtgcggcatcatatcgagttccttggtattcacctgggttttcatcaacgttggctagaaaaccaatggatagctcatgtttaccatctcgaatctgatcaagtgttttctgatcagccaccgtcatcgatactttcaaatgcctgccatcactctgcgcatcattgtgtgtcatccctacggcatacctcttataatttgatggcttaaccgtttcattaggatgatcgttcgtaattggcttagaattagccgattgaactgtctcaggtgagaaaatgtcatcagggagcttagcttccatcaattcagacccatcagaaaagcgatatgggaacacacctggcttagcaattggacaagcggtgatattcaaaaaaccgtcgtcgtcaatcgtcgaatccatgattgccattcggtcatatctggtaacagttttcaaatctgccaccttctattcgccgagtggaaccatgaagtaacggtctggtgaatagatgatttgcccgacttgaaccttgcgatacttgcgaatgccgttgtaccaacgtaactgttcagatccacgcttgaaatgattggcaacatcggcaattgactcgccttcttgaacttggtaagttgcatcttcataataagtgcagtcgttgggatgattaacccagaaattcttctgctgattagtcaatctcaaattgccatagtgagaggctacttgctgcgcacgtaccgttggatcttcggagtatacctcatcaactggagaaacagctgatgaactagccggtgctgaattagtaggcgcatcacttttagctagagtacttgatgcagagctgcttggataagtggaagcagcgtatgaagcactggaactggttggtgctgaactacttgatgcagaactaactgagctagttgttgcatcactgcttgaactactgtcttgtgccataatagaatctccttttcctaattttgctaggcatcaaaaaagacgtccatttctgaacgcctcatccctagtaatgtgactatgtgggcttgcaccacatcatgtctttgcactagccactattaaattaatccttgtgcttgatattcatgaagttggtcagcaaacactggcaacgcaacgcatcggcattggatcggttcacctggcaccatcccattatcaccgccagcaggattaccatacctttgtaagctttggtcaagtaattgatgcaagtcacgcacacgggcgtcttccattgactgccagatataataatcggcaccagcttcctgctgacgatgcgcattgatttgaccgagaatgctgccagtctgatcacgagcaattagatgagcgtgcgcactggttacattgtcaattttggcaatttccttagcaatttcgcccgttccttgacctttggtaacgccattaaaaacggttgattcgacttgttgggcatattgatcatgtaaggtcgtaatgcgactaacattctccgcaatcttgctttgggtatactgccttaaaaacctgtctgatgatattgggtcgatgggctgcggtcccatttgaactttcagcccgttataactccacttatcaacatctttaataaactctctaacccaggcttctaaagtaatgtcattgagtccggactctaattggttctctaagtactgcatggctgccctgagctggtcagccacactgtcgttagcgtcgtcgtcttgataaatggctgattgtttgtaaatcgggacaatcgtgtatcgccacaattggtcggctcgttgaaaccaatgcttcagcaagctgtccatatacttgtgatagcgtgtctctaatccaaagcagaaccgtgttggcacaatgtgcggtaacaattccttgggtactttgatcaactttgccatgccgtcacctacttaaacagcttcttaaaccagtttttatgcttagcggtctcaccgttgtactttttaactaggtcattcttctcactatcggttaattgctcaaacggcttaatagcgtctgctgaatcacctgtgaatgcattagtagcattgttcttatccgtatcaaggaaggcatcatgtgcctcctcagggcttaatgcgccacattgaaccaagtaggataatccctgtgcttttgcaagggatgtctgtgcgtttgttagtgaatcctgttcccaaagtgggttgaagttcagctgccagtcgatgctgtccgggtcaatattaccaacgttcttagctttcagtagcaagcgaactaaacgctccagatatggtcttagaatgttttcttgttgtgatttgatataagaataatagttctgcacatcagtctgtgtgccagatacctttcccgattgctgacctaataaaactgttttaggaatgttagtcgctgccgataagttgtcccacatgaagctaattaatgaatcaacaccggttaattgtgtgccaaccttagcaacctcatcattctgaccaattaacgccagtgattcagtcgtaaattgataattcattatgccggatagtttcgctaattgtttgggatctgcactggcagtatcaatactattagatgaataggttttaaacgaaagatcgttcatgatttgccccaccgaccagttagcaatgtcaactagctttagagcatcaaagattgtttcgtaaattgaatgtccctgatcatcgccctcatcacgtctgtattccgcatgcatatatcgtgaaacgtcaatggtcttcatcagaccattctcggtctgtgtgttgttttcaagatcataggctgaattgcctactgaaacttgaatattggcttctttgccatacgttagactaaacggccataggttagtaatgatgttacccacaattcgtctatcgaacggttgaatgtacagaatatctaataaggcgtcaggatccagtggtttagatgaatcatcatctttttggttctcaatgccaccgatcgcaataaacgaatcgccccacttgagacgatcacttagaaattgggcaaaaacattctggctatttaaatctttgagtttttggttaatcaaattgtccaggtcttcattgtcagacgtgaactcccagccatttcgcgtcatatcggttgctggcattgtgattaccatatgagcaacgtggttatcatggtcaagttgctgtatttggttatcatctaactggcgataattgccgtgtggcacaagattgctgtaactcttagccgaagcactatgatcatcggccatactgtcaacgatttttactttttcatccagcgaatccttaggtgcttgcttccgtttgatgcgtttgtttgccacactgtgtcacctcacattccatatcgtgcaaataggttattagacttttccatgtaggttagtccttgcgtcgtactatcaacttcatcgtcgtgggctgcggttgggaagctcgttagctcagtaatataatcgtcaatctcaggtcgccaagccggatgagggatgtagatattaccagcctcgaactgtgcagtaacggcatatgctcgcacttccttgccaccttgcggttcaaccggaataatgccaccaatctcatgctgaagcgtgttaatgatggctggcccgttggctttgtcttcaataaacttccgtgaagctttcgggtacatcttggttactcgtcgaatagcattcagcgtttgcgtaaagtccatacgagcatgttcacgatgtagtagataacgatcagcaccccgggcaccccatacttgaccagctacataatcatcattttctttacttttaaacgtggcatcccaagactgaatttgagtatctaaaaagcgtggcaaaatcgccacgctatcgtctaatcctaattggtgtttaatttgttcgttaggcacgtagtaacgaagccaatccggtttgaatacgccaccaccttcagggatgggattttgttgatataatgccgcccatgttcgagcaccaacactcttctttgtttgttcagcccaggctttgtcatagcttaacggattctgtggtgcgagtgtgtcgccaatttcacgacctaataaatcatccgattcagtacatactgctggcaactttaactcaatccacggtcgtgctttctgcttaagcaaacggccaattagatcatcgtcgctccacctagtcataatgacaatgcaagaagaatcagcatgtagacgagttgaaaaggttgattgccattcttcccatatcttgtcacggattgtcttggacattgcttcttgggcgttcttaatcggatcatcaatgattaacagatcagcaccacgaccagttgcaccagatagaattgaagttgagtacatcccaccggaatgccctttaattccccagtctgaaacggaacttgtctgttgtgaaagctgtaggctaaacatttgcggggcgtaaaccatgaatttatcacgattcttacggccaaacttagtatataaatcttccgaataggccgccatcataacttccttatcaggattcttcatcaagtagtagctcggaaatgtttcagtaatgctggctgacttgccgtgacgtggtggcatctccacacacaggaacagtttttcaccgttaataatgcgctgcaggtatgaacagattagtttaacgtgcggatagagtttataacgattttcatgcgataaagtaaagtaatactcatactttcgtcgagctaatgccaactcaataccatattctgcctgttctttaggattatttaggttccaagccatctttatcaccttctagcttttctaaatgcttgattaactcgtctgtgcccaagttatcgaatgaggaatcaacgcgaccagacaagccaatttcacgtttatcacgccactcattcggtttccgattcttaagccaaaaaatgaccgccgtggtatctggtggaacagtatgctcgttttgataaagctcaattcgttcacgagtgggtacatgctcatacacatattctttgatatcgtcatcagttgcttcagggtgactaagcttaaactcattcttcgccttatttcggcgtgcccacaatacattatcgtcaaggtcaaccactttgtactgatggtcagtggtgacataaccagtagcacgtttaaacaacgcattttcaacttgtcggtcaacaacttctttccccttttttagggtgtcggaaatgtcggaatattttttcttccacgcatataatgttgtgcggttaattcctgcatttcttgctatttgatcatcagtcaggccatcacgtgcccagccttccagcttgagcaagccttcttttgttaaccatttagtatacttagccaacttgctcacctctaattattttataaaattatctgagccgtatgggatagggatgtctccccaaacctcttttagcatgataaagatcaggtaatcataattactaccaatcaatggcacatttgagaaattgtcatatgctttggtcataatttccgcatggttgcgaatttcttggtcaatatccccatcttttaactcttgctgaatggcggaattagtaaccttatcgctcataatcatcttagatacttcaggctttagttttgatagttcgtcaacaatcttattaaaatctgcattctcccgattagtcattatttctctccttcgtgatacaattaaattacaggtatttagtaccggttgtgcatatagcatgatctagtaaatagataggctttaaggcctgaggctcttagctagaaattagttaagagtctcttttgttttggccttttagttccaaaattcatcctcaatatgagcaacaccgtgcattgacgggatactaaacaaacgaatttccgagccgtcaaacatcttaataacagtgatgtttttttcatgctttttaattgatttgatatacccacgatcaagattcttaattgtcacgtacttgcgtttaatgtcctggtctgtgataatccgtcctaattccgaaccgtttttaccaccagcgatgttcaattcctcaactaggtaccgctgatgattatttaaatgaatctgcacggcattaggttgatagtcattattgccgtcaattattggatcatagaacgtctcattatcgctgtttacatcttgtaaatataaaccattgttaaattcatagacccttgaatttttccactgctcatcattgtgataagtaacgatattttgataatatcgtggcagtttaacatgtgcattcccatgattgattacttctagcaatccatttgcttcggttttcgtaacagaattaacatatgtcattaagctttttctccttcaattcaagtttattcaggcgtctagctgctagaactttccgcttacgatctttaatctttgacttcttgtgattcttcgtatgtttgttatgtttactcataaattgacgcctcatcattctttagttgtcatatttcaaaaaaacagtttaacgtgggataatatggatagatgttttggtatgtttgtttgtcgtgcaattgcttaaggaggcatctttcatgaccatacttaataataataaaatttaccagttacttagtgaacgaggattgggaaacgttagtccagaaactgccgaagccgttgagtcaattttaggggaactagatcgaaaaaatattttaaggcaaaataatagcaaaaattattttattgatcggaccacgttggaaacaactggtcttttaagagcattagttgaacaaaactggataataattgcacaaaacgatgaaatcattaaaaagctaagccaaatttttgctgcccaaaaggaattgtaaaaataactaatagatcattactatgaatttgtgttcatgttaacttattagcaatcaaatcaattgcattatttgaatattagaaagataataatcgtagtaactaataaggaggttatttatatgagtttaaaagataaagcagatagcactaaggataaagttagtggtaaagctaaagaaactgagggtaaaattaccggtgacaaagctcgtgaagctgaaggtaagggacagggccttattggcaaggctaaagagaagctctctgatgctaaagaaactgttaaagatactgtcaatgatcttaaaaagaagactgacaaatagttttgaatttttagacaagccgatagtttgtcttttttctaaactgataagtcgatctttgcctcgataatattcagtaaaatggttggtagcatatgataaatattaaataatcaatgtgaccatattgatgccctctttgcacatttaaaagcgttaactttaattgtataatagaatttgggggacgaataaagttccagctgcaggtgacttaaatacctgcagctttttgtacaaaaaagtccatgctttccacgcatggactacttacttacgatgtgtgattagacacaaacacggatttaaattttatttatcgtaagcaacgtgactggcaaggaatcgaaccccacaacggcagtttcataccgtaccatttcgcattgttgcgtactcagccacacattttatattagtattgtaaaactctcttacaaattccacaataccaatatacctcataaattcgtataaacagtccgatcatagtccactttgagtctgatttaagtctgatttataaatatgtaaatcatccaaaagatacgtatcggcaaattgtagcaacgcgctgggcttgatgtggtcaaagtagtgtgatcgggaataaccaatagtcatatagcacattgtatccgtatagttatctaaatatcgcatgcttagaagctctttgctaacattatcgcatctatcaattgcttcaaccgttcttttgacgatttgttgggcgtagactcttcgaacaattgtggcatcagcattattcagtttggttggtgatttgggcattccgtccatcgctggcgatttcaaccttgcaatcattgcatcatagttagctgaggtcaggccacttgcccttagcatccttggaaataagctccccaaaaagtgtttgcaattctcaaccgttctgtctctatccacctgtggaaataagctgtccatttgattgtccaagtctggcaccccttctaataagctttagttaatgttataattaatctgccattaattgcatcacttcggcttccggaaacggaagccttttttgtttattaattcttgatctaccattcatcagtaggcggcaaactatccaaaataccgccctggttcatgattaaataaatcattggcaaatcttgtttaaattgctgcttgcttttagatagtgttaaattatagacatcaatttcaccgtcatgatagctaataatacaaattagcgatgaatcataataattatgaaaagaaagtgcatggcgagatttgtcatgctctattttgaaattcttatgaataatatcatatcctgaataaatgatgaacatatgaaggtagcgacttaattaggctattaataagagtatctttaagcaatgtgtggttcatttactctcctccatagatctggattttgggggtatttcccaaagccttgcaggccaataagtaaaattacaacctccaactgacgtattagaattaattgttgcaaatcaaaatattcatgagcttttttaccccgcgctctaaatttgatttttgggcgcatttttatttcccctttgttgcaaaaacagctgttttttgatttatacgtgaattgcttttcacgctttcttattttttctcctcaattaatttccaaccaaacaacttacgatgtttggcgatagcgtctttaaccatccaagtactaattaatgggtgattgtcatttcgaataatttccacaactttcaccggactgttaatcttatgaaattgaccatctttaattgccagaatcatgagttcaccttcttattatcacgatcaatttgattttgatattcataaataatgttacgacaaatctgtgttttgagtcccaaaatgtgtccaatcgtggcactatcatagccacggtaataaagttcaactgcttcttgatgaacttctagagcttcccactgtggtaaatcactgatcgtccgttccggaaaatgcaattccggtggttgggctcgtctgcgctgaagggctaacatttctggtgaattgtccggtgcttttctgattgattgataacgatcatcacaacaatgaactaaagctaatatttcatgataataattcttattggcctgcttatgctgcttaactacccacagatagtgagcaattttattttcaagtaaccgactcattacttaacctccccgattatctattttatccatctgctgtcgcgtcatcacacctaactcaatcaaggttacctcatcgagcttaataggttggacgtagtatttattaatgaaagcttgttcaccgatttgatggaattccgcatgatgcttgcgacataaagccataaatcggtgttcgcgatgatcaaccagtactcttgtttcagtacccacagcgtcccagtggtgaatatctgcatgcgctttcccacaaatcgcacacactcgatgacgacagcattcatattgataatactcctcattctttggtatgagtttataaccttttcttaagggcacatgccattcaaacacaaagtcaaccactaagtcgagcaattgattagcatcgctgactgacgatgtagtggcgtctgacaggctaatggacttaccggcagtgtaaaactcatattgagtataaaacagttccttcaaaaattcttgtggcacaatgaagtgctccgaaatatcattcagcaaggcaaagaacaaccgccgttgtcgcggtctagctttgcgaggatcggcaaacgttagatccacccagacttgattcgtttggccgttaaccgtctccagatgatccaggcttggctcgtgatctaagtgaataatcaggtccattccttgacgtttagctatcaaacgggtcatctgtctgtaaccttctttttctgcttggcaatagcggctttgaagtctaaataatcttccgcttccaagtcgggattccattcaaaaccactgataaagccttcatggtattggtttaaaagtaccatcatggcaaatcgccgataaatttctcgacagtcatcgtcatactgattaccgccatgagcaattactacccgcatctgatttttataacactctaataaccaatcaggatgaacttcgctggctgctaatctaagcatttgattggcccaggcaatgtttgtcatcatcaagcctcctcagtcggggcagtctgtctaaactgcgctaacttttcttgaactgcccgtttttccgcctcggaaactttcctcttcggttgcttagctggcgcactcctagactcatcctgggcccagtccggcaatttttctttaatgtgcgcttgtttttgcttatattcacgattggcttgtcctgttagaacgtcatatttttcacgcagtttcttggttgataaaatattagcccgccagaaatcgttatcttgggtccaatcaaccagcttggcaaatttgtcatatgcccgtttgtcacgctcatgagctaggcgaacttcatctgcccacttttgtagatccggtttttttaggtctggttgatgttcacgaatccgcttataaagatgctcagcaatttgatacggccgctcagtcggcgcataggtccgcgatgttttagatcggggacgtttgtttttattagtctggttagagtctgtattagtaagtcttttatgagctactgtctgagctaccgtttggggtactgtctgagctactttatcggtaccttctaagctactttttgggctattttttgggcttgtagtagctctgatagtatccttataaagttttatgatgcgatattttggtgcaaatgaattttttcgcccacgtacgtatccaatcaatccgtcttggacaagttcattacgtgctttcttgattccagcttcagataaaccggtcagactgagcagtgcagaattcttcatgggaaatgtgtcatccaacttgccttggtcgttcgcgtagtctaatagttcgcgatacagattattttggccgttactgatactcatttcatacatcttcaaattacggtacgctcgtcgttgcttaaagtaatccaaactggaacctcctttcatttattcctcccacccaccacttgttgtgactaatctagaacggtaaatctgaatctgaaatattaatgccgtcatccttaccaaaagagtcagttgaatgctttatttcctggtttgaagtgttatttgaaattgatcgactaggattttgaccagcattgggacgcttaacgccatttggctgactaccatccggattaagtggatggtatccacggacctgtaaataaacttgaccactattattaggttcaccccattcagtttcaacagataactgactattttgggctgctttagcaatttggccaatactatcaacccgtgcaccatctttaactcccaaagcaaccaagaaggtgttaaaccgtttgatcgacgtctctaagtgttcctcatcactgctgtcccaaacgaggttttgataacgaatttgaccacccttatacttgccatctattacttcaacatccaaggttaacattggtaaacctcgtcccttggtcgtggttgtttgaaccttaaccactttaacattgtaagtgccagcctcttggacactcattccaaaaacattatttgaatcaactgtgaacaatgacatttctttcaatctcctcttcagttagcttgttaggctgaattagttcttcagcatgaattaatttccgattatctagccggttcttagcatgattcccctgctctggatctaaatcaatcatccgttgaccatctttaacgtagattcggcccaccacatcaaacatgctggtaaatgcgttaaacgtcttctcattcatatcagctgcataacgaccatcgccagtaatgccagccgtcccattatcaatttgatgggcggtcgcataaacagtcttaccactctcctttaaaattgtccccagttgccgaaaccaaagctgcaacttctgatagttctggcgattatcctttgaagcattatcaatattctccagaacaaagttttgaagtgttgagacattgtcgagtgcaatcacctgatacttactgttagcaatgacacgattaaccattttaaaaacatagtcttgaattcgtggcatatcctgtttttgaaagatcaggacatcggtatctttttcaccgattaaaacattacttgataggtcaaaactaaaaagtaatttatgtccattaaactgtttcaataaacttgtttttccggtcccaccatcaccataaataaaatacatgctgggaatacgggggatatttccatcctgataaaatttcatggttgacacacccccttattcattaaatttaaacattgtcgtttcactggctggtttaatcgttggaccatcgagaatcatgccatcattactgatgaagtgatcaccaacaaaatgaaaatcctttttaatggcagttttatctggcttgggatttggcttaagatactgggttaatccctgatcacttaaactttgtaccaacttcttatcattcggccagttgacaccttcacgttgcttacgggtggaaaccgtaccgtatggtgttgaaatacgggccttagggtccgtttgacgcatatcatgtaaatagtcggacaatagtccttccatgtattcccggctgctctcgttcttttctaattccttctgttgccacttttgaatcgctacaatttgttcttgggcaacccgtttaacctcggtatcctgattattaaaatcacacagtttacgcatcacccaggtagctgaactcaaatcatgaacttcaaatttgggcttttcgacttccgttgattcgttttctaaatctagttttggtaacgcactcattgctattcctcctcataaattccggtcattgcataatcgctcaaatgatcttcctcacggcgtaaacaagtcagcatagttgctttgacgtcagcacttggttcatcatcaatagctctttttaaaccagccactcgtagcttggccaattcaacggctttagtcgttgtgttttccataacccaatccctccataattcgttgcatccagcttcgttgtggcctatacttaatgtatagaatgttttgacatacaaacaatctctttttcgttgcgttggacaactgccattgttcagcgcttttcttttgctcatttttcatagttctcatcccttctaactgaaccaatcttttagccatgcttttggatcttcacaaaacttacaaaactgatatccgataccaaatgcaatcgcaccaaacaatacataaactgtccatgttggcaaagttgcaaccacactaatcacctcctcaattcaattggtttcagcaattcatacggctcgcattccaatacctcagaaattctacttagtgatgaaaatctaattgtctccaagtgaccgctgcgaatataccaaagagcattcctagaaagaccggttttctggactaggtcacttaaacctaatcctaatcgctgactacgaagcaaaatattttcagcaagaacttcgcctaaactactcgctttcattaaccaaactcctttctaagagatgttggcaaccgttgtgtaccaggcttgccatgtttagcaacataagactcccatgcctcagatacctttttaacgtcccacagtcgcttatttcctaaatcatgttcagcagctaaaaattcaggcgtatcaataaccgacttataaagaaatgattttgacatatgggtcattgctaccagtccctttaaatcaaccgttaccgttttaacctctaaacttcttttaacagaagtttcgatctgttcatcaattcgggacaaaatatattgactaagttgggctgaaaaatcattcatttgcctaacctccaaacttttgattatattcatcaaccaattctttaatctcttcgtctgataacttggcaaaaatcattttggcgtaagtgtattttaattcggatccaatctcttcaaaagaatccttaaaatgcttaagcaaaaaatctgactgcgcaggagttcgctgacacgggtccatggcaataatgtaatctgcctcgtcttcagacgcttgccgttcatgttcttcctttttctgagaaacctcatcagcgtacaaatcctgctgtaaaactggattattcatcattgatggaatgccaaactcacttcgcgaagcactgaatgctaatggtaacgaccacagcctttggacaagtgttttcttgacatctcggggtgcgtttcttcgcccagctcggatgttgcttaactgacttccggaaatatgagcttgttccgcaatctcagatcgatcgaacgtttttcttagtttgcctaaatcgagtgttaattgtttagcaaattttgaatctctcaatctaatcatctccattttgaaaaaagattaatcgtccttttccatctaatttggtaaattgaacttaaggagttaggaaaatagtaattgctcctcactgtcacaaagtgattgatacatggctttaagaaaatcatcaccgtgccgatcaatcatttctttaatcgtttctactcctctggatttagccgttggactgttgagaatttggtgaatcatctcttgacgtgtcatggaatcgcctcctttcgtttctttagtgggataattaagttattccatcaaaggtggtgaaaaaacaggaaacttgatcatcggtcaatttgcgaatatctttcaagttgagcttcaatttaatcgccatactgatagaagatgtcaactagttccacggaaatgatgtgctattagatttgctatatgcccaatcgtgaatttcctgtttcaataccatagctttcagattgctttgtttcgttaacaaacgacagaccaccgaacgctctgcttccggaaatgccttgagtggttcttcagtaacttgcattacttggtcacctctttttcagtgagtaaatcggatggtgggactcccaatccgtttgctagcttcatcaatgtcgtagaagttggatctgctcctcgttcgactgcactaatggttgtctgcaataaatcacttttaactgctaaatccatttgtgtgtaacctcttgatttccttaaattcttaacaataattccaacggtcattcaattcatccctttccacaactaacatttttttgttagctaacacctatataataccaaagttttgtaaaatgtcaacatagttttggtattaaagattattttattacttttattgctaaaataataacaaaagattgttaggagtaacttttatgaaaactgattctcagttactagctgacaggctaactgatttaatcgaagataaggatattactattaatcgacttgcgaccttatctgggcttgggcaatcatctgtcaatgctatttttagaggcgatagtgctagtccaaaattaaaaacgttagttaagattgctagtggcctgaatatgtccattacagaacttctagatttcccaccatataatcaacgtccagatggttcatcacccgatcaggaagctgataaatgggaaaaattggggaatgcgctaacatctgatgaaaagaaacgtgtttgggagattctcaccggtcatgattttcttccctaattagtgaggtaaaaaaatgaaatcaactactaacattgaaaacatcgtcttagatacattagtccatcttcatatggatggttacgactcctacgcttgtgcaatgacaattcttcctacgttggaaaaaactggatatcaagaatctgatatttttgcagctattcaaaacctttctagtaagaatttaattaacattgaatcagtttctcaaacccctgcttccaaatttaaatgtgttaatttgataccgtttactaaacagggctttgcttattggaaaaagtattgctaggacattttatttgttcgttgccactatctcataaagtaatgacgacatctcaactaatcgaggtgaaggtatatgaagataaaggttgctcattttaaagcatcaagcactgacttttcggtcatcctcttggcttctaattctgagttgacggctgaagcaatgaaaagtgttggttcaaagcttcccaaaactatccaaagaccaattgtaattgccgcaaagtcaacttctggtttggtgttttatggtcaagatgatctagttaatcttatagacgaggtcaaaatggcccaatttccttggaaggtattgaatatttaaggatatttctgtctttcatttgatcatcttgctcaattgattggctaaagctgttagttttgcagctccatcaaaaagtgcctctttagcttcctttttcttagagatgtctatgccgtttaaaaatatcagaatctcaaccagttcctgttccatgctttgcctcccttcaacaaacttctcggcttgtgccacctttgatataggataatgtaattattccaaaatattggctaacctctaaaggacaagaactagccggttatcttcattatttcaaaacatttttcacaagaaaggttgtaccgtgatatcatgcgtacacctttttttcctaatgccatgggacaagcggtgatactcataactatggggagagaaataattgcctgctttgtaagttgataacggaattttgtctcccgactcgttgtagtaaaacagcagaatatcattctcagaatgttaaatgtaattttgccatcacctttaaaaacaatggatttaatttcaaacattttcataattgttaaatcagctctttaaattcatcgcaaaagaaactaatttttacgttcaaagcttttgaggcggcaaaaacatgttctaaggttaaacggttcttttgattttcaagattccaataatgttgagtggttttcaatcccattcgccttgcagtctctgcttcggtaagccccaactgctttcgacgctgcttcaatagttcatttgcattgggtttaatattcattcaatccctccttgctaaacgaatcgtttaacttatgatcatattatagctaaacaaaagatttaacacaagttattttttaaattttttgtttataaatgtaaatagatcatttaataaaactataattattaataggagtgatgacatggacgaaaaaggaaatactggactgcctatgcgtcttattaatttacgtgaagaacgcaattggtctaaaacagaagttgcacgcaaactcggtttcagtagtatgcagagatatgcaaattatgaatacggaactaacgagccagatgcaacaatgttaaaaagaatagctaatctctatgctgtttcagttgacttccttgtaggaaatactgttgaccgtcatggtcacgttccttcttgggcaactgaaagggataaaaatgacctaaaaaaatatctcagtgaaaactgggattcaatgacttatgggggtgatgaattaaccaatgaagaaaaacaacagttacgggtggccatggaaaccatcttctggaaacggcataaacatcagtagtttggcaaaaataactgtcaagaccgttgtttcccgatatggcactgccgatccgttcacgattgcagataaactaaatgttgaatatttttatatgccacttggaaaacatcctttaggcgataccagttatgaccatcacgacccgatcgttattcttaacgaatccattcgagaatcaccacagcgatactacacattagcccacgaactggggcatattattatgcacgccgatctaactggttatcattcaggaatctggacttatggaaagtatgagcaacaggccaatcagtttgcaactggattaatggggttactgtttgttgaagagaatggatatgaaccagataattattataatttagtgaattgctatgggtcaccggtagattttttgggttaaagaggggaaacattataataaagttcaaacaatttttaaatctagaaatgtggatactagttatagttgctgtaattctagttacaatgtccttagttaaccaacaatcattttattgaaccaaatgccgttattttaaattttaaggatatgattacagtgactaactttgtattaaaaatcaaaaatcgaacaactcctaaggttgtaatgatttcttaccaggcaatgaccgaaagtgatcataatatattgatcactggagatataaaactcattaggaatcaagttgatcttacatatttgtctaataaaaattttttattgaatttggttcaggatataattaaacatcttaagacggattatatcctaactaaaattgaaattgaacagtcagtcaatcgatttcaaatatgtattcctactggacaagatcttgatgtttatataaaaacttatgaacttactaaccgcgttagcacaagtattggaaagctcgataaggtggtaattacagttccaatcataaaattatttagaataggttaaataaattgatactttcaagaataggagagatattttaatgatttacacagatatatttaatattaaacatgagaatgctaaggtcgttgatactcataactcttttaatcgcatctttgttatcgaggacaccaatggtgttcggtacacttgtttaagagaaaatgcaccggttatgccaaaatctgctactcattttaaaactttgcgttctaaaaatgcaccactgaattatctgtctccttactttactggtaagcgagttaaatgacggttgtttcttaaaaatctaaaatacaatttattatctatttaagaggagattattatgttaaaagaatttaaagaatttattgctcgcggtaatgttatggatctagccgttggtgtcattattggtgccgcttttacatcaattgttaaatcattagttgacaacttaattaatccattaattggtatttttcttggacaaattgatttttcaaatttggttttcaaaattggtgatgcaacatttaaatatggtgccttcattaattcaattatcaatttcttgattattgccttcgttgtattcttattggtcaagcgtgttaataagctaatgcctaaaaaagaggaacaaccaatcgtaccaactaaagaggaacaatatttacaagaaatcgtggacattttgaagaagaaagcctagttttcaccaacaatactgggatgggaggattaattcatggatatcattttaatcgctatcggactagtatttgcattaattggtattatcgttattaaacaaagtaataagttatcttcccaggatcttttcaaactttttggtacattcataggtatatcatttatctttttagggggatgtttgattatatcgggcatatatccactcttgttaaaacacttcccgcttataataacgcttttttactaacatacgattattattttagaagtttgtaatttgaatacatttgattttaaaggagaaataattcatgaaggctattacatatcagggaataactttcactacttatcaacaggcagctgactttattggtattagcaaagttggcttctcaaagcgctttcaaaaatataaagctggtatttattcactagacaatttgtttaaaagttgtcacccaaacaaaaaagaaatttcatatcatggaaaaaaatttaacagttatgtagaagccgcaaaatatattggttcaacgccagaaacatttggtcgccgtcataagcagtatgaaaacggggaaatttctttagataaattatttcgaagaaccaaatatacttcctatgaactgccagcttatcatgggagaaaattcactatcaaaaaagaggctgctagctttttgaaaattagccaaacggcacttacaagacgtttgaaatattatcattctggaaaatatgatttggacgatttgttttcaaaaactccgaacgaaataagaaaccgacatgctaaaaaaacgccattacaatttgctgatcaaacatttgatacttatcaacaggcagctgactacgtcggtatttctcaacccgctttttccaatcgtatgaagaaatactacttgggaagctacacctttaatcaagtttttgaagcccctaagcatacacatggaaatgtgattaagtacaaggatcatactttctatacctataaagcagcctctgaatttattggcatcagctataattctttctctaaacgattaaaaaaatataagtctgatgcaatcactctggatgaattatttgctaaaccagatgtttttcgaactaatcaaaataaatttggttaaccttatattttaaaatctgctcttaaaaggaatttatggtcaataattagtcagtctcaaaaaagaccctttgagtcgaaataaattaactaatccgatttgcctatcacaatgaagtttttaaacattattcataggctgctaagtatcttgaaattaatcaaaatgcctttattaaacgatttaaactttaccatgaaggtcactatactgtgaaagatatgtttacatctatccttcacatgtcaaaaataagaaaaatagaaagtgcttccacccactacagagacaaaacatttcgtaatcaacatgggaacattaagcacttgggaattgcttaatgtgctatcaaaagtatttggcaagaagggtttcttagactatgtgctccggcctggtaaacaccatccgccagcataacagtcaattaattttttacgtaattaacgtaccttttaatatttaggaggaatttattgtgaaaaagtttaatcttattttaagcttggcattgccatttatgtttttatcatcagtaaatgcttcttcacacaagctaactattaagattaatcctattaataatcaagctaaaactattactggtaagacaatcaagggaacaaatgtagtgctttatgagggacaaaaagttattactaagaaaaaaagtaatggtaacttttctataaaagtcgccaaaccacttaattttaaaaataaataccatcttctaattaccaaaaaaggttataaatctaaaaaattcaaccttaaaattattgatcaaggaattaattatgacgctaaaataaatcaaatcaactctaaaataaaagatatcaacgatcaattaaaaccattaaaaaaacaagtgcaagttatggacccctttatcaatgctctagagaatgatgatcctacctcatcaggctatcaaactgctctgcaacaggctgagggaaatactgaggcttatgagaatcaatataatgagttaaatgctcaaataaaaagtgtttccagtcaactagggccactttatgaccagcgccaaacttatatctataaatcaatgcaacaactactaaaacatcaagattagctcttgaggaacccagcaaaacgctaccaatcctacagcattatatttttgttttgactgtttaaatggatcaatatattcccgtttactcatactatcactcaatcattctcagattcttgttcgcaaatgtatttttgaatgatcttctgattcaaaccaattcgtgctacgcaatatacgtgtgcccaagaacttcgattgccatagttatatttcaaattggtatgtctttgatggattatcacggcacttcttccttttaaatagcccatgaatctcagtttggatattacatataccccgataatctcaacctcttttaattcaccataaatattctttcttcggtacttcagcgtgaaaacaatgtgatacttacaattccacctggtatgtgctaagctattatcgtttttggacaaagcaaaaactaattataacgaaagggagtttttcacgctaaaccttttttcactcccacaagtaaaacttgtggattattcgcgggtactattataataaaagtgttcatcgaaaaaatgtcttttcgatggaacatgtttttcattaaacaatcttaatcgtttaatttcagcatgttcaataccaaactttttgaaactgatattgtcatcgtagaaaaaatacatttataactctccttaccgtgctatagagtatgttcagatatagaactgaatgaaataatactctaagtgtatcatatggaaggcgcttgtaggtcttggtaaggatgatatagaaagatttaaaagaaaagtaatataagattttttatacacaaaagtttgataaccagaaatcgtggaacaattattttttatgatcgtgttgacaacctttagtggatacaaaaaagagacccattaaataaataatagatctccttcttgtaaaattgataaattgaaaactatttgattaaaatattagtcaaacaagtttgcttggtcgcttgaagtaccgctggtagtggcagttgcaccactcttaacgtcattcaatgtccagttgaagtatacttgaactggatcaccaaatttaccattatttgcaccactcaaattgtacttgatactgctgaatgaagttgtgtaatcagcatagttagaagtatcaaattgagggaatacagcagatgttaagttctttacaccatcttgttggttagcaaagttcataacatcactagctgtaaaggttgaacctttagtaccgctaaatagtttagcttgtgctaattgtgggttaacaacgtagaatgttgcagcatgttgtgcaatggctttattgatgtcagaaacaaattgtgctttttgagcaacagtttgatgattaccagttgcaccaaagaatgatgacaatgtctgatactctaatgttgatggctctgccttttcagtattcgttgtaagagcgtctttagttacactaacggtggccacaagacccttttgactatcacgagtgtaggcaatcctgactccacgggcaccagcacctaaaccatttgcggtactttgatcgatcttataatatccggtattagccgcagtgtcagaaagtggagctacatttgtgtagttatagttttgagtatctgatgcttgtttaacagtaaagctaggaactttattaagcttttctgattgcgttaacgtaccattttcatagtaatgagaatatggtgaaagtgctgtatagacagtgtcacccttagccaattggatcttgatagttgaaccaaatgttgcttgggcaagtgcagattcttgtgaaccagttagttgaccatcagccaggccataacccgtaccagttaacgcgttattgatttgctgagtaagagcattcttgtcggttgtattaagagtccatgaccaaacaccattagcgtctttattcaacttacctaatgtagcacctttagttgcattagtaacagtataatcaggtgttaacgttttgatggtgttgccttgggcgtcggtgagaatcacacgtacggcgttgtcagcgacaggagtagcagctgatgagccggcactcgagctagcagaagtagcttgcagatcagaagccttgatccacttaccgttcaattgagcggcagcggattgagcagcagcagaagctgatgctgaagaagcagctgatgagttagcacttgatgttgaagctgaactagcaggggcagcagaaacttggtaccaagtttcgccttcacgagaagtagttacggctttagtaacagtgaatgaagcgccagagtatggtgtagtagtagtaactaccttgccatcaacagtagcacggcccactttgtattgtgaccaagcaggtgcattgtaagctaagctgctagtaccaggattcttcaaagtgaaggttgctgatgaagcaggagctgatgaagcagcactagtagtgtcgtatgaagcaataccaccggcaaagttagaagtgctcttaccaccatagatccagccacgataagtcttatcaaatgatacaaccttgtagtaaactgaaccacggttagtagtggcaacacgatatgcacgccagttcttttgaccttgcttgctatccttaacagctgccaaagtagtcttagtagcaacagtcttagcaccctttaaggtacctgccttagtgtaaagtgcgttagtaccattaacattaacgttacgagtagtagcgtcagtagttaatgctttatttgatgtaactttggcataagactttgcagatgcagtttgtgcattagcagaacctgcaacggcaacaaagccaagagcagccaaacctacaaataatgacttctttaaacttgatttcattattttgtctcctccaatataaaaatttttaagtacgacgatagttcaaaagaactcatcgatcaaaacctagtataacatactcatagcaattgacaaatataaagttcaaacgtcacttattattaataatactgttacatctatgtaaaaacccttccattagccagtaactaatgaaaaggttttggaggatatgtttgtctgctcttaaagttcattctacttgttatatacacacaaagcaaatcaattaccgataaaatattttcatagtcatttcttgacgccagtgaaggattccagtatgctaagcacgtgtagtagaagaagttctactgcatatatatgatttgtagtagcgtcacacgtactccagcgtgtgacgccttttattatcccaagcaaatctcttcctattaatatgtggtattctattcataaatataatttttaggcttactaaaaggagacttcttatggcttcatttaagcaattaaaaagtggctggcaggctcgaattttttattatgatgttaatggtgatcgtcagtcaatttctaaaaatggatttaaaactaaacgtctggcccaagaatatgctaatgaacttgaatatcaatattcccagggtggtgatttaaacaataaaaatgttacccttattgattatctactgaaatggtatcaaacatttcgtgaacctcaaatatctgccagcaccaaattgaattatgaatacacgattcggatcgtcaaaaattattttggacgtaaactactgaaaagtcttacccgcattgattatcaaaaattcttaaaccagtttggcaacggtgacgctactcatgtggcacatgccaaagcaaccgttattaaagtaaacgcccatatccgtgcttgtgtgcacaatgcaatcaacgacgggattatctttcgtgactttacctttggcactcacattacctttgatccaaagctcacccgtaaaataaattatctcagtgaagctgaagccaaaaaactactgggggatttaaaggcacatttaaatggttcaattgtttattcaatggcttatgcagctcttttaactggtatgcgggtttctgaaattgctggtttaacctgggattgcattgatcaggatatgcacactattcatatttatcatgcttggaattttaaatcccatactctaggtcccactaaaaatgcttcgtcaaatcgaacgattatcttcgatccaactttgagtaacctatttgcccatgtaaaactaaatcagaatacccacctaacgttaaaaaaagcggacaatccccagaacctagtattcttaggacgtgatttaaaaccggtttcaatcaacaccctagaacatctattgcgaatatccctaaagcgatctggtataaagtcggatttaacttttcatggtttgaggcatacacacgcctctctactattgtataaaggaattgctattccatatatttctcagcgtctaggtcacaagaatgttgacacaaccatctcgatctatctacatatcgtacaggaactccaaactaaggaagctgacaaaacaatcacctatttgaataaattagaacaatagttaaaaccagagtgtgcacatttctgcacactctttttatgcataatgtgcagaaatgtgcagaagattataatcaagtggaaactaatgcaaaccttcaaatggttaaaatagaaaaacactgacataccaacgtttatcaatcccgaaaaacagcttatgtacggatgcaataccctacgttggttctaaccaaatcaggttcaaagggattggcaatccgccatctcagcatacagcacccctagtgatcatatttgaataactctattttaccatgattcaattttttctgaagcgcaattaaatagcttcgcaaactgcatttccaacgtatttattctataattgtgactgataaccatttcaagggagtgatcaactattaaagcattatattttgaccaatttggtggtcctgatgttctaaaatacggtaacttaccggaccctcacttatctaaaaacgacgttctggttcgaatggaatatgcgggccttaactttgctgacatatatcggcggagagggacgtatcatatcgacaaacggacaccctatattgatggttatgaagggctaggtgtcgttattgacatgggcgcccaggtttcaaaacataaacttggcgaaaaagttttctttgttgatgcaccgtttgccaatgccgaattggttgccgttcccgaagatcacgcaatcaccgttccagacggcttagacgatcaattagttgcgagtgttggtttacaaggcctaaccgcagattttcttgcccatgaccttggccgcaatcatcctaacgacaatgcctttattcatgggattagtggcggggtcggccagattctgtcacaaattctgactgctgatggtgtcaacgtttatggcgtcacctcaactgccgacaagaaaaagatcgcacttaatcagggtgctaaagatgtctttttacgtaaggaaccttggcttcaagcctacgttggcgaatttgataccgtatatgatggtgttggcgtgacgcttgatcaaagcattgaattattaaaacaccgtggcaatttggtcttctttggcatggccggcggtaacccgccaaaagttgacttagtcacattactttcacaatccaaaagcattttaaccggcgacctttgggattacctcacagattattgggaacgggtcgcccgcagtaaacgactgtttaaatacttcgaagcaggcaaaataaaaattagtcaacccacaattttcccactcaaagacggtcaactggcccataagtttttggaaaccggtaatagtgccggaaagattcttttgcaaacttagtttttagtttccggtcgaaataatgacaactccgaaaaaatatttgctggaaaaagtaaacagaactcaaaagagagccgatccaagcaattttggaaacgactctctttttaattgacgttcttaacaattaaaaaatgtcgacaagcagcaatccggtttcctgattaactttctaatagttaacctccagtgcaccattggtttatattctcttccgctcaaacattaaaaacgccgcaagaataaacaggatactgtaaccaatatttccgatcatcaattgtttaattgttaataatgtattttcataatacgccggatttgaccattcatttggcatattcagcatattgaaaggattccatctaagtaatgggatgcttctaccaacatttcttagaagcatcatcgaaacaccctggccaataaaaatgaccgtaattccgctggcaatcgcaaccgccgcgcttttagccgcacaggatagtagcagagccgccccaatgataacaattgagcccaaaaaatcaattaggcactcattaatcaaattgctcattaacgattggccgtactcatagttggcactaaacgaatatttacctccatacattaaccacttaatcggcaacgtaaatccaaatgccagcaagtgcagataggcatcgtaaagaataataatcgaaaacttggataaaaagatccgcacttttcccttgtcctcaataaccaaatgtttaatcgtgccatactcatattccatggaaatcgtcgtggcgcaaaccacaatcatgataataattgcccactcggtgccggcaaatgctgctgtaatgtaccattgggcatctggtgaatgccttgccataaagccaaccgccagcatggccataaataaaataattggggtgtaccacgtcccttttttatgaatcaacttatagaactcttcactcagcaattctctcattacttgttgcccccttgatgttccagcaacgttaatacagactcttccaaatcggtttgtagatgctgaacgtcattaatttgaatgtgatgcgttaataagatgttaaataagtcattcaaacttggcgattcggttaatgaaacacggacactcatgctggtttctgccacacgaaaccggtttgcagccaagagttttgcgcattgatcatttgatgacgtcattaacgataaatagttggcaccgagttcgtgcaaatgaatcattgaatctgccaaaacaacatttccgtgatctaaaagtacgacttgatcaatcatcttttccaattcacttaaaatatgactggaaaccagaaacgttgtcccattctttgctaattttaagattaaattgcgcaaatcccgatttgacatcggatccaggccattcattggttcatctaaaataaccagttcggggtgttgcaacagtgcgatcgcaattcccgttttttgtttcatccccaacgaataatgagcaaccggcttatcaacataatcggtcatccccattacttcaacaatctttcgaacgtcattgctgtccttatgagaataaagcatgagctgctcgcggccggttaaaaagggataaattgccggactctcaattaacgccccaacccgcttggcacctttagctgaatgagcgtcattaaatctaacttcgccagagtccgaggcataaataccaagaataatcttcatgacggtcgacttaccgaccccatttggaccaatcaaaccaacaattgaccctttaggaacttgaaagctgatgtcgtttaatacggtatgcttcccaaatctttttgaaacgtgtttgacagtcaaaacattctccaaaccaactcatcctctccatgaatttttagattcgttttgagcgtacagcaagcccacccactcgtacataggatttcaataatgctatcgaaaatagcttgaaggctcttcgaagtcgggtatgctaaaaatagtagcaacacaaccaacacatattttaatgaaatcaggtggaaatttatgataacgattggaaacaaaattaagcagttacgacatcaaaagggaatgactcagcaacaactggcaacccaactttgtgtatcacgccaaaccatttcgagctgggaaaccgaccgaaacatccccgatattgaaacgttaaccagaattgctgcatatttcaacattcaggttggaacgattatctcttctcaaaacgctgattcggtttaccttcataaatatcaacaatgcatgatggatattatcttagctatcttgctggttgaaagagtcacccagttatcgactacctttgggttgcactggatgaactttatcgttattttttatttgattatctttttcttggcgcttaaacaagccaactactttttgaatgccggattaattattttcggaatgaccagcattcttagtggattcgcaaaccttttttggatggggttcggtttccgatttacttgctttatttgtggcgttttgtcactaatcgtctttgcaataaatgttcaccaagcactttttagaaaacaatgtcagttgcgaaaagtcaatcgggcttgaataagtggggatgacgaccactaccttcatcgcatgacctgttacgtttcctttcaaataatatgtaacattatcattgctatcttagattgactcatttgattcactggaaagttaccccgtgttaatcttttaatacggttaaaattattatgccattaaagaagttcttgaaccgccatgataattaactttgattccttaggagtgagtaactgtaaataggtatataaaaatagatagaataaagcagaaaaatatagtatactgttcatagaaagctaatatggaggtgaacagtatggctatgatcaaacctaaagaaatggctgatagattgggaatcactgtccgcacactacaggaatgggaccgtaagggtaaactgcccgcacatcgcacgccaacagatcgaagatattataccgaagaccaatatcaagcctacgtcaatgacaagccaactgctaaaaaagtggtggcttatgcccgagtttctaccagtggacaaaaagatgatctaaaaaatcagctggaattcattcagacctatgccaatgccaaaggccttatcctggatgaaaccatcacggagattggcagtggcctaaactaccagcgtaagaaatggaaccagcttttggatgaagttcagcgtaatgaggtcggtgtgatcttcatcacctataaagaccggtttatccgtttgggctatgattggtttgaacatctttgcgctgtccacggtgcggagattattgtgctgaataataaagcaacttctcccgctcaggagttgatggaagatctggtcagtatcatccacgttttttctggtcggctccacggcttgggcaagtacgagcagaaattgaaaaaagattctagcttgttgggcggtgattctaatgatccgaacgcaaaaagttagactttatccgaatcagcatatgatcaaggtactggatcagctttgtgactatcgccgctattgctggaatgaggctctagcgacttggaatgacatgtatgacttgcatacgatcgaacctagcaatccaagccctagtgcctacgcagttcgtaacgaactggttgctaataagcaggactggcagtatcaacgttctgcccgtactttgcaattagctgtcactgatttgggtaaggcgtggcagaatttcttcgataaatcccagccggattggggaaagccgaaattcaaatccaagaaagcaccccggcagggatttaagaccgaccgcgctaagatcgtggctggcaagttgcggttggaccgccctcacgggatactggattggcaggatatcaagctgagtcggcatcttgacttatctggtgatctcaaagttgtcagtatctatcgtgaaaatggcaaatactgggccagcttaccgtttgaagtggcgatagccgttaaacctaagacggatgccgtatcggcggtagacgtgaacgttggtcatttgaactataccaatggggtgcaagacaccctccctaagcctctgagtaaactttatcgacgtatcaaattctatcaaaaacgcttggctagaaaacgacggctgaatggcaaacaagcgaccaaaagtaatggttacgttgcaacgagaaccaagctgcaacgtgattatcgccgtgttgctaatattcagcacgacctgatgcagaagttcacgaccaaactggtcactgattacgataggatcgtgatcgaagacttgtccgtcaaggacatgcagatgacccatgtcgcctcaaaaggcttacagcggtcaatgtttggctattttcgtcagatactaacttataaatgtgtttggtatgataaagaactcattttagcggaccggttttatccttcaacacagcgttgctctgaatgtggtgacatcaagtctggtcaagacaagatcacactgagcgggaattcagctcataagaccaaacattatgagtatatctgctatcactgtggcgcggtactggatcgggataaaaacgccgttgctaatctattagccttgatctaaaaaacgatattaaaaaggggccggctaggccctgatgctgtcatagttggtcaatgtgattacgtccttgtggcatatcggaatactgatgtttaacggcagtaaacaaaatcaagaaaggaaaaatacaatctttctaaaatatagtaactcgtaccgatttactacatttctccacattttgtatagcaggacatttatgaaatttaactggaactatacatttgtcgtcaatagcccactcgccattttatgggtcttcgtcatgatcgatgatttggtattaacgatgacaccggcgaacctattaatagtaattggtatagccgggattgtttggctcatttactacctattgtttgaacgaagctattttcgaagccacccactgttcaatcctcaaaaccgaaaaaccggaaaagcagccagtttggtgacaattctcggagcatggttgagtcttatactattcttcctaacgcgaaacgctttgctgatttttagcttgcttatcctgaccaactttattcgtgatggtttttcaatccctaaacacaccacccaagaaggagatggcattaaatgaaatttgattggcaatccagtttaatttttagtctgccaatgtttgccatgtggttaacccttgttatttatacatacctcgtttcagtcacattcacttggcaaagctttttaatcactttggctatctttggatgctgcctagccgcctactatttcttatttcaaagagggttctaccaggcccatccaaaaacaaatccccacaatcgaatattcaatcattcgggaattataactacagttaacttgattgtctgtgtcactgcctattttctctataaaaacccgctcattgtgattggaatcatgtcctttggtgtctttattcaagccggcaactcagtccctaaataacttttgtgaggtgaaaattttgaacaaacgtaattggaaatacagttttatcaacaacctaccctatttcatgattttcgcattctatgcgatattacttccattcactaatcgccgaaactcagggagtttacttggcccaatccttatttttatcatcatctggctggggtactatctattattccagaaaaagtattggcaaaagcaccctgaggcaaacatcctcaatcggaaaccaaccttgatgagttggctcattagcattgttggtgcagttggcctgccgttatatgttctcattgcgcagtctcataccaatttctttattttcatgggatatttattaatcctgctatttattagggacagtttttccaaacctaaagacaacatttaccagaggtgactttttacaaatgattttcgattggcgttacagtctgttccaaaacgttccgattttgcttgcagcaggcttattctttattgaaatcagatcctcaatcaacatcatcggtgttaactaccttgacttggcgggtgttttcctaggcatctggctgctttactatttaacggttcagaagcggttctatgggaaccattcagcctataaaccgaccaaccgacaattaaccggtctcggactgatcattacgatcaccggcattatgatttgtgcagttttatttttcgagatcccggcgaaaaatgactggacggcatggctggctgttgccttgtcagttattttaaaggattgctgcaccctgccaaaattaaccactattcagcacaaatcattttgatttttgacccataaaaaaggatggaacaatcatcaaaaatcactattatagcgtcttagtccgagataagaatcccgtaaaatcagcgtttttgtaaactgattttacgggatttcttaaaaataattgtttcatcgactatgtcccagccacagaccattttaaaattggcggtggaaaagatgtttggtttctatgctagattttttaattcgatagtaaagtaggatcgaaaaagattaatgttgaccaagatcggtttcaacatccgcgagtgaaaataacggcaactgcgccaaatagtcgcaatctttccgattcccggcatcaccctccgccaaaatggcatatcgaccaatcacacttgcaccagcttgtttaagtaagtcttccgcggccgctaatgagccaccggtactgataacatcgtcaaccagaataatccgcttgcctttaattaaatcggcatcagtggcgtcgagaaccaagtgctggacgttggtcgtcgtgatcgactttacttgaatgctcattggatttcgcatgtataacttttcgcttttccgtaacacaacgtagtgctgacgaccggccaatcgactcatttcttcagctaatggaatcccttttgtttcaatcgttacgaaataatcaaacggttttgttatccgcttagtcaattcaattgccgcgtaatgggccaattcggcatccccaagcagcacaaatgacgcaattgctgttttttgattaattggaatgatgggtaatgttcgttttagcttaccaattgttaactcatacgatgactgcacctgttccttcctccaaactgtgaacttttaaataagtttttaatattatattcgtatttacactaatttaacacctatatgaaacgaatgtcgaggtttatatggccaatacacgaattaggtggataaaaataatcgtaaaaacacacgttatttgatgtgttcttacgactatttttactaaatgacagttgtggctacccaggatcccttatgtatttgctcaaatctgagtagttagaatgatatgccaagtgtgatcgtcaaaataacgcccaaagcgtgacctgcatcgcggttaccctcgatgaatccttgaataaaactgtaaaattccggcaccaaaatcaatgccacccaaacggctccccagataactgacgacttattcaatgccttattaagatcccgcatattgatagaggataagaagccaagaaaacaaaccaaaattggcaatgttaatacatcatctagcacattaccagaaacaccaatcaacttaagaatggcaaacccgataactgcaatgataaccccatacatcacgatatctgctgacttacttgtaccatgttcattttccattttattcattaaatctgcatctcctctaattaattcatccagtgaaatttgaaataaatcactaattgctaccacatttgcaaaacttggcaatgtcgatccgttttcccattttgaaatcgattgacgggaaatatgtaatttctccgctaagtcactttgagataagtggttgatttgacgttgcctttggagctgttcaccgattttcattttgtttcctccttgatgaattcagtatatcgggatttgaggggtagcggggagtacttaatggttgccccaataattttaccgcaaactaaaacggtaaccataaatctcgttaccgttttgttaatcctatttattctgatcaaaacggcgattacgcagataatcctcggcccataacccatagataaaggcaatgcacagagtaatcaataaaaaagtaatgctcttaacatcaacgaacccaaatgataatccgatcaataaccaaagggggattaaaaggaacaatgatcctgtcacatatactttaaagatgccccacttttgatgccaacatgcacgtttactaaatatatgaaacaaaaataatccacagattccgaaccgatggcgaacattcttagtattgtagcgataacgatcacaaatatccttttttagttccgccaaaagctgtggctcatttctaattaattcttcaaatggtaaggcataataatcactaatcagcaataatgtgggcaggtctggataatcccgaccactctcccaatctgaaacagtatcaatttcaacatgaaatttatctgcagcttcttctggaataatttttaattcgactcgacgctgtttaagaatcttacttaacattaaagtcactcctatgtcactctaaacttctgattaaaagtcattatggcaaaaaaattgaaaacttaaaagcacaatttacttgccccaattacccggttattagagttaaaaattatattccaaagttagaatgtcaaaaaccgcaaaccaaatagcaaactttgactaaacggtacatacactactttagttatggctgtctacgaaacttagcttgcgaaatagtaaaaccttttcgtatattaaatgacaggaggtgaatttaaatgaactttagccgtaaaatcaagcaggcaaggttagaccaaaatctaacccaggattgggttgcgagacaactgcatctttctcgaaaaacaatttccagttgggaaaatgcccgtagttaccccgacattgccagtttagtgaagctcagcaatctttatcaaatgtcattagatcaactattgaaggaggatgaagcaatgattaaacattttcaagaacaatcaaataatcataaacgaaacgccatgattgcaacaatctgctattacttaaatattgggttgcttttctttgtcatcatcaatcagcattggaacgtgtcaccgttattaacggatagtctctacctttggatcattaatttaattattctggcaaccttttacgattttggtcgattaaacaccaaactaaagcacttcaccaaattaacgtcaaagcggctccaactaatgggcatcattttgttaacaatgaccatctttctttcgctttttccaatcggaaatgtcactccgtttttactgggaaaactgtatggccaaacttttttcatagtaatcactgcacttagtatcagttttgctgtttttggaaatcccaaatcatcagagtagtcctcagattttgatattaaccaaggtctatttggtagattctcatctcaccagcttgatcaaccaatcgacccccgttttttaacacaaccttttgagatgcaatattgtctctgtgaacagtgatcaaaacagaagtcagtcccattttgaccgcctcttccagtaacaaacctaataatttggaaccatatccacgctcccgctcattcattgagattgcataggcaatatttccaccatcttttttcagcctgtcagttagtcggtgccgaattcggccaattcctacaggatgattatcagccagtaaccaaaatgttgtttgggggacgatgacctcattcccgaaatcgggctgagattcaagccgacacttctgaagccagttctgataacctgcataactgtgatttcgaaccggattactaaaccggtgatcttcggattcaatcgattgaagcatccgataaaatgaaatcccatcgttgagacgaactcttctgatttgtaagttttgaccatcaattttcaatacaatccccaccttctaattttagacgccataccgttgtccaaaacaaacataacgttacccaatcctagacacgtagcgatctttcactaagatcactgcgttttttaatcttcattaggtaacatatagttgtttgattaatgatccagaaccaaaaaagtattaaactttttttagtcgtttaaaccgtgaagccacgcggttacggcgcctcattctcattttagtctgagcactatatattgattatcagcgagtggcgatatactatatatagtatcagctcacaggaaatgagcacaatcaaggattaggaggtaccgttatgcaagcaatgaaactttcgtcagtttcgctttctgacgaatttataaatcaagttaaagatgaagtaacaccacattggggtgaacttggatgggttacctacaagcgtacatatgctcgctggttacctgaaaaacaacggactgaaaactgggacgagaccgttaaacgagtggttgaaggtaatgttaacctcgatccccgacttcacgaggaaaatgttgatccaaaagttgttgacgagctaaccgaagaagctaagaaactctataaattaatttatggcttggcagccacaccatccggacgaaacctctggatttcaggaactagttatgaacaccgtaatggcgatgctttgaataactgctggttcatcgctgtacgaccacaaccatacgggaatagtcatattgtacctgaatatctaaaacctgatcaaccagccgtttcaatgccttactcatttatgtttgatcaattaatgaagggcggcggtgtcggtttttctgtcaccaaagaaaatgttcataagattccaatggttgatgataaagttaatctaaccgttatcattgacaagaacagtgaatcatatgaagcctcactcaagatgggtgcagttgataaagatgattggctgaaaaatcattcattaaacgacgttcaatattataaatcacctgatacccgtgaaggctgggtcatttccaacgcgcacttaatcgaccttcacttcgaccagacaactcctaatcatcaacgaaatttagttttggatatgagtgaaattcgaccaaagggtgcaaaaatcaaaggatttggcggaactgcctccggtccaatgccattaattgaaatgctatttgatattaatgatgttttgaatacacatgttggtcaacatttgtcagctgttgactgtactgatatcggtaatctaattggtaaaactgttgtggccggtaatgttcgccgttctgcagagttagcattaggttcagccgacgatgaagacttcattacaatgaagcaggataaagagaagctttaccatcaccgttgggcatctaacaacagtgttgcggttgactctaattttgacaactatggtcccgttgctgattcaattcggcataacggtgaacctggaatcgttaacttggagctctcacgcaactacggtcgtaaaatcgatggtgttcaaaaaggaatcgatgctaacgttgaaggaaccaacccctgtggtgaaatttctttggcaaacggtgaaccctgcaacctattcgaagtctttccatatgttgccagtcagcaaggctgggatcttcacgaagcctttagattaggaactcgttactcaaaacgggttaccttcagtaactacgactgggaagtttcacgtaacgtcatcgaaaagaaccgccgaatcggtatttcaatgtcaggaattcaagattggattttaagtgaacttggcaatcgggttgttactggttttgaagatactaaagatccagaaactggcaaattagttaagaaaccactttatgatcaacgtgccgttaagcaagttgatggtctgtatcaagcggttgttgctgctgatagagaatattcagatactttaggttgccaaccatctgttaagcatacaacagttaaaccttcaggaaccgttgccaaattagcgggtgtttccgaaggcatgcatttccactatgcgggctacttgattcaacggatccgattccaagacaccgatccattattacctgcattaaaggcatgtggttaccacattgaacctgatgtttacactaagaatacaatgtgcgttgagttcccaattcgtgccgcacacgctgacagcaaagaatttgcttcagctggtaacgtctcaattgctgaacaatttgcaactcaggcattcttacaaacttactggtcagacaatgctgtaagttgtaccgtcactttccaaaaagatgaaggcaaccaaattgccccattgatgagacaatatcgcttcactaccaagtcaacatcattgcttccatacgctggcaatggcttcaaacaagcacctaaagagccaattgatgaaaagacttatgaaagccgcgttatggaaatccatggtaatgttgaaacaatctttgagaaacaaaacggtaaccatgataaaaagggtgtcgagttagtcggtcaaactgattgcgagggtggcgcttgtccaatcaagtaaacaacccctgatttggatcagcatcttagcttttaaaacaattaatttaacttaaaacgaagactcaaaggggactggaacaaagctgatcaagcttggttgccagtccctttttactgctcagtaaaagatttgctatactaggttgtgagcgattaactcattaacaactggataataaaaatggaggttaccatggtaaaaatttatacaaaagtcggcgatcacggctacacaaaacaagttactggaaagatggttccaaaatacgacttacaaattgaagctttgggggcaattgatgaattggactcatggctgggttacgttttatccgtcctatcaccaaaagcaagtcctgaacttacgccacgaattaaaaagattcagcataatttgtatgaacttcaagcagacattactgtcaaacgccatcacaatattactcccgatgatacgaaagcgctagaaacagaaattgacgatatcatgagtaagtttccaagaattaaagcatttattttaccaggtggtaagcaatccggtgcctcgctacaatatgcacgggcactggcgcggaaggcagaacgaatggtggtcgagcttcatgaaaaacaacaacctctctctgatgatctgttagaatactttaaccgcttatccgactacttgtttactttggcacgctacgctaactttttagatgggtatcaggacgaagtcagcaaactaaaataacatttacagattttaaaaccgatttcattgacttacggttacaaaaagcggctggggcaaaagtaatttttgtcgccagcccttttatataatcacgattattaccaaataatatgggatgaaagtcaacttcctgccacgtaactgcctttcgtcccacttttttcttcatctagaaaatctgcatattttttagatgaatgaactacttgcaaaaatattatagaaggaaggcttacccatgtttcttgtccaagtctattggggagatcttatttacacgatcattatgaatgcagttctcattgcaatcttagcagcgatcgtttatgctgttattaagtttattcgtaaatagttaataaagtaatgactaaagaggtgccatttaatgattagaaaaaccacaaatatgacaaacagtttctttattatcatcattatttttggcgtaattagttcaccatttgaattcttcatcagacgaactaattttatctcccaaatatttcagatctttttttatcatggtatgacaggctttatcggggcaatcctgatactagcagtcatctggttgacgctatttgtggtcattgtattcttcgtttggttaaaagcaaaaatggacagctgggataaccattaaagtttcataattaattttaatgtcgcctcaaccgcttgctcgttaatctggtcaccctcctacaaacggtctcgaatattttcggtcatcattcttcatgatgccgcggatccggccttcagaacatttgaatcgattaataattttcgaatcacatgccataaccaaattcttttctttaatgttcaattcgctcagggtaggctgccgaataaacaagaaaggcaccatccaaatttttcactttaaatccattatttttaagaattcgctcggccaagtaactccgctgaccacttcgacaactcacaataatcaatcggtctttaggaatttcagccaaatgatcgcgtagatcatctaacgggatattggttgaacctggtaatttgccatcacgcttaagctcaccaggggttcgaacatcaatgagataagcgccatccttaattgcgccttccagttgatcaaattgcaaattatccgacaatccttcaaccaagttactggcagcataaccaatcatattaacaggatctttagctgacccaaatggtggcgcataacttaattcgaattccggtaaatcaaaaaccgtcatgccggatttgattgctaccgagagaatatcaatttgcttatcaacgctcttctcaccaacagcttgagcaccaagcaactttccggtttgcggttcaaacaatagtttcattgatagtggcttccctccgggataaaaggcagcatggttttgaccggttgtatggactgcttgataattaaccccagcccgttttaactgagcaacatttaaacctgtggatgctgctgcaacatcaaacgccctaacaatcgcggttccaataccaccacgattttcccggggtaatcccataatcacgtcagctacctcacgcccttgacgattggcaggagaagctaatggaatggatactaattgccctgtcagcaattgtttcaccagaattgcatccccaaccgcataaacatccggttgggacgtctgataatgtttgtcaacaatgatcccacctaactcacctgtttttatcccagccgcttgggccagtgcagtatttggtcgaacaccaacagccgaaataaccaggtcagccttaatctggctgccatcgttcaaagttaattggtggcgatcaattttatcaatctgagtgtttaacttcagcgtaacgctatgctcactcaactcatgcgaaatcaacgcagccatttcagggtccataaatggcagtacttgagacccggcatcaattaacatcacactaagtccccgtttaatcaggctttctgctacctcaatgccaatcgatcccgcgccaataattgcaacacgcgtgggtgcttgcgataattgcaccattattttatcaacatccggaatactgcgcagggcataaacatagtctgctgatcccattccaggaatatttggcttatcggcaactgaacccggtgacaaaatcaatttatcataagttatggtctttgataggccatggtgcacagctgtgatctggtgattatcagagttaatttcagtaacagtcgtttcagttcgaacgtcgattttaaatcgttttttaagctgtcggggtgattgaacaattaaatcctctcgattagcaatttcaccggaaagataatacggcaaaccacaatttgcgaacgaaacatatggtcctttatccaaaacaatgatttcagtctcttctgaaagtcgacgtaatcgagcggcggcagacataccaccggcaaccccaccaataatgacaattcgcatttaataacctcctatactagaaatcggatcgttccaagcgcttaccccacctttaacattcacaacatggcaaccgctggtcataactaagttggcggcccgcatacttcgcgcaccggaacgacacatcaaatacccaagctggggatcaggcggtttaattttaacggtcaactcagacaatggcacgttaattgtaccagaaatgtgatccagctggaattccattggttcgcgaacatcaataacaattagatcctctttaaatcaatcgtttcctaattgggttatgttaacaaaatttatttttaaagatcaaaagcgcctccttaactttaaacatccccatagggtatcggttctcgttcgggataacgctttttactattcctgtaaattttcttctaagcaccacgacacacgggtttaacaaactcctcgaaaattattctccggctgcccgctttctattaaacagctgaaatgacttgtttacccaagataagttcatcgtgaatttcaatatgattattaccaattaacggaatctccggcttttgccgacgtgctaaatcaacagcatcgggaatcacttttttaaaccgatagccgcgatgctgataaaaagtcatcgcttggaggttatcgttagtcgttgttaccagcacctgggaaatttgatggttaattgcagttgtttcgacaccctgcaacaataacgaaccaatgccacgcccctcaagaaggctatcaaggctaataatttcaacttctgatactcgttttacatatgtaaccagaccaactatttgttcttccgaaaaagccacaaatccgtccagatgatcaatgtcatattcgccggaagacacaatcatcttgtcagtcaaccacttttttgtaaaaaaatgatgaacccgttgtcggcaatgcctaatgttctgaattattaattgcattctccatcttcccttcccaaccaaaacaccttagttctgaatctcttgtacaacaccgacatctagtattaacgttaaagcaacaattataatgatacgaattaaatccgtttcttgaaaattctgattgacaatcgccataattggatcaaccaataagataagtgccccaacatttaaaagaccaaaaatgagtgcataaaataaccgcttaaaggtcataccatcaccattcctccatttttaaccagacgcttctatatcggatgccaaacgccctaagttatccaatcattctataatcaaaaaccacaaaccatctttattttcttgattgtcaccaccttatcaataaacttccgtttgaacaagcaacaattgttttacatcatcattttatagcccactctatggtttctggtttccaatccagttttcgatgtcatatgagtttgaactgtaacgcacatgctgattaatgcaccattcacggcttttgcaaatagcctttgcaaacacaaaaaaggccaaaacaaatgttcaacttgttttgacctcttgaattcaaacgtctcatttactcaacgttttgctattcaactacttgtgacttctttgtgctttattttccttaataatctttaatgcccgtttacgtaccttaatacttgggctcttaagacgacgataagcactacctaaatcttgtttttccataataagtctcctcatgaaagaaatatcacattcctgataatctgtaacgtcaatcagtcttaactaaacgaaagataccacgactaccaacttgctttgtgaacacccgggatttggcctaagtgagcatattttctaaaattcaatcgtgacatatcgaatttacgcatataaccacgtggccgcccatcgatatgatcacggcgacgtaaacgaattggattcgaatcttttggtaacctggctaaagcttcgtagttgtgttccttttttaattctcttctcaaatcagcatactgtgcaattaacttttgctgcttttcatactttacaatttttgatttttttgccattattcgatctcccttacttcgtttctctaaaaagtgctttacgtcttagctttggcgaatacttttttaattccaatcgatccggattatttcgaatattcttactcgttaaataaattcgttcgccagtttcaacacattctaaaacaacatgttttcgcatattaatttttcctttctaaaatcaagtcttaaaattatagatcatttatttttgcttaaatagtagcggttactatttattatggatattccgttccattttgtcaaggataaagatggttttatctctggacagattatggctaaaactagaaggacaaacatcaatctctgttcgaaataagaccagaaaaaaagcagattcaccagtcaatccggttaaatctgctttacttattaataattaatggtcactaatctgaaattcggcttttttcgataaacagtatttcgatcatatagataaatatagttcttactaattttctttacattataagtataatgttcactgtttgaagcgatcccacgataatcctgattagttgaatacgtccatccggcaattcgataagcatcgttacctaatgacttatattttacatacgtcagtccgtatgggtcgttcttatagtaagcctgtagattatttgagtaaactaacgtattcattcccgtatgattttgccaataggttatgtattgtttgggagaatccgtaacaaggtaccaagtcccgcgtagtgcttttggagttcctgaatgataagtacttgccttaactggtgttacagtagtcaagcctaacccaattcctaaagttacaaccgccaacgatattttaaaaaaacgcaacgataacacttcctcaatactaatttaatattttacacataaatatattttactcagcttagttaacagtgtcaacgtaaatttatgattttactcataatattttcatcttatcctaaccatatacttatgattagtaagcacaaaataagtaacctatcttggccactaactatcaccgaaatttttctcagaataatcgttcctcaaacaacataaacaccattttggatttattttttctttatggataattaaaaagccgagcaggttttaccctgatctcagcttcagattagttcaatacgatttttggctatttagtttctttaaccactaattatttgtttctacccaattttgtaataaatagatacttccgactgactccaagagaacaacgaatgcaacgaaagcgtctgctgtataggcgtaaagatacgaatctggattgccaaattgaccaataaaattaccaactgtgttggataaaatactaagaacatataccagcccaataatgacgaccacatataaaataaatcgaacgatcttttgacgattatccggtaagaatgaaatgattgctgttgtaatcatgtgaatcagagtaatggatgtccaaaacaagatagtgaagaataaaatcgcaatcaacactgaaacaactccccaaaatgtcctcattgagaacacagatacgctatcatccataaccactttattaagcattaacgtaacttgtttcaagtttaaagccgaaccaacagcgaatagaaggatttgaaaaacaccaagatagacgatccccaatatcgacgaaataagatttgcggtatagaggtttgtatcattagtcggaatcaatcgatacgaatcgctgacaaatacatgttcactatttcttgatagtaaaacgaatgccaccatgaacgcgacaaccgaccaaccaagaataattgaaagggaatcaatcgcagtcaaactcccttgatatatcgcccagaagattgacaaaataaccgcaatcagatctaaaacaatcacatgattaacaatttgaaccttttgcttggataatatcttagttactgatgaaaaactcgtcattcttctcactcctcccgataggcattttcataatattcttcaatgccttcacgatacttttcacgaatctcttcggtgctcttctgtgcatacaccgttttatccttaataatcacaatttcatcgagaatactggcaatttccgacacataatgatcactcactagaataacggcatcgtcacttttccatttaataatactgtcaataatcttttttcgcgtcatactatcaatgccgccaaacggctcatccaataaataaacctgcgtttcacgtgaaagtgttaacccgataatcaatttttcacgcatcccttttgataacgccgataacttcagaccttcgtcgatttgcaaaaagccagccatttcgttatatttatcagttgaaaaatccggataaacgtcttgataaaaactaataattttctcaattttgatgttaggattaaacccatttaactgttcactaaaactgactctcgattttttagccgtaattttttgctgattatcaacagtaatctctcctttagagcccttggcaactccagcaattaaccgcatcagtgttgttttaccagcaccatttgctcccaaaaggcccacaattttaccctgttgaattgttaaattaacattttcgaggatcttttttaaatttttgctatagcttaaatttgcaatttcaatcgcatttgtcatgatttctttttcctccgatcttcaatatactgattcagatattcgataatttcttgatcgctcacatttagctgatgcaaattattgtaggcatcgcttaaatattcgtcgattaatcgtcttcttaaatcatcaatctttgtttcatcttcagtcacaaaatttcctttaccacgttttgattcaattactttttcaacaatcagttcacttaacgctcgttgaattgtattcacattgacggttaaatcgacggccagttgacgaactgccggtaattgttcacctaattttaagttaccgacaataatttctcggtaaataaagttcttgatttggtagtaaataggtattttgtcgtcatattgcatttttccgcctcctcggtgtcatactttactattacaatataacaggaaacctaaaaatatacaagcaacccgaccaacaatctcctgattaacaaaagatagtgattcaaagttgtatgcaatccttccccccaaaaaaatgtttcccattaaaacaaacacccattttcaagaaagcagaatgagacctgtctctctacacaaaaagactggagcaaacgtcacttgcctcagccctttatatgaatattattagatacaacaagaattgatcgggactaccttgccgccaatactgatagattatagtaggtagacaatgattaaccaggtaatgagacccccagtcaataaaccgcctaacgttgcaatgacagtcttgacaattgtcgaggtcgtactgggttttggcacccggctaactggtcgatcattgatataattgaggatttgtttaaacgttcgcagctgcagtgatcgcgtgagtttaacgtaaaaataaatcataataaccccaatcgttgtaaacgtcccaaccagcatgcatgcaatcccaattgggatccatctaatgctggcaaacgcaaggtagttcaaaatgattgaggttgctatcccaatcattaaccaacgaattttcagctgggttaatttatcttccatctttttgacatcctcctttactaagtcatcaacagtgacgtgataaagctcagctaggagtaacaaactctgaatatctggataggtcttgcccgtttcccaattagagattgtttgtctggaaacatgcatttttaacgccagctcttcttgactaagtcgattatgctgccgatagctaattagttttttaccaatattcatcatttattccctcctgagttacctttacaatactgactatggcattaatcgtctgtcaaaagcgcttgtcattacttataaaatcattaatcatcaagcctcacagcaaaccagttcacaaaccagtttgcgataattggaaactcatattatggttcactttaatctggtttttcattttactttaccatatgctagtgttcgttgcttggcaactagtcttcttcacattattctgatcgtaaaggagatgagtaaaatgaaagcatggtggttaactaatggcattgaagcgttgatttttatcacgctaatttcgtttattctacttagaaatgttgatgcaaccggtacggttcaaacaccgattgttaaactaatcaacctgttggttcttcttccagtcttaattgttgctgtatgtattcaaatgatttggctgcatcgtataaaaaaacgccgcagttaataaaatgtgtggcctagagactgctatcaagcgatgtttaaaataatttgctcgtcaacctggcgtcgttggggttacgttaaatgcataaatacgaggagtgatcaatatgcatttaacaattgaaaatatcagtctgcaatatgataagacacccgttttgactaaccttaacgcggatttagttagtggtgagttaattggtctcttgggacccaacggtgctggtaaaacgtccctgctaaaaatactcacgaccctccagtctcccaataaaggtgatattttactagatgggaagagtatcattaagcgacctaaattaattcaaaaagttctcggttatctgccacaacaaattccctattttcctaatttgactgctgttgaatatttgaactacgttgctgtcatgaagggggtggctaccaatcagattggttcgcagataaaatcactattagacaggcttcatttatcaaaaaccggtcataaaaaattgaaagacttctcaggcggtatgcgtcaacgggtgggaattgcagctacattattgaataatccgccaattatcattgcagatgaaccaaccgccggtcttgatccccaagaacgggtgtcacttcggaatctgcttgctgaactcgcaaatgaccatctggttttagtttcaactcatattgtttcagatattgaagccgttgcaaatcaaattttgctcttacaaagtggccaattcctgtaccgtgggacgccgaccaatttaatgacaaaaagtaacggctatgtatgggaatatccattgccccacagcaagccatcactaattgagtcaaatagttcattaattcaacgttcaaacggcatccaggttcgcgtactttcaaagacatcaccacaagcatctgcacaatctgtcacccccaccctggaagacgcttgtctggggatctttagcggggtgattccattatgaaattcatctttatggctacctttcatgagaagacacgccggttatcgtttacagcactatgcatgagtttactatttgcgacaaccctcatcattcctcgagaatccggtaccatgcgtgccttaatcattaatcctaatcagtacagtcaggcaaataatgcaacatgggtctcaatcagtatcggactgattatggggctcttccttcccctgattagtgccattttcctgcgaaacaccattcatttggatcgtagtatgggcacaatgtcacttttcttaaccactaggtttccgaaaggcaaatatgttttcggaaagtttttgtgcaacatttgtatttcactgatcctctggttaattattttactgactgcttacgtcgaaacagttttaaaatatgggctcgcagcgattaatcttgaacagtttatcttaccatttctaatcttaattcccggattggttttcgtttcagcagtaaccttagcaaccgaagtcattcctggtttacgtggcaaattagggacgattgccctatcagttggcataacctttctttacaccacgaccgctaattaccagacaactcctggtttttttcaacggctactcaatatttccggatccacttatttgatcaccaacatcaaacaggcaattttagcttcctctaataatccgctatccacactgagggtaattggcagcacaaccagccgatataccggcaaccaaaacttggtatttccaccactacaactgacgattattgatctgcaaaatttggggttactacttctaatgagtctgattctcgttagtagattacccggattgattgagaagcggcccctaatccacaccactctgaatcaatttcttgaggatcattcaacgatcagccttcccattcatgttttaaagttaagccgttttcgattatcaatccggctcctcacagcaccaattgccactatctggctttggttaatctgctttatttggctctggagctggtttgcaacctatgatcagctgactcacattacctttccattgctatacctcgcggcaactccaatcgtttcatcttttggtgcaagtgaaactcaagaaaacgtttatcaatggctagctacttttcaaaacgggcaacttcggcagaccctgtggagttgtacagttgaaatcgtattttcattaggattaattctgccgttattaatcaggtcgcctagcgtcagccgattaccgctcagcttctgggccattttgctacccttattagctcagttaatcggcagaacatcgaaaagtacgcgtttaacccaaacgatcatcattattttcttttatttatatttaaatggcgcaccattactcccattcggaaataacaaccataatctgttaacactgatttacgccactctgacaataattgtgtttactattttagctttgagtcctaaaataaaagaaacattgtaacgattgggagtgagatctttggcagaactagtgggaaaacgcattaaacaaaaacgattagaaaagggattaacccaagcagaagttgccgataaactgtatgttacaagacaaaccgtcgcttattgggaaagcgatcagcacttaccatctttatcagtcctgagtgaattagctactttctatgatgtctctatcagctactttttaggtgaaagtatccaaacaactcacaaattcaacttttttgcactcgtcggtagtttcctgttaaatctcattttgattccaaccgtttttctcgttagtttggcaacactggtttttgcatggcttatggatcttatctgcattcctgtccccattattatttttattgaaagccaaattggcgttcatcagttcgcatggtggcgaatcggggttggctgggggatatttgtcgctgccgcaattggatttccaattctttggctactcactaaacaattcattaagttccttgagcaatatgttaagtacaccattgaatcaattacctaccaaaaggttattagaatcaattagtctaacatctaaacccagatactgttaagcaataaattatctttctatgagctattttgttgagtttcattaaccatcccttataataaaaatgagtcctgtaaccgttttcgttagtgccatccaagggggatttacattatgacaattaaaaaagtaacggtagctggtagtggtgttctaggaagccagattgcttttcaaacagcctttaagggatttccagtaactatctatgatatcaatcaagccgcattggataaggccaaggaccgcgttaagagtttacgccatgcttatcggcgtgatatagcggcaagcgatgcaaaatttgacgaaggtatttcgcgaatcgcatttacatttgacttggcaaaggcagtttctgatgctgacctagtcatcgaagccatcccggaacgacctgatattaagcgtgacttttataaaaaaatcagtaccctagcgcctaagaatgccatatttacgagtaattcttcaacattggttcccagtatgtttgccaaagatactggtcggccaaaacaatttttaaatatgcatttcgcaaaccaagtttggttaaataataccgccgaaattatggggtcacccgaaaccgatcccactatctatcaagaaatcgttcagtttgcgcgagacattggtatggttccgattcaactcaagaaagaacagcccggctatattcttaactcattattaatcccatttctaacggcaggtcaagaactctgggttaagggcgttgccgatccacacatgattgatcgaacatggatgattgcaaccggagcgccattcggaccgtttgggattcttgatgcagtcggaattcgaaccgcttacaatattttattggcggctgaaaaggaacatcccgatgctggtctcgaaacaattggtgccaaattaaaagaattattagatgaaggtaaattaggtatggaatcaggcgaaggtttttataagtacccaaatccggaatttaagaatcctgaatttttgaagggttgatccagctcaaataaccagaaactttttccatattttattttagcaattacaaaagcggacgaagtaaaatcgattttttactcgtccgcttttgttatgggtactattattctcagataaacaatgaggctgagacaataatcgttttacccagtctcgggtggtgtaaacacgattgttaccaagcaatagtgcttttggttgccacattgataactcgattctaatcgctctcagagccatctttaaatgtaaataatttagcaaagaaccaaaagttaattaagccaataaacaaaattaacccaaacgcaaactggctgccaatcgccacattctgcgaacttgaaagatgcggtaatttgatcgatgtcataagaaccgcaatgattgttgtcccgatagaaccagcaacctgttgaccagtgctgtataacgcatttgcgtcatttcgaacaggtgatgccagcttttttaagccatacgccatactatttccaaatgccattgaacgtcccatcgcaaatacagtgtacacaattgtgattgccaacacactcaagcttctaccaaagaatgcaaagtacagggctgtaattgtaaataaaaagtttccaagatacagtggcaatttaccaccgtaacgatcaagcatccacccgtaaatcggctggccaaaaccattcagtaaacttccagggagtaaaattaagccacccataaacgaactggcgtgatcaaccatttggacataatttggtagaagaaaattaataccaatattggataactgtaacaagatgtaaggcaagaaactgtatacaaaacttggatgcttgaagaccgataatttaaataacgccttgtgactatacttggatcgccagccaaatagtgcaaacatgacaaccgccaaaattaaatacccaataaaccggattggtccacccggctcacccacaatattaagccccataatcaggctgactagcccaactgatagcaatgcaaaccgcaaccaatcaaaatcatatttctgcgtcggtgtgtattgtttaatcgcctgtaagccaaggaacagtaaaataatcgttaatggtaatgttgtccaaaaaatcattcgccagctggcaatataaaccattagaccaccaaaagccggtccaatcgctggggaaactaaaataatcaggttagccatccccatatatgtaccaagtcgatgaacaggaacagtatccaaaataatgttaatcattaacggacctgataatccaacacatcctgcctgaatcaatcgaccgaccagcaggatccaatagttaagtgccaatccacaaataatatcaccggtaatgaataacagtgcggcggaaacaaataactgtttgtttgtaaatcgccgttttaagaaggcagaggtaatcatcaacaacgccacagtcaacagataaccggttgttacccactgaactgtcgttagtgaaacatcaaactgcttcataagagtcggaaacgtaacattcatcgaagtttccgttaggacgcccataaatgtcatcaaggcaactaatgtaatcgcataaaacggatgcttagcagctggcctttcagctgaattttctgatgccaataaaataccccctcaaattgaatctatcatataaatgcgcatttatacatgataaaccccaatgtaaattcaaaacaagggtattttactaaaaacttgaaaactggcaggataacataagaaattcagtttttggaatcagttcctattaaattgaccaaccaaaaacgagatcagaagaagtgacttttcgttctgatctcgttttgattctacgatcgttatcatttgaaggataaggacaaacttttcctgccttcatatgttctagtcaatggtccagtcatcactatttagcagaagatggtttctcccgatgcaagacctgtgaacgttccaacattttatcaaccgcgcggacacaaacagccccaaaaaatgtcacagaagctaaccgaactaagaatagcagtaggatcatcggccatgcatacttgacgtagcccaacctgaacagctcatagccaaacgctacaaccgttgtggtcactgccgatgtcagcaaacttgcccaaccccaactcttataacgccatagggtaaaaccaagttcactaccaattccctgaacaattccagataatagagcagctgccccaaacgtaccaccaaacaatacttcggcagcggcacctaaaacctcaccaattagtgcggatcctggtactcgggtcagataaatcgccagaggacctgccataatccacaacccaaacaacgcttcattggcaaatggtccaatcgcaaccgccaaaaagttatataagtagtctgttccaacaaaaatggcaccaaaaatgattgcaattaaggcaattaaaataacgtcttgcaaatgaaatttccgcttcataagataattcctcctaaatacctaattgatacgttcttctcgatttgactcatttgtttcgaaaaataaaatgccccctctgtcaaaattagcgtactgagccgctaaaatcacaaagggggctgtcaaaaaatgctcttgatcgtaatcaagagcgttaacaaccgtgtaagtggatcgctttccctacgcgagttctaactctcaggttcaaagggttcagttgattattcaaccatctcagcctatttaaggaaggctcccctagctgcattaagattctcacaaaaccgattcaattgcaagataaaaatgacctttatggtcgatcaaccactttaaacacttcgcaaacacatggtatattataggaaaaggtgccattattttgcgcgtactcgcgtttaaaaaacgcttcatgaacttgacgccagtaccataatgatttatccccttcgccttcatgataagcatgctcccaggatacccacttaaaaggaaggatctcgacaacttcagttcttgttatgcaaactggctgtccttcccaatttaaaataatattataatcaccaacttgagggatcggctcatccggttcgtacaactcgtaagctgaagtcgttgcagtcttcaccccggttacaacaagatcagctaatttgtagcgaagctcgcgaggaagctcggcacttcagtaccgaaaggaaagcgccttgtgctttctggtttccgagcgggtttttaaattaaaaatacttgtatatgcaaaataaataatggtataatatgcttatataatagtaattaggtgtgttgatgatgcaaagcaaatctaaagatttacattatgcgcgaaccagtgtctactcgctacaatatcatctaattatcgttactaaatatcgacgtggtgttttagttgggccagttaagcaggaattggaagaactacttcgcagcttagccagtcaatttggtatgaagattgagaaaatagaaattatgcctgatcatgttcacctgttagttgatgcagttcctaagtactcgatttcgtcaattatgaaagggttaaaaggggttactgctcggatgctatttatgcaccatccggaaattaaaaataagctttggggtggacacctgtggcaaccaagttactttgccgtaactgttagtgagcgttcagaagagcaaattagagaatacattcggcaccaaaaaccaaacccagccaaggaaagtaaggataatgatcaaattacctaaaaaaactgaatacttacgggtgcgtcgctatcgtttggttcctacttcgcagatgattgcccgttattgcaaaaaccttgaggttcttaacaaagcgcatcaatatgccgttaagtatctcgagaaaacttatggttgtaagcacttagggcgtccctatccatcaacaaagaaggctaagatttatgtcatcaaagataaaattttgcccggcttcttacacgatgtttatgggatcgacaagtgggatggtaaggtcgtcccaattcactcacaagcgttacgtgatgagtttttggttactgtgatgactaatttcggtgagtaccgtaaggtactcaaaaaagctgccaagatgaccgataaagagaagaacgcctaccggagcaattgtgatcgaaacaatccacagcaccggtcttggtatcgcaaagggtcactatcttatcttcgcagtggtgctagtcataaaaccgttgccttgcctgataacggtcaaattgaggtgcgatcaccgcactggattaagattcaagattatggcgaaattcaagtggttgagaatattaagcacttagcaacggctaagattacgacctcgaaaatcaaacgcaaagatgatgggacttacgaactgcaattagtactcaaagaccaaattgaacggaagaagcccattagcatgattggtgctgactggaatatgaaggacaacaaggtctttcacacttccgatgatgagaaaatctatctgggttatcttaaactcactaaccggcgtctgattaatgtcggtgctaaggcagatgaatacgaaacaatcattaacggactcaagcgtcgccgggctaaaaaggaaaaacaccttagcaccgatagtcaacaacttgagagattgagcattcaaatccgttactattctgcccgacgggtaggcttacttacggaacggtatcgccagattgcccggcagatgtttgatcattacgatttaatcgccattgagcagttagacgctaaggaaatgcgaaaagaaaaccgaaagtggtcaaaagccgctaaccatggtaagaatcggaaactggccaaagtcaaaccttacgaaatatccttactgctcaaacaagtagctgaccgtgaaggaaagacgctcttgaaagttgatagttacaagaccagccaagttgaattcggcactcagtaccaggagaaacacgatccaaatggcgaacgccaatgggtgtctaagtataccggaaagttaattgatcgtgatttaaacgccagtcgcaatattttgacttgggcgttagagcccaaaaaacacattaagtatttggaacggcaagcaaaaattaaagtcgcaaaaagggctggtatcactaaagacaaattgcctaaggcaattccggccaaggcattagtaacaatgaattagttgatttgatcaacgggcggggcagaacctagccgtccttaaggctccaagagttactgttggcgtatcaccctgagcgtgcaaaacgggtgcgaaacagtcattaagatctaattgatctcagcggcgttagccgttgcatagcttaaacgttttctaagatcgagaggcgcttagcagccctttgatccagaagctcggtcatttatgaccgagtagttcacccgcatcctgcttattatcaccaaataaccatgcatcatgaggctgggacaatagtcatttatcccagcctctgttcgtgtaaacacgattgttaccgagcgaaaacgcgggacaaaagggctctttccatactttagtgaaattttgatgatgatttttaaacttcaaactgaaaacaaaataacccggccagttcaaacaattttcaactgatttaattttgagttatcacttcaccatggaaagagccgacaaaaggcaacttccggccgtgtaaccgaattatccaaatattcaagttctgaatattcggataattcaattgcactctggaagttaaacgccttttgtcccgctctgtttttaacaaattgattccagtaactcgttacattttctgtcattgttttactctccagttcaataaattaacctcactaccaaactgcaccaatttttattcctaagtatcatattcttaaagcgcatgaatatccagaaagcaggtaatcgaaaatgactttatctatcaaaactcaactgattggatccaagaaacaccctaaagttggctttaaattcactccgaaaatgatgacagaacttggtcttcacaatgttcgccgagttacttttcacctaaaaggacaacaactcattatgattccaatccgtacccgtaacaatcgcgaacgagtccatggtatccgaaacgtatcccaggcacgaaggcttgaaaatgctcaaaagaatctgtaactgggagtaagcattaaacatattttaaagtaatttttgattcctctgatcatgataaaacaattaaaaagcagttcaattccgtatcccaataaagtggatacgcgaattaaactgcttattcttcgaaaactggttaatcttttgaaaattctctaatttcatttctatcattaattttcttttttcaccattatttatatgtgtcaaacagacttaactgcttgcggatgatctgtcccagaccaacaatatgtgacgattaacttaatgaacgaatcattcttgctaaagcccggaatcaccacccttactagttagtttgcttacacttgaacgccaattgtttctttaatcgcagttcctaaacgtttaataccggttttaatttgatcttcggacatattggaatagtttaatctaaaggttcctggaactactttatccgggtaaaacggctcacctggtacaaaagcaacatcgtgtttaatgcaagtatcaaataattccttggtatcgatatcacccggcacctctacccaaataaacaatccaccttctggatgactataattaaccccttttgggaagaaggtctcaatggccgccatcattacccgttctcgttgccgataaaccttcttaatcttgttaatgtgttcgttaatatcatattcttccataaatttggcaacaatatgctgcgttaagttatcagaatgaacatcagccgattgcttcatcaacgtacattttttaatgaaattcttttcggcaacaatccatcctaatcgcaaacctggtgctaaaattttggagaaggtgctgagatagatcacacgttcattacgatcataaaacttgatcggctcgatatcatccccggcaaacctaatcgcaccatatgggtcatcctccataatcataatatcggctctatcggcaatctcaaccattttctcacgacgatcagctgtcatcgttcgaccagttgggttctgaaaattagggattgtgtaaatgaatttagtatttggattatcggcaaccgccttttccaaagcgtccatcctcatcccgttttcatccatttcaacaccgacaatgtgggcaccgtaactacgaaaaacgtctaatgcacagaggtaggttggtttttcaacaatgacggtatcaccgggattgacaaacatcttggcaactaagtcaattgattgttgtgaaccggtagtaatcatcacattttcaatctgcgtatcaaccccttcacgtcccattcgcttaacgatctgttggcgtaatccaggatggccaatggcggcactatactgtaatgcttgccggccgctttgatcgaagacttcattggttaccttttttaaagccgcaattgggaataattccggagctggtaatccacctgcaaaggaaatcacacttggactccccgccactttcaaaatattgccaaccggatcttcatcactttcgggaactctttgtgaatattggtatgtcatacgcgaaccccttccttttttgcatcagctacattagtttgtggtttgtgatattttctcatcatttctgccatatgaacctcatgaacaacgaactcatgagttcggcaaacgtaatcgtgttcacgaccaactttagcaatgtacccgttaatataatcaacttcagttggacgaccttttgagaagtcttgatacattgatggataatggtatttatattctttacttacggtgatgactgaatcaacttgctcttgacgggttggaattaagtaaataccagcccgctcgcaagcatcataagcttcatcaaataattgccgagacatttcgcgaacgccactatactcaataaattgacccatctgcatttcaaacatcgtacaaagtgtattggtcacggcattgaaaacaacctttgacatgcacatgcctttccattcatccgcaaagactggtcctaatttggcttccttaaaatcattaaaaatagcttgagtggtggcatctggtttttcatttgtgtagcgtgccatatgcatgacttcatcaccttgggctcccataaagtcaatgttagcgggaccatccattcgtgtcgcaatcattgcggttccacagatgatatggctttctggaaaatacttggcgatcttttcaaaatgacccattccgttcattgcggaaaagacatattgatcttcatggaaaataccagctttactatcacgttccatttcctcagctaactgcatctgttttttaaaaataatccagacatccggatgacctttgtattcttctggataaaaaatattaacagggacaatccgacgattttgatgatcgcgggcaactgaaacaccgccttggctgcgaatcttttcaacattaggttcccaagtatcgataaaatcaacatcgacgccagcgttctcctgtaacattactccgtaccttactcccattgctcctgcaccaattacaccgtatttcataatgcccaactccttcttattttttattaaatacaactaaaaaacgccctttggttgtcaaaaccaaagggcgttaagttcaacgcggtaccaccttaatttgaattactctcacaagtaactccttagcacgtacggagaaaaagtaactgtcattttaaaatgatctcgttttttcctcgatacgccgcacattaatgggtgccaccatttcacctcgaaaagtgaacttgtcgagttcgatctttcaaataatagtttcaatgccttcccaccaaccgacactcgcttagtgaagctattatcctaatccatcggaccaaatcaattagtcgtatttgaaatgttgaatgaagtgtagtccacgacctagatacatgtcaacctcaaatttaaaatttcattagcttgatctcatcgaaatgccattttgtcaacgattactcattaaaaaatttttttgaagtttattacttttacaggttcatcattttgggttcagctgctgacagccatattaacgaacaatttgaatatacttagcattaccggtaatgtaaccaccagcaattcggtaacgcaacgtgccatgtttggtgacactattggcctgtgaataatcaaagttgtaaactttaaacacttttttggaattctgcttatagtgctgattacgtttcgttagattgacattatgatatcgattaaccgctgttttagcttttacatattttggataatgatgacgtcccatgttaactaactttcgattaccagtgacatactgaccgtttgagaggacatagcgagtcgtaagattgtgtcggacaatccctttaacttttaagatcatcccctgcttgtaatttctgatcttaccagtcagattagccttcgtataaccattaacaccacgcgggttgataactgtaatggctgcatgttttccaagataataaaccggccggacatacttccaactggcggtaatataaccagttttatgacgattctttgttaaatgattgacatcccgaacctgatatcgtagcttaccgtcagccgtccgtgaataaccagttacaacaaacattggccgataaacacgcggcttcttaacataccaagcttgtctcgtattttttgaaaagttttcagtccggtataacccaatcttcttgattgaatagataacttcatttttcttggcaacatagtcttgattgttggtttgcgaacctggttttctatctggatcattagttgaaccatccgttttaggttctgtcgcctgtcccggcttttgtggttcggtgactgtcccagaaccagcagagcttggcggcgttaccggtggcgttgatcctccgttgccatctcctgtgctaacctgttttttgtaaagagcgatgatggtttgatcgctttcagtaaatggaattgtatctgtgtttgccggtaatttttcgacttttccattcacgatcctagccaggccatcgaattcgtaattcggaaagttctttgtaatatcggaaacctttaacggattattaaagtctccctgtttactatcactgacaggttcgctgccatttttaaattgaacaaacttaccattttcatccagtgagccatagtcaactttaatcgtgctttgtttaacaaaaacaaccgttaagttttgagtattctcagaaatggttcctgtttgtccaaccttatcggcccttccatttttttcattaaaatcagaaacttggccagtaccgttgaaaacaccataaaccttatagccgaggccggccaaacgatttagttggtagtcagtagtgctatcagtttgaatgttaaacgacgtgcctaccgttcctgaaagaactgaagaaggtgctagtgttaactggcttttgtcattcctcaacaattgaaaattcacattaacattcccaatgccatctttaatttggtaaggaaccataatccacccattataatccgaactcggatccttccaaagcgttgaaaacgcgccatacatatttgaccgatcgggcagcatgttcgaccaagtaatcgtcgtagaatcaacattgccgccatctgatgtacttggataaagtcgggcataatcctctttattcgcattatatacttgaatcggcagattatttgcggcaagatttttaataataaatgatggggtcgtatatgaagctgtcccagtcctgaaagtaaccggcgatagtagaatatgttggttactaaatcccttggttagatccagagccggattttgattagtagctaatggtgataaatcggatatctgattgtaagccaaatcaattttaaccagatcaggcttgttggcaagcgccgcaacatcactaatcgaaaaatagttaaccgaaatatctgttaatttatttagttttgttaaagcactaatgtcccataaattaccattttgagtggcttcaccatatgcgatggcgctggccgtcatgttcggatgcaaataaacactctgcagattagtcgcatattgcaaaccttccaatgtactcatcgacatcattgcctgatagtaaattgttgcctgctgcttaccgccaaccgttgtcagctgagcatcactgtcacttttaagggtagtcattttagctaaatcattcttagtaaaattatctcgaaaagtagtgaggtctttataatctttcgtgtaatttgtcagataaacaaaaatctgtgtgccataatccggcatccattcatcaatatagttcttcttagttgttggatccaatcccttagcatccatcggaatattggcagcgtattccgcacctttccaagccttggcaccttgcaagttctcaaagggtttatgaatataagtgtactgaagcggacgttctttagtaatgttaaatttgttggttgcctttacctcattcgtcaaattaggaactgctagttggcttgcttggttcgctgcagtacttgtggctgtctgggccgactgctgatctgcggctgacaccggagatacggcaattgttccagtcattaacatcgaaagcgccacagttgcgtacatgaaccctcgtttaaaattcgatggcctcgtttgacgactacgattattttccgccttcatgatggtttcctccttacaattaacccgggaaactattttccactagaagtataacgtgtttatcggattaccgaaagcgattacactcgaattatcaaaaccctttattataagaaaacaagatcaaaattgacggcttgatcacaggaattcagtgccaaacagacgaattattatttcagttcattaaatttgtttattacgcaatatgacaggtatacttagtgacaaagaggggtttctgaggtgatcaaaatgcgattagtcattggaataataagtgcagcttcgttactattttgtattggtgcactgattctattggttataggtaataataaggctgcgttaatttctttagctatcggattaatcatgatgatagcaggatggttagcatctagtttaataaatcaacacgacaaaacaaaaaagagtaaataaaaagcttgagactatcttggaagaaggtttaattccacgcatatctcaagctttttcaattcaatgtggcacgtttaaaattaataccatatcaagatttttttaaataatgctataaccgacaacgatccttgctccagaactgtaagtaacgcacccacatgaagttaaaccgtatcgtacaaagaaatactgacatcactcgcagacaatgccagcggtaattccgtacattctaaaataactccctgaatatgatcgtaatctctcagttgcgcaacggttttcaagagatacactttgcttaacaacgcctaatttcaattcagaagaaatgatggcgtagatatgattaatctgctcgtcacttggaacgaccacttgaatgcggttttctgcaagtttatttttgtaaaagggttccttcattgtcattttggtcccaagtagtccaacctttgattgttgattgtgcttaattgcattagcagtcacatcgacgatactaattaaagggatcggcgacaaagtctgcaattgatcaaaaaccatgtgtggtgtgttggccgtcaatgcagcaacatccgcacctgatgcttgtaggttcttgatactagttaacagtttctgaattaaagtttccgtttgacctttcttttcaagttttgatatttgataaacatccaaactatcaatcacaatttcagggtatgattgtgggtgtcgtttctgatacttacttgttaattgacgataataatcaagcgtcgattcgggtcccatgccaccaactaaaccaatcctaaccattttagctgcctccaaataatgatttaaatcacatcacagcacgttttccagccgttcatattgatgttacagtatgttatggtagataattaattgatacgagagaattggaggaattcaaatgataataagaacggttcgcaaagaagactattcagatgtttccgatctaattagaattgccttttcaaaaacatcaaatggttatcgtggcgaatcagaactagtcgataagattcgccaagatcccacttaccgcaaaacattcgaggtcgtcgccgataatcacaaccgcattattggttatggcctcttaagcgaaattcaaattgaaaacaaaacgtcatcagcactgggattatgcttagcaccattggcagtggctcccgtaaatcaaaaatcgggaattggcggcgcaatcattaacgaactagataatcgagctgttagacgaggttatcggtttatttccgttttaggatggccggactattatccacggtttggctatcaaagggctagtcaatttaatattaagccaccctttccggttcctgatgaaacttacatgattaagccactggtaaaagatggcttaaaaggcattcatggaacagtaaaatatttaagcgcgtttgattaattacaactgagaattatctagccacattatcttaatctgcaggtaagccaaaagggtgtcatgtaaactttcattttgaaaagcttacatgacaccctttattttttgaaaataattaaattaaaccatcaagaattaaccatcgatcatttcatctagatgaccatcttcaacttttttgcctttaaattaacatcccgatatatcttggcaattgtccgttcgtagtcttcatttgatacaccaaatacgactttaatatcactgccttcttgaataaccaaatgaattttaatttggctgtcatccaaaagatccaaaattcttcccgcaatggccggccgtttactaagttggtaagaaacggcggcaaccagcgcaatgtttttctccagtttgacactatccaaatcacaatcattttccagcgcattgataataacatcgagtttatcagcaacctctgttcgacgagctagaaaactgaatgaatccgttccagagggaacatagtcaaaagaaacaccaaacttttgaatcactgaaaagatttttgccataatatccagccgtttatttaattgatatttactaactgaaatgacaacataatcctttttaccagcaattcccgtgattaattgattgggatcgctattaactgaatcaaccactaacgtgccatcctcttccggatgattggtattcaaaattgcaattggaatttgttgttctttgactggctgaatggcttcctcttgaaaaacactaattcccatatatgaaagttcttgcaactcttcataagttaattcgttaatctttcgcgaattattaataattcgtggatctgccatcttaatcccagaaacatcggtccagttttcatatagatcagcatcaaccagattagccataattgaaccggaaatatcaccgccaccacggggcataatacgaatttcaccatttttatcaacaccataaaaaccgggaaccacaatttgataaccagtagaaatgatcttattcagacgttgaattgaagctttataatcaatttgatcgccatcaaaaatcataaatcgggcagcatccacaaactgaaagcctaagaaatcagccattaatttcgcagtcaagtattcaccacgtgacactaagtaatcgtggctgcaattatgaattcgatcgctaatctttcgaagatcatcttcaatttcaaccgttaaaccaagttcatcacgaatttcaacaaatcgttttgcaacatgatcaaagattggctgataattttcatgagcatcccttaatctttcaatttcaattaatagatctgttaccttaattggctcgtcatcgcttttcccagccgcactaacaacaacgactcgacgatcatcgttagccttaacaattgcctgaacctttttaaactgaccggcatttgcaactgaactgccaccaaacttggctactttcattgagctgcacctccttttctatctggtaaactcgccataaaggctgttccatcttgcttaagtacttgtctcattaaccgatgcatctcaccaattggaatttggtgaatgacaaggtaatcaccgcggacacaaggatcaaatttggcaaacattttggaacaatcaatttctgaacgaacaatgtaattgctccgggtcaaatctgaccgatatttcaagttgctcataaattcgcgttttaaatgctctttatgttggaaaatatctaaaatatcttggatgaccgcattagcagttggcaattgtccagcgccctgccccataaactttaaattaccaattgtttcaccatgaagtgaaattaaattatagttatcggtcgtattagcttccaaagtatcaccatgataaagcgtcggctcaaccacgtaatcaaattcattgcctcgttgatgactcttccccattaacttaacggtaagccccttttgattaaaataggcaatatcatcaccggtaatattacgaatgccgaagattggcaactcgtcggtcggtttcacaaaaatatcataggcaatatcaacactgatacacaacttattagcaacgtccaatccatcgatatcggcacttggatcggcttcagcataaccaagttgttgagcttgaagcaaaacatcattgaatgacttgcccgtcttcttcatttgatcaagaataaaattacttgtcccattaaaaattccttgaatcttgttaacatcatcaactctaagtgcccgctctaacccttgaatccaaggaatgccgccaccgacactagactcgaagtaaaacttgacgccattatcagcagcaattttcgtaaattcgtccatataacgagcaatgaccgctttattagcagtaatgacgtgctttttatgcttcaacgcagcaagtatgtattgatgtgccggctcaatcccacccaacacttcaacgacgacatctaagtctttgtcgttaagaatctcatcaatatcatccgtcatctccggtaaatccggctttttatttttccttattaaaatatgttttacatggaggttttgggtttgtcgctttgccttctcaataattttataaacgccagtcccgaccgtgccaaaccctaatattgcaatgttcactgctcaaacctccaattttttattttgttcattgataataaacacttgttttttaactgaaaacagattatcataataatcacagaaatgcaaggagttaaagtcaatgaataaattttataccagcactagaaataactcagtaaaaatatcggctaaggatgcaattaaaaagggatttgctgacgataagggattatttgtttacccaaatctcggtaacactcaaattgatcttgataaattaataactttggattatcaagacattgccagggcggttcttacaaaattactgccagacttttcggctgccgaaattagcgaaagtgttgccaatgcttaccattcaagctttgactccgaaaagatcaccccagttgtcaacgtgaacaactttcatgttttggaactctttcatggcccaaccagcgctttcaaagacgttggcttacaattgcttccacaattaatgaaacatgttttaactgaaaataataaagttatgatcctaactgctacaagtggtgacaccggaaaagctgctcttgagggttttaaaaatcttaataatatgggtatcatcgttttctatcctaatggtggtgtcagcaaagttcaaaaactacaaatggttacaaccggtggcaacaataccaaagtggctgcaatcaagggaaactttgatgatgctcaaaccaatgttaaacgactttttaatgatcaatccttaaaacagcagcttggcaacgaggtcagcctatcaagcgccaactcaattaatatcggtcgattgattcctcaagttgtttactactttgactcttacaaacaactcgttaatgccgggtcaataaaagccggtgaccaagtcaacttcactgttccaaccggtaactttggtgatgtcttggcaggctattatgcaaaactccttggtttgcccgttaagaagtttgtggtcgcctgcaatgaaaacaatgtcttggccaacttcttcgagcatggtgtatatgatcggaatcggccattttaccaaacagttgcaccaagtatggacatccaagtttccagtaactttgagcggcttctttattacaagagtggcgaagatactgaatacgttaaacaactaatggatgatttggaagatagcggtaaatatcaggtttccaaagagattcttgataatattcaaaaagatttttattgtggttatagtactgatcaggaaattgagaatgccattgcaactgtttataacaaaaacggttatttaatggatccacacacagctgccggatataaagtaatgcgtgattatcaaaagagcgacaaacaaacgccaatgatcttactcagcactgccagtccatataaatttgttaacgcagtttctgatgcagtcttacctaaaactgctaatgatgttctacaggtaatgaaggatttggcagccaaaacccatgcaccaattccggagaacttgagaaaagtttgggagttaccaattaagcacgaaagcgttattgaaaaaagtgaaatgaaagactatgtccgccaaaaggttgaggaggtattttatgataaagattaaagttccagcaacaagtgcaaacgtcggcgttggttttgactgccttggcttggccgtgtcctattattcaacggttagcttcgaggaaagttcaactcatttagagatcacgggttgtccagaggaatttcgcaatgagaataacctcgtctaccaagcatttgttaagggttgcaacttcctcgacaaacccgtcccaaacgttaagattacaatcaatggtgatgttccggtggctcgcggacttggtagttcatcggtgtgtgttgttgctggactaaaggctgccagcgtttggtttgataaccaactttcggtcgatcaattgcttgtcctggcaactgaaatggaaggccatcctgacaacgttacaccagcaattcttggaagcttatgcgtttcttttttagatgaacgcaatcagccccaagtcattaaatataacgttaacgaaaacttgcactttgttgcactcattcctgattatcaggttagcactcacgaggcacgaaaggtcttgcctaaaacgctaagttatgctgacgctattcatcaagtgagccattgtgcagcaatgaccaaggcactcgaaattggtgacattcatatgattcacgaggcctgtgatgaccgaatgcatgaaccataccgagcaaaattaatccccgattatagccaagcaaaaaatatttgtgagcaattagggggtacaatgtacattagtggcagtggctcaacaatgatggctattacaaatgatgaagctgcagctaacgaaatcgtcacaaatgcaaaagctgcctttcctggctggaaaattcgtaaaatggcagttgattcaaatggcgtaacaagtgaggtaattgaacgtggaaaagtactacatcgttgatagttcgattttaccagagtcttttgataaagtaattcaggctcggcaactcttagaaagcggtaaagttaaacaagttagcgaagcggttaaagtagttggtatcagccgaggaacctattataaatataaagatttagtctttttgcctgaagaaaatatgatggatcgaaaggctgtcatttcattaatgttggagaatcagcgtgggattctatcgcgagttttaatggcaatttctgattctagtgccagcgttttaacaattaaccagaacattcccattcataacatcgcgagcatcgtgatttcattggatctaagtcatttaaccggaacagtagatgaccttttaaatcatctccaacaagttcaaggtaccagtaatgttcagctggtatccattgaataacaacagataacattacccaataatctcataattacattacaaacggggctggacaaaagtaattttgtccagccccgttttgtgtaatcacgattattaccgagcagaaaacgtgaggaaaaaatcgtacccgacactctggaagctaaggatttttgcctcactcttctgatgtagcttttatcgtaataatatgtgacctgtcacttcaatcaggagtaataatcatctgaacgatcatgtaaaccataattaaggttaatatgatccatactaatttccccagtggatgattaggattgattgttaatccaactccagaagatttaggaacaaacaagtttttcgaatcaccatgacaaaacgactttagcttcaaatagcttaacggaaacatcgcggtcacacataccattataaaaacaccaatccacttggactgctcatcagattttacaaacggtaaccatagaaggggagccagccctacagtcagcccaacaattagcaggcgatccagccaaacatcttttttccgcttattgattaatcgataatccttcttaacctgcttcatatactgctcatcaccctttaacatatagtcgagcgataaatcatacagcttaataattctgacaagggttggaatatccgggtagcttttgtcattttcccaattagaaactgtttgccgctgaacatttaatttttgagcaatgacagtttgagttagtcccagttgttttcgctttttttttaaaatatcagctgacatgattcacctctcaaattgactatacttgtgccgccccatgtgttaaagcaattatcggttgcatagattattttgataagcaatttatctttgcatcatcaatttcacggactttaacaccgaccttatcagaactttttgatataaaaaaccacaatccaacattagattgtggttttctatgttaataattgctgaagttgactgactattaccgcccaaattgccaccaatgctttttacgcttaggtgctgattgataggcagatgaaactccgtcagttgttgactgtggttgatagctatctggaatgttgtcactagcaggcttatccgtagtagaattcttagattgggtggtactttctacattgccttcaattgccttagtttcagcggaattgccggtcttattctggagctgctttaacttattttgaacatctaattgcaaacgttgtgattgatcaagtaattgatgtaattcgcgaatttgtttgtctttctcttcaatttgtttgcgctgttcattcaactgttcagccaacaaatctgttgcactatgattggtcttttcctgttgccggttagtaattgcagcagaaggtttctgggccgtttctgttgtgttctcagaactaccttctgtttccttaaattgacctctgaggatttctgcaccctcatctttaatcaaaatcttgtttccctgcttgatcgtatatgtactccgaaatttgtcgtccatatgttttctgattgcagttttggaaaccgctaattgatctgctaactctttaatcgttaacgccataatgtcgcccccaatatatattattcagttcgcaaacaactcgtttgcgctcacacattattcattatagtgattaatttaaatatgagcaaataaaattgtagaacttttctgataacattataacaaacctttgtgcaaaattaaattgagattagaacattcgttgacaatctcatataaaatgcggtaaactactcgcatcccctagtgtcgttttcgatatttcattaatatttatttgtaagaatttacatatttttatacaaaacaaatcgtctagttctcataccagatgattagtttccgtttgctatttcaccggaaacctacaaattatgttagattatcattaagggattattattaattcggattttactacaatggagtgatttttaatgagcagtttaatagaaaaaatgtttcgaaaagaagatcctttagtttaccaggataaagattcccatttaattcgtagtttaactacgaaagactttttagcgttgggtgttggaaccattgtttcaacctcaatctttactttacccggcgttgttgcggcccaacatgccggccctgcagttgcactttccttcttagccgctgcaattgttgctgggatggttgcctttgcatacgcagagatggccgcggcaatgccgtttgctggatcagcttactcttggattaatgtcgttttcggtgaattttggggttggattgccggttgggcattattagccgagtactttattgctgttgcgtttgtcgcgtccgggttatctgcaaacttccaaggcttaatttcgccactgggtctaaacctacctaaaacactttcaactgcttcaactggaagtaatggtggtttaatggatctagttgcaattgttgttattttactggtaacgacgttgctttcacgtggtgcttcgcaaactgcacgagttgaaaatacattagttgttttaaaagtaattgctattttagtatttatcttcgttggtgcaaccgcacttcacatgaagaactacacaccatttattccaaaatatcacgtcaacgctgatggctctgcttttggtggctggcaaggaatctacgccggcgtttcagagatcttcttagcatacattgggttcgactcaatcgctgctaactccgccgaagctaaaaatccacaaaaaacaatgccgcggggaattcttggctccttgtttattgcagtattcctttttgttgccgttgcactagtcttagtaggtatgttccgctactctgattatgctaacaacgccgaacccgtcggctgggctttacgtcaaagtggccacggtgccgttgcaactgttgttcaggctgttgcggtcgttggtatgtttactgcactaattggtatgatgctggccggttcgcgtttactttattcatttggccgtgatggtctacttcctaaatggctcggtaaattggaaaataacctccctaaccgtgcgctaatcgtcttaaccatcattggaattgttttaggcgcctttttcccatttacgttcctggcacaactcatttctgcaggaactttaattgcattcatgttcgtctcgattggcgtttacgcattgaggccccgtgagggaaaagacattccaatgccaagttttaaaatgccattttatccagtattacccgcacttggcttcttaggggcacttggtattttctggggcttggatattcaagctaagacttatgcgcttggctggtttatttttggcatgattgtttactttgcatatggtatgaatcattcaacatccacagcagataagaaaaaacaaactaacaaggattcttaaggattggtgatttcatgagtcatttggaaaaagcttcaaaactagttgatgaagaaaaccattactatgctcgttctgcgcgaattaactactacgatttagtgattgatcatgctcacggggcaacattagtcgacgttgatggtaaccaatatattgacttacttgcaagtgcctcagcaattaacgttggtcacactcatgagaaggtcgtcaaagccattaccgatcaggcacaaaaattaattcattacactccagcatactttcaccatgtgcctggaattgaattatcaaaaaagcttactgaaattgcacctggaaattctcccaaaatggttagttttggaaattccggctcagacgctaatgatgctattatcaaatttgcccgggcttataccggccgccaatacattgtctcttacatgggttcctaccatggatcaacttatggttcacaaacgctatcgggaaccagtctaaatatgactcgtaaaattgggccaatgctaccaggcgttgttcatgtcccatatcctgacttatacagacgctatccgggagaaagtgaagatgatgttgcaaaacgttatttcgatgatttcaaacgaccttttgaatcgtttttgcccgctgatgaaactgcttgtgttttgattgaaccaatccagggtgacggtgggatcgttaaagcacctgagatttacatgcaattagtttataaattctgtcacgataatggcattctatttgcagttgatgaaatcaatcagggactcggtcgaaccggcaagatgtggagtattcaacagtacaaagacatcgaacctgatttaatgtctgtcggaaaatcgttagcctctggaatgccactcagcgctgtaatcggtaaaaaagatattatgcaaagcttggccgcaccggcacacttatttacaacatccggtaatccgatatgttcagccgcctcacttgctactttaaatgttattgaggacgaacatctcgttgaaaaatcagctaaagacggtgaatacgctaagcatcgattccttgaaatgcaagagcaccatccgctcattggtgacgttcggatgtggggattaaacggtggcattgaattggttaaagatcgccaaacaaaggaaccagctaatgatgaagcaacaaaagtaatttattatgcatttgcccacggcgttgtcattattacgctcgctggaaatatcctaagatttcagccaccgctggttatcgatcgccaacaattggaccaggcactccaagtacttgatgatgcattcacggctgtcgaaaatggtaatgttgaaatccctaaaaatgcgggtaagattggctggtaactagaaactttaatgtataagttcccttttactaaagatatctaaataaattttataatcatcgagagtctggacagatattatttgcccagacttttttaatgtgatcgaaccgccaactaaagtagtagaaatatttttaaataggcagctaattttttatcttaattttccaccacctaatttaattatttttgctgtttaactaataaacgtcgtcacaaatcaacccaatgttgtataataagaaagacatagattggagaagacagatgaaacatttaaccttacataatacgataatctcatttggaataattcttacagcagctggttcaattttttttacgaaccagccggtccatgcacaaagcgctaaccaagttgtccaaacaactcaagttcaaccgaaagctagccaagtaagttcagctactacaaatgatcaatcaagccagtcttcaaacttagctgatgatcaatcgacagttgatacaacaactgcttccgtcaatggtagttaccccgatggtcccactaatgatagtgatagtgcctcgagtttatctcaaaacgcttcatcagtacccgattcaccacaaaacaacaatagtgctaatcaagctgattcatccattcaagcagacagttctgaccaatcgtctgatacttcaacaatatctgacgatgacgcaacacgtcaatcggtcacatcttcagatatggataacagtaatagccaatcaacaacagtcactagtgcgtcttcgacaagctcagctgatcagtctgaatcttccacaacagtggataatgctcaaactgatagttcaaatcaatcatcaactaacaataagtcatatcaagtttccaccccagatgatactaagccaactactaccctttcagaaactgcaaaagatgaatcagtagctgcttccacagacactaaaaccaccacgccggaaacggcaaccacaacaaataccaatgacaacatcacagtaccatctgcaaatcaatccaccgaccaaacgattaaccccacaatcaacggcttaattaataatttagtcactgacgtcactagttttgcaggggcagctattgcatatccgtttgtttttactcgtgtggctcaatttatgtcagattttcgaaccttgctgtcacccgatcgctataatatcgaccaaatgtggaatgatcttgatgaaaaatataatcccgaatattccaaagcattttataccgaggctaaagattggtatgataataaggttgccaaagagacttggagtattcctttttatgacgacaaatcaaaatatgctaaagcaacttatattaaaaatggaaattctactaaaaccataatttatggtcaaggctggactaccgatcccaactggatggggtatatttcaaaagtcttctacgatatgggatataatgttttgattacctatactcgtggtcaaaataccagtgatggcgcctttattacttatggtgctaaagataagtacgattggcaaaactggatcaaaaaggttgatgaaacaaacggaccgaatagtcaggttattttatatggtcagtcaatgggtgctgatactgccttggaagctgcctctgtaccaggattatctccctcagttaaggccgttattgcagattgcggttattcaacgatgcccgcacttgcccactcactttatgaagatgcctctaaatcgcttaacgatatcacatcaaagattggtattaatttaaacgggcaaatcccacttttaccctttaataaggtgctcaattctctgaatgcacttaatcaattcttccaaggaaccagcttagatgacatttcagggattaccgctgttcaaaatgccaaagtcccaacgctgtttatttcgacagcagatgatgcgttcattccaacaagccagacacaaactctttaccagaatagtgcagcttccctgaaagaactctgggttcttgacggtaatgttggtgggcacgcatcggcaaacaacgctgtcattcagtatcaacagcatattgaagactttgttgcaaaagccgaacaatctaacatccaggatacgatggtaaccgcataaataaacttttttataaaacgtacaaaagagtatccataatatctcgtcaaaacaaattaatgctatatttgtaatcctcggaagtttaatttataaaaaacagcttattaggggtcgtaaagtcggtatttttgtaaataccgactttacgaccccttttatctgtatatcaatcaataagacaatgaaacaaccgtttacaattacggtgtcaatctcaatttatacggattttttcaataaacgataaaataatattcaaagtacgttgaccaataactatttcatacttttattttgcccttcaaggctttcattgaccaaattagtgtgatcaagcaaacgacaccaacaacaatatcaacgagtgcaatcgccaataccggaaacttagcgcatactgaaacgaaaaccattccgagactgcccataatggtgccgcccgcactatacaaagatgaagcagccccattatcattctcttgttgctttaaaacaagataggttgctggcggtcggctaccgctgctggctaaagttgccggaaactcagtgattgcaaacaaatagggatcatggagtccaaacaaaataatgagaaccccgccaataatactaatgatgtagcaaccataaatgaatttaaaccgatcaacatacttggaaaccttaatatataataatggggcaattaacatccccaaggcgttaaaggaaaagaaatagctaaacacttgactgctcaaatgaaattcattctgaaaaatataagatgacgaagatataaacgagagtgaaataatcgaaactgctgaaaagttaagcaatagcgcagtaaatccgggattctccagtaaaacagccaatcggccaaaaattcggaaaatattcgatttatcatgggttggttgatgggtttcttgaaaaataatcgcgccgcctatgcaaataactcctaaaagtgcctgagcgaaaaaaattcctctccatgaaataaaggttaataatagcgaaccaagaacgggtgccacagcgggagaaatcacaaccattgattgcacaatcgccaacgtggtttcctgtttccgtccttggaatacatcttttatcacagcagtagcaacggtggttgcgactccaccaccaattgcctgtaaaatgcgaaagaagataatttcccaagcactgtttgcgatcccacacaaaatactaccaatcatataaatggttagtccaaccagtaacattggccgacgaccatatcgatcacttaacggcccccaaataatggttgcaacactataaaaaatgaagaaaagaatcaaggttaaattcattgtgaactcagaaacattgaaaaaggttgtcatatctggtaatgccggtaagtacaaatctgtagaaagcggcacaaatgcgctcaatagtgctaaaaaaataataaaacctttatctcccagtcgagattgcatattacccgaattcatcatgaaatctcctttccctgcttcacctaagccacttcatatcaattgttaattcaccagtggcttcgtcaatctttctagtaatttcagtgaaaccttggcgaacataaaatcgacgagcctgttgattcttaaggtaaacagataacgttaattcttaattagcagattgagcagctttaatcaacgcgcttccgactccttgccctcgaaattgagctgccacaaataacccggcaatataactgtgatccattcctaaaaatccggtgatttgattatcacttctaaaaataaataactctgaaactgataattgtgattttacagattcaaaattttctaaccaatactttgagtcaataaatgaatgagcttcaagattagcttttagccaaatctgggcaacccgctctaagtctggtccactaagctgattcacgtgagtaatcatattcttatcctctcaaaaaataaattaattagtattattgtatcctaaaatatggcaatacgacgcttttaatccgaagtaagatgaaatcaggtgctgtaaacataagccttactcagttttccctcctgatgactctaatcgatacctattaacaatcatttcactgttggatcaactatcaaaagaatacattcaataaccacgtcggcttttggcacttaacacattgaatcaaaatcattagcagtgtgacctttatcgtcaatacctgaatttcttgtaacagaattggtgttgactattatccaaaagctaatcacttatttcttaaaattaacagtaaaagtagcatatttgttcgtatttagggtacaatatgactaaacaaagaaggagattcgttatgtcaacctataaaaacaaagtttatctagcatccccattttttagcgatggtcagcgagaacgaattgaacaagttatttcattattaaaacaaaatgacacaattgactcagatcagattttcaatccccaagaacaccaatttgagagcgaaccctttggcagctttaagtggcaggacgccgtatttgcttctgacatgcgacaagttcacaaggcagatgtcgttgttgccatcctggattaccagttagaagacggcttaaccgaacccgattctggcaccgtcttcgaaattgggtcagcccatgaagccaatattccggtaattatggttcaatttggtgaaaaaagtcaattaaacctcatgttggcaagaagttacactgcctttttcaacggcagggaagatatccaaaatttaaaaaattacaactttaataacttggaacaaaaatacacagaaaagaaagtactgtaaaaaagtcacgtaagctttctataactaaattataaacagagtgggccggcaagcgcttagaccccagaatattaagtcaggggacttatatggccggggtttgcttgctggcccacgttttagccaagtaagaagttcaacaagatattctgggcttgaatgttttgataattcggttacgcgtcaggaagttgccttttggcacacatttccactcggtaataatcttaattacacaaacggggctgggacaaaagtaattttgtcccagccccgtttatttataatcacaagaattgttaagttaaacgctatcttacaataaatctaactaaaaattaaattcccaattaaaatcaaaccaccatgaacaatgtgaatgatgttgataaacatttaccaaccgaactgtgttattcactggttgttgctgaccaggagtcgtcgttttatagccacgtgggaccttattttcagcaacggtgtatttgtattgattaccttggtcatcgtacttcggtaagtacataaaggttgtttgataacaattgaagtcattcaaagaagcaatccgataaggtgtcccattccgataaagtgtcacatgaacattaggtgtacacttccaaaatggtacattctgccaatccttgacaactcgaacatacgtgtatcgatcatagcaagactgatatttattcgtaaacgtaattgtcccgtttgaatccggtgcaacatttggattgccgcccggatctgtcacatagccactaggtacgctggcttctttagctgtatatttaatgggttggccattagcggaaaacttattcaagttcgcaaacttggcttgatatgagttttcattatttaaagtaactgtcttaccagtatcaacaccgtcggcataaagcttgatagtgacagccggtgttgtaacaccatcgggaacattttcccacttcttctgtaccgcaatggttgtcgtaattggtgcttgataaacattggttagtgtaattttaccattgctgtctggcgcaactaatggattcccaccaggatcggtcgtgtagccatccggcactttggcctcttgggctgtgtactggattgcatgcccatccttggcgaacttatctaaaccattaaatgaagattgatatgagttggcagcatttaatgtgactgacttgccagtatctgttccatcggcaaacaatttaacgttcacatcgggtgtcttaacaccatccggaacgcctttccaatttttttggactgctatatttgtcttaaagcttccaggttcatctccgtgcgcagttccattacccatcgataacttaaccgtcttggtgtttgatgttgtgactggtgttccagttgccgattttgatatatcggtagcattaatcgtcgcggtatttggcaaatcaagttcactaccgtattgactatatgcgttatcatcactcactttagttgtcgacataatgttaattgccttatcaagcgtgccgttccatgtcaacttaaatccggacgcacttggtgttaacgtataatcctttgcaggcattgtttgccctgaatcattctcagtaaccttaaatgagtcattcatgatactttgtgctgttgtatttcctaagttatcagatacgctgatattttttaattgatggttatttggattcactaaaacctgccaagtcacttgcgataaagtgccgtttggtcgggctgattcatttttcccccaaccattctttgctagataagtatcttgtgggtagcttggtacaaaattttgggttcctgtaacatcaaattgaatctggccgccacgattactatcgtactttgcccaatatgcagcgttggaaaatgtaatctgtccagtattggccttagcatcagcggtaaactttccaacgtcttcgttagtatttgatgatttgagactaaattgctgtggattcctaaagacggcaccagctggtaatgtgacagttgcggtatcaccatcattgactttaacattatcaggaatcttaaactgataagtcagcgtatgtattggtcctgcataccacttctgtgacatatcaggcgttactggcgcattattttcttgagcatcgtttgtgcttaatccggtaacttgatcagcactcagactagcagctccaacttgattcgaaggcaaaaatgcttgcgacaacatcaaaataaagatcgtgacgataccaagcaacaatccctgtttaaacggtgattgctgcttaatttttagtccatgaaccatttctattcccccatttctatttggtttgtccaactcaacaacttaacttgtattagttagccataatcaactcaataagaatatcccttcaataaaaattaattcaaaatgttttatcaaaggggtcaattgtttgctaacaattctaaaataacgcaaccaggtatatattacaagtcctttatgaaatgggttgaactatgactaatattatggtctaatataagtaaataattcttaattattgctaattattatttattagtcatgataatgcctaatttttagcatgatacgtatagcaattattaacggtggctattaatcaacaccggcattacatatttgttttttcgataatcgcaaaaataagactaacaatcccgtaaggagtcattaaatttatggtaattataaatacactattaatcctttgcctgctgggttccaattgctacggtgcctgggatttatatcttgcccttagacgaaaaaatccgcaggcgcattattcaaaagtgattacccgccgcttctctgatatgtatatcattattcctgctttaaacgaagagaacacaattaaggaaaccgttaaccgtattctaaaatcgattgccaatctcaaaaaaatcagcattaacatcactgccgtgtttattgatgatgattcagacgatcaaaccggaaatattttaaaagaatttcaagccaatcaacatatccatatcgtgtcacgaaaattgccaaacgcccgaaagggaaaaggcatcgctttaaatcatgcgttgcgctggattaattcccaacatcccaatcctgataaaacaattattggtgtcattgatagcgatagtgaacccactggtagattattagcatcagtactctgggcatttgaacattcccactatggtctcattcaaaccggtgtttttattagtaactgccagtcatttctaacaatcatgcaggcatttgagtttggtgttattaacttaatttctcaagttttgcgttgcgattggggatcagctattgcaagtggtaacggtcagtttatgactttaagaatgacaaatgatgttaaatggcggggagcgttacttgacgatcttgatttttcaattaatggacttttacgtggctatcaaggtggctttttgcctcaaacgctgatcccgcaagagggtgtcactagttaccgagcctttcttaaacagcgaactcgatggtgtcaaggcgggatgcaatgtcttttaaaatatgggaaaactatttttttatgcaaactaattcgaacaaggctaaaggtcgacatttttgttttcttattcgcaccatttatcgctttatttttatttttagggtcacttatttccctgccaatcttacttgaacatttaattatgtacccgctaaatacttttttagtactcagtgtctttttgacaattaactttttgatttctgccaccattgttaacgccggcttacgctctaataatcgtaaattacgaattctcttacaaaaaaatattttgcaagttgtctttggaaatctattttatttatgggccatggcaccagtcccttacattgctttttacagattactacgcggccaaaatgaatgggttaaaactgctcaccacggaggtgcagttagttgaaaaagacatttttatgggcgatccatgtcagtctccttattttgaccatttttttcttggggtggcttattacggcatcatggacaagttatctgcgttttggatatccaaatgaaacgtattttttctggggtatttacatcaccatttttattggtgttttaatctggattttaacaagaaggttatcaaatcattacgttggctggttggcattagtcttgcttgtcctaacaattcctaagatattgggtattttttactttaaattaatccccgcatcagatatgtggacttacgaaacattagctaacttaaatgcaaccggcgcaaattggccaaccctttatgcaaaaggaatgcttgatttagatagtctctggccgcatgttttacatatcgcaactacctttggtctcatttatcgactttttggcgttcacttagtcgtcttacagctcttaaacatcgttgcgacctttcttgatgcgttacttttatattatgtgattaaaccgtttggtggttcccgtgtcggaattgctgcggctctgattttttatcttacgccggctttttatatttacagtgtcctgattggggcagaacccctttggctgttggcggtactcctatcctttaagtttttcaatgatttattattgccacgacttcacatcggttggttaagatatttaatgacaatcgtcagcattaccggctttttgtacttggcccaattgttacgacccattatcatgatcgttgttatcgcaatgatattatatggattattttcatttggccaatcagaatccgcacaggcatggtcaagaaaacaacgggtgttatcgcttttgatgatcaccattggcttcttcacactaactcatttttctaccaaaattgatcaagctatctatcgtgtgccaatctcaaatagcactgtgggtatgaaatatacagtcgcaaccggttcaaattcagccaccaaaggacagtacgattacaatatgatcctcaaattagagaaaattaatcattcacaaatgtccgcatcaaaaaagtttaatcagatggacgcctatttagcccaaaaaattaaacacaacctagccaccgttatcaaaaacggcaacctcccaaaatttatcttcacaaaatcacaaattctacttcaatcaggttatggattccggttattttggattgatacacacccagtgactcataaccacattccaagccatatcaaatcaattagcaatagtatctctgcagcaagccaaattggaatccaaggacttgcctttaccgttgcgattctagatttaatttatatgtgctattatggttcaaaatcaaaaaggatccatttccgaacattaaatggcctctttttcatggaaattttgctcattggactatttatagcatcgttgctcgtcgaggttcaagatcgctatcaagttgcattatatattccaataatcggaattatcagtaacgggatatctttgttgaatcaaccagtaaccgatttacctaagctagcattattaacaaacttcgagcaaccgcataaaataatttctcagagaaaagcgctatccgatttaaaacgcgagcaaccatcaaaaacaaaatagcataaagggtggccgaaacaaataggtcctctagtgtctatctcggaataaaaaattaggtctagtcaaagctgatcaatatcagctttgactagacctaattttagattctttaatttttcaaaataatcattaattattctaaactttcctagaattaaataagatcagctatctcactaccttaatatatttagtgttcccagtaatatagccaccagcaactcgataccttagcttaccaaactttgagatactattttgatatgaataatcgaaaccatagactttaaatgatttacgaacccttcgattgaaataatgatttcgtctggtacaattaacatcactataacgactaattgcacccttcgcccggacataacgtggcaatcgatatccacctgctttaactagttttcgatttgcagtcatgtatttcccacttgataaaacatatctggtagtcaaattatgttgagcaattcctttcactgacaatgttgttccctgcttatagtttcttaccttgccctctaagctaactttgttatacaagttaacaccggttggattaattaccgtaatctttgcatgtgtttttgcataatatactggacgaacatattgccagtttgcagtaatataacctgttttcccgcgattcttggttaaatgattaacatcacgaacctgatatctcaaatggccactccgagatcgcgcataaccggtaacaacaaacattggtcgataaatccgtggcttttttgcataccaagcgtttcttaaatgacttgaaaaatctttattacgatataaaccaattttctttaacgaataaaccgccattcccttcttggcagcgtaattaggaagtgactgatctggacttgttggcgttatcggtgttgtgggtgttataggagtttccggcgtcactggcccgactggcgtggtgggtttaacaggagtcgttggtgttgtatcaccgccaccaggtatacttgatttttttatcgttaaataagcagtcctggtagtctgattgtgataaatccttcccctgatttcaggagtcgtatttgttgccgtaattgtaactaaatatttaccaggttctggattatttgcattaaatgactgatcaattttaatcttataagtatatttcccatcttgttgactataatcaccaggtttgggggtatcagcaacaaaattatctctaatataatggccactatcaatcccctcgttattcaaaagcaattttttcaacccattaagagaagttttaccatcctcggttgctaaatcaatcgttttatcctggggcctaaagaatggtgagtaaccagcaattgatggattaatataatacaaattagcataatactggcttacaggttgctcatcagtttccagatcactttctaattttacaatatcgtccggcttaccatcgggtgtttcaacgaagaaagcgacattaatcgtttgcggcgaaccggaaacccccatagctttgagatcctcaagatcgcaattaaacattaatcccttatctgtttgcttcaaatacttattgtccaaaactcttggaccacttggtgtttcaagccataactgggcattctgtctatcgattccgatagtgctgccttgagttggtctaataagccatttaatactcttcttaggcatattgttaggactgggcaatgctaactgggcaaaagcagccatggcaggctgactaaaaatatatgccaattggtgcgcccggttgggatcatttaagtcaaccgtgttattcccaccaatataattatcaatatatttggaaacatcaggtacagacaagttgctaaatccaccgaaaataatcgttgacgattgagtcggagccggggtattcgaatccgttgaattatcaattttaaaattcaatggctgcgatgaaattgactgaccaccacttggtaaataagaagtcaccacagacttatcaccattaatagctgtccccgatccaacggatcccgctaaaatcatttccatttgaccaatattatccaatgtttgattaactgtcactacaatggtgtgttgcctcgaatcagttgttaaggtaaatgtctgatcattaggagataatggtgaaccaccctttgatgtgaataaatgaaatttgcttaaatcaccaacatcggcattaaacttgataacaaattgatcacctcgttgcattcgctcttttggaacttgactgttgttaaattccagattaaattgcaacaaattaccattatttagcaccgggttactttgctgatctaaattagattttaaagtaattgaatgacccgttgccggaataattgaatcgggtaaggaactctgttgaataagatctccagaactattgttatcatcagcttttatattattaagttgattaatccccattgaaaagccaagtaacgcaacccctaaaaagaacaataagtttcgacagatataatgcttctcagccagtttgacccctttattcataagtgaatcccccaataattagtctatacaaattagttattaactagagtgtatccttgctgataaggttaatcaacaattgactgaactgccacaaccatttaatggtttgcaaatattcttcatatttctatcacttcgagagacaaaaacctttgcaaacaaaaagagaactcctccaacatttagttgatcagagttccctttattatgtgttatataaatatataaaaattgcaaacctatgtgtttgtactatattctaacttctcttggtttcactttcaacccctaatgacaaacttgcgctatcttcttcaggtaagtgatgaatggcatgctttaagaaaagcggtgcaatcagcgttgataggacaattgttaaaatcaaatcggaataataggcacctgaaagcaaaccagacgaaaacccaatttgagctgttattaatcccatttctccacgcgaaatcataccagacccaatcatataactactgtgaatgttaaacccgctcatcattgcccctaatccacagccgaataacttgctaacacaagccaaaatagtcaacacaatgacaaaccacgccgactcatccaaatgcgtgaatgacatttttaggccaatcgttacgaaaaacattggaacgaaaaccgcatacccgattggttccatatggttttcaataactgtccgatacggcgtgtgggcgactgctattccagcaaagaatgccccaactgcaccactcaagcctaccgcatctgccaaccaggccatacccaaacaaacgaccatcgatgtaattgtaatcctcgaagtcattaacaaacgctcgccaattcgcattaaaactggcacgatccatttgactaataaataagttaatccaaaaaaagccacttgttccacaaatattaatcctaaattagtggtatggggactcgatccaacatcttttgctcccatgacactaatcataattgaaagtaggataacaccgataatatcgtcggcaactgcagcacctaagattgtcgcaccttcccttgtattaagcgcatgataatctctcagaacctcaaccgaaattgagacagacgttgcactaaacacgacgccaataaagattgcttccaaaacggaaaatgaaaaagccatcgaagcaacactaatcatcacaacaggaaaaataacgccaataactgcaacaacaattgctggtcgtaaatattttctaagcaacttcaaattgctttcaaggccaccaagaaacattaagataatcacaccaatttgagaaaataggttgagtgccccacttgattggatcaggttaaaaactccaggtccaaccaacatcccgaccaatatttggccgataaccgatggcacaccaaccctgttaaatagatgtccaacaagggtcgtaaaaattaaaagtaaacataaactaccaataaaagccatgtgatcgagcctcctatttttcaaacaaaaaacgtcctttgaaatcaacttgatctcaaaggacgttttcacgtgttaccacccaaactttgtaacagtttcacaactattaccttattatgtaaactgttaactttgttttcagttacattagtgcgataatggacgcttccaacggatgctcatcacttgcatccgttcactcaaaaggttactttcaccgcaaaaacaattaagccgtttccacttgccgactctccctgaaaacgttaaagcaattactttccttatcatcgtttgtttctaatatgattaattatttctaatcgtaatctggttacaccacaatgtcaataatcgaataagtctttcttaccatcgcgatcgatcatcacatttaatgctgcgattataccaactgcatcggtctctagagataacgatggtaactgatactgatggcgttgagtaacttgttcaggtaaaaggggaatatggataaagccggccttaatatttggaaattccttatctctcatgtactggacttgatacataatatggttacaaacatatgtgccggcactgttagagatcgtactgatgattccccggtttcttatcgctgcaaccattgctttgattggtagttgggtaaaatacgctggttgcccatcctgttgaatcagctggttgattcgacgaaccccggcattatcaaccgttttcgcatcatctaagttaattgcaattcgctctggtgtaatgccatttctacccccagcctgaccaatattaagaacataatcaggtccttcctgctgaatcgcacgatggacaacttgagcacaaacattaaatttagtcggaatttcaagcttgataatttggaccccttttatctcatttggtaatcgtttgacgacttcaagagccggattaacccgatccgtgccaaatggatcaaatccagtcactaaaattttcatggccaccgccctttctaaagatataataatttctattctaataaataaagcaattaatgcaaacaaaaaggcacctaaagtttccgatttagcgaaataatcggaaactttaggtgcctttttcgcaaacttggattaagtttccattttttagtttgcgttttttgatgtcttagcactactatttgacaactcgaatatccttgctgccataatctaaatgccaacctttgggtaatgaaacatgattaaatttaccagtgtgctttttaaaactcaggagtttatcacccgatgataatttagagtcactcttaacgactaacttaccacctagatgagcagttccattaatctgggcgtgactattagagtccaattctagagtcccctgctttgcttgggtgtaatttcctttaactgtgactgatttagaactcagttgaagtttaccagcatttactttgataccaccattaccaaatgcctgattattttgagcaaccagtgaaccgccgtctacattagtttcaccacgataagtgttttcaccgagcaaagttaattggccactgccttgcttagttaacccaccattaccggagatattgttcttccagatatcatttgcattaaatccacccttagatgcatccaacttgacaaccgtatctgtcaagaatttaccaaatccatttgcagcagcaaaaagatttaatcgtccccagccttcagtgtcatcacccattggataaccagatggtaatccagttgtgtataggatttcacgccgttgcgtatcagacaaatatgggaaacgggtcttcagcaatacttccgcacccttaggaactaccattgctttggtcgtactaccaacgggcttaaatccataggtcaatcgataagtgtaatctttcaaattcttttgataatcactaaacgaatcatcagcgttagtatccttagcctttgataagtttgtttgagcgttttgataggcctgctcaataagctgcttattagcagggtcgttcaaagttgcagctgtcattgctgttcctaaaacccgaccgcccataacagccagcggcgaatgacgaccagcaagaacccggtcataaccaacttctgacgaacgggtaattaattgttgaaaacgctgagggaaaacataagctaacgattcacccgtctcaaaggcagctgttgtatggccactcggaaagtcataatcgttgtcgggtgcggcagccatgacattcttaagataaggattgactttaacttgatcactctgtcgatagggacgggtaaatttgatgtatgctttaggtgtcccggtacttgaccaatcagatgcttcatttaagtcaaccaactttacaactgaacccagcttagaattttcatcagcccacttcattgaactataaggtgaatttgctggtaatggcgatgtcggaatcgtattaaagtcagtttgagcacttgcatccttaatgaaggcaggcgcgtattgacccaatccgctgattaggttatatcgtaaatcacgacgatcggtcaaatacgaacgattaacttcatcttgggaagcatcattagtaatcttaattgacttatctaaattctctttaagaacatcggcgttcttcttggtgccatcaggtgaccaataacttagaaaggtgttatcaaaaattgaaattgccggattagtatccggcgttgtattttgtttaatattctttttgtattgatcaataaagtaaccataagaagctttctggggtgctaaagcactagccacacttttactactgtcagcagcttgactggtattttgagcgcccaatagtgctgcgcccgttactgaaaatacgaagacactcttcaaaactgttttcaaaaccgaactttgcttactacccatcttgaaccctccaagtaaaataattactacgaaatgcttaccagaataacaatcagagccaacacagcaaacgcgatttcccaacccattttgggcgtctttctaatctcgttgatcatcgttgacatcatgtttcaccgtccttcaaatcgacccctgataaccattcatcatccacttttaggatacctaaaccttgtaaattacccactaatattttgtaaaaagtcagtaaattttactctttaaaaataccgtcagttattgatcaatatctctaaacgttgcttttgacattgtcaaaatatcaataaggtgtcggtttgcaaaaatcattaatattggatcgtgctcttttcctcgcgaccgataaatcaacacggttgcttgcttcgatgtttcaagctgatgggttgcctgcttcaatgaaattggtttggaaaccatatgtaaagactttttgataatcgataacgaatcagctgttaactgatttaataactgaaactcatgaactaatttccgcccattttgtttaatcttatccggtcgaccaagatcgcgctcaactgactggactgaactgccaactttaatccgatctaattgctgaaatgaaacaatatctccaccatttgcttcaaaatgaacttcggatgttgaccgcttgggtgtcttaccacaactgctgagaacaaaaaccagcaatacacctaccccgataaataagactttgagcgtttctttcataattaatctcctaacttttagaccaacaatcgtcctttttagggtatctttaataaggcgtcatcgtcaaatccaagttatcatttgccctattatttagaacgtatgttcttaatatcaattttaagagcgttattcataaaacgaaagttagcatatacgatatggatttaagtattataattacaattacgaaatatcaaaagattatattaattttgtaaatcaaaaaaaatgactaggaaagataacccataccatttttcttctcatcacaatgatcacttgcaacagaataaaaaacttaacggttccaccttgtcttagccattcgccaatcacaatttaaacgtaaaatctaaccagtgggtaacaactacttactgcctttattgggtcccttgtctttatcctcctcaatgacttcttcagaatacagtttgtttaccaattctggattagctttacctggatttaattcaacaatcttgccacttgcactataaacaatccattcggccaaattcacaatatgatcgccaatccgttccaataaacgaatgaccatcaaataactggaactggcgggcattgtttcggaatttgcttcaactgctttggtgatttcatctcgaatcagcaggtattccttatcgacgccaacatcctgttcggataaggctcgagccgatttttcatcactcttggaataggcatccagagctttttccagcatgtctcgaacctcatcggtcattttaccgatctctttttcaaccccgggaattcgcggggtccctttcattcggatcgtctcacgggcaatactaaccgcatggtccccaattcgttccagatcagaactcgcttttaaaatactaatgatgattcgaaaatcagttgccaccggttgctgtaacgcaattaaatttaaagcttgtttttcaagtttcatttcttcaccattggtattattatcggcttcaatgacctctgccgccaattttttatcatgatcaataaatgccttggttgagtaataaatttgctcactgatattaagacccatttcaacaaatcgaccatgcaatttctttaattcatcatcaaataactctctcattgtaagtcctcctagccaaacttcccattcaaatagtcactcgtctgctcactgtctggattgataaacatcttttcggttttatcatattcgaccaaatttccatttaacaaaaatgccgttcgatcagagattcgagaggcttgctgcatattatgggtcacgataatgaccgtgtattcatgtcgaatatttaataaggtatcttcaatcttcgcactggaaatcggatccagggcacttgtcggctcgtccaataaaacaacatccggctgaacggctaaaactctggcaacacagatccgttgctgctgaccacctgagaacgaaagcgcgttgtcatataaatgatctttaacttcatcccaaatagccgcttgtttcaaactggtttcaatccgatcgtccagaacatgtttatcccgttcaccagccaaccttagcccgtatgcgacgttttcatacacactaaatggaaatggattgggctgttgaaataccatccccacccgttttcttagttttacaatatccacacccggtgcataaatgtcttgatcctgtagtttaatactgccggtaattgtgacatttggaatcaaatcattcatccggttcaggcaacggagatatgtagacttaccgcaacccgatggcccgattaatgctgtgatttcgtgttcagtaaaatcaagattgatcccgtgcaaggcttctttttcaccataatataaatggacatcttcacttgttataatttttcccattgcctgcacctcttattagccaaagtttcctgaaatgtaatcttcagtggctttaatttgtggatttgtaaatattttttctgttcggtcatactcaagaacatggcccatatgaaagaacgccgtgtaatcagcaattcgcgaagcctgttgcatattatgcgtcacaataataatggaatagttttttcggagttgttgtaaagtttcttcaatttttgccgttgaaataggatccaaagcactggccggttcgtccaacagtagaatatccggcttcattgccacacagcgggcaatacacaatcgctgggcctgcccgccagatagggctaacgcacttttatcaagctcatctttaacttcatcccaaagtgccgcagcctttaaactactttcgacccgttcttctaattcagttttatctttaatgccatttcgtttcagcgcaaaagtgatattttcccgaattgatttggcaaatggattggggcgttgaaagaccatgctaatgtgtttacgaacttcataaacattaattttcggactattaatatccatatcccgatacataatcttgcccttaacagttgcaatccgatcgttcattcggtttaagcaacgcaaataagttgatttaccagatcctgaagctccaattaacgccgtaattcggtacctgggaaactgaagactggcatcatgcatggcgtgattatcaccgtaaaagacttgcagattttcagttgtcattgccttctcaattggaatatcaataatgtgagttttatcaaatgagtaatcttgcatagctaatctcctactttgtcgccgtcatttttttgtacatccagttacctaataatcgtgctgataagttaaacagtaaaattacaataatcaacaccgctgatgtcccacttgaaattgatagtgcatcaggggtaacaccttctgtattaactttccaaatatgaaccgccaatgtttcagccggtcgcattgggtttaaaaaactagtggtgctcattggattccagttactataattaacgattggtgcactttgcccagcagtatagattaaggcagcggcttcaccaaacactcgaccggcactcaagatgatccccgttaagataccggggacagcagccggtaacacaatcccggtaattgttttccaatgtgatagtccaagtgataagcccgcttcacgttgcaagtcagaaacatcctccaaagattcttcaacacttctggttaaaaggggtagattgaagaacgttaatgcaatcgcaccggcaagaattgaaaagcccattcgaaactgaataacaaatagtagatatccaaagaggccaacaaccacagaaggtaacgaacttaaaacttcaatcgcggttcgaattaacccggtaaaccaattgtttggtgcatattcggaaagataaatcccagagcccaacgcaattggaaacgaaataattaacgttaagaccaacagatacagggaattaaaaagttggtcacgaatcccaccgccagcacgaaacgattgggctgccgatgttagaaagtgccatgagacatgaggaagtccagttatcagaatataacccagcaaaaagattaagataccaacgaccgcagctaccagcacataaataataccggttgcgatgttgtttgttgttttgctattcatttctttaagctacctcgctttccgataaaccgaactaagatgttaaataccagggacatcaacagcagaatcaatgctaatgaccatagtgcattgtttggtaaagttcccattgttgtgtttccaattccagtcgttaactgactcgttaacgttgaagatggcgttaacaaaccatggggcatcagaaccgcatttccaataaccatttgaacagctaatgcttcaccaaatgcccgggccatcccgaaaataatggcagtcataatccccggagtagcagctctcagcacaaccttataaattgtttgccaccttgttgctcccagtgcaagggacgcggatcggtagtacattggcactgccttgatactatcaatggataatgaggtaatggttggcaataccattacaaacaacacaactactccggctaaaataccaaaaccggtaccaccgaatgtgtgtcgaattaatggcacgatcactgacaagccaataaacccataaacaactgacggaataccgaccagcaattcaattaccggttgaaggactttcgtacctcgctttggtgcaatttcagtcataaataatgcaactccaagggcaaacggtgttgcaaccaaagccgacaagactgtcacactgaaggacgtcacgatcattggtaatgccccaatttgcggctgaccatgcgaatccaacacacctggattccaatttttttctgtcaaaaatttccataaactaacgtggttttcggtgaaagttgccaatccacgagtcgtaataaagtacaaaatcgacagtaccagtagaccaacaaaggtaatgcaaagatagctaagcgctttaccaaagtaatcttggtgggttgctctggaagaactttgaagttcctgcttaatctcatccatactgaacctcctcaaaaaaataatagggtaaacctcaggaaggctggggcaaatgtggatttgccgccagcctccagagtaaaaaattagttaagttaatatatttcaaatttgaaacggaaatcttttaaaatgcaagctgtcagctgctagatgaacgattctcaatagttattatttagtagtaaccgcaccactggcattcttttgaactttcatatcatgaatactgatgtaacctaatttttgaaccaagctgtcctgaactttacttgaatccatataatttaagaacttcttagctgcagcatttggttgaccctttgtatacatatgttcatatgaccagatcttccatttattgttttcaacgttttgatcagttggggcaacgtgattaattgaaggtgcttgaatcttgctgttaacgtaagagaaggcaaggtagctaatggtccctggggtacttgacacaatcttttgaacagttccatttgaatcttgttcctgagtcttaatggccttggcaccttcaagaactgcaccttcaaatgttgctcgagtaccacttccttgaacccggttcacaacattgatcttttgatccttaccgccaacttctttccagttcttaatcttcccagtaaagattccttttaattgcgccattgataagttcttaataccaacacctttatttacaactggtgtcattccgacaacggcaacttgatgatcaactaacttcttagctttaattccggcttgttgttcggcaaaaatatctgaattcccgattgtaacggcaccttcctgaacttgactaagaccagttccggaaccaccaccttgcacggagatgttaactttcttatttgctttttggtaatcactggcagcttgttcaaccaatggctgtaaagcagttgaaccaacagccgtaattttgacatttgaatctgctgacgtactctttgacgattttgaactgctagatccacacccagtaagtaaaacccccaacgctgataaagcgacaattgttgaaaataaggatcgttttttcataatccgatttcctcctaatgaaaaccaagtttttttagtactgttttagtacagttttaatatatcaacgtcatgtaaaaatcgagtttcgtttatgtaaaagtaacgtaaatatcgccgattcatgtcaaaagtatggcataacttaagatgtaaacaattttatttaaaatggaggaaaaaccggatgccattggaaattttattaattagccaaaatttacaactcgcaagtcaacttgaaaaattattagattcctttaatatcaccacccgggtatcgttcgacccacttgaccatttactacaacaggtttccggagtcgtctgggatcttaatacgacttctctaccaacaaattcctctgaactacagattttaagaaaccaaattacgggtcctatcttactgttggatcaaaatactgaaccaattgatacaatttgttcctatttccttaactatcatctggacgattatattcagtcgtcttcactaaaagaaattgttgccagaactgttcagaaaatctgggtttaccagaataaagaccatttacagattaaccagcagggacagactgatcccgatttgaaagtcggtcatttaaaaatcaatttagacaaaattcaggttaatagcggcaacgtgagactgaatctaagtcccattgaatataaattacttctattctttgttagtcactcaaacactgtattaagtcgcacccaaattgcttcagcagtttggggaaatacaactggggccaccctgcgaattattgatacgcatattagtaatttacgaaaaaagattgaaaccgagcctaaaaatccgcagatgctaaaaaccatccgcggattcggttacttattcaaatatgaaaatcaaggtgctaagataagtggcaagaactaattctttatgcaaggagagaaacgatgcaaactgccactgatattttccgaaaaatccaaaccgatcctcaaaatcaaaccttcacagaaaagggaattttaccactctaccatattgttcctgacgctcaaattttaattattagtcaggcaccaagtcgtaaagcccaagaatcaatgattttttggaacgaccccagtggtgatcggcttcgagaatggatgggtgtcagtaaggacgaattttatcggtcgggtaaaattgcagtcatgccacttgatttctattacccaggtaaaggggctcatggtgatctaccacctcgaaagggattcgctgacaaatggcatcaaccacttttggcattaatgccccagattcaattaacgttattaattggtcaatatgctcagaaatattatttaaagcggcaacggcaaaaaaacttaactgaaaccgttcgccacttcgatcaatatttaccaaaatattttccattggttcatccatcaccattaaactatggttggttgaaacaacacccttggttcaaagagacggtcgtgccagaactacaaacaaaggtggccgccatctttcatgactaaaacagccacacttctccggttacttaaaaccggctatttaacaatcattggaaccaatctagttggcatttatctccatggttcttatgtcatgcatgcctataacgagtcagtcagtgatcttgactacattgtagtagttaggcaaccgctttcattttcgaccaaatctcaattacttgcttatacagtcaatcaactttggccactttcaccaaaaaaaggattagaatttcatgtcttattgttaaaagatacccaccatttcgtcgacccgttacctttcgacctacatttttcacaaatgcattaccaggaatacttaatgaataacacggaatatatttcaaaaatgcagggtgtcgatccggatttagcagcccacctgacaattattaatcattttggtcaagtcttgattggtccaccagtcaagacggtttttagcccggttcccgaagctgtttattggcagagtattttgtttgatatcaacgatgctgaaagagaaattgttaatcagccgatgtatgtgattctaaatctttgccgggcattggcctttaagaatgaccacttaatcacatccaaattatctggcggtcagtgggcgcttacccatctctcaaacacaacgtatcaattaattaacgccgcaatatcggattataccggaacgggagcttcaaaggcattaacatgttactcaagtcgtgaattgcaggattttgccaatcatatgttaaaactaattagacagtagcgaacacgagttcgatgatattcgataattatcaaagaacaaagaataccacattagtggatttaactaaggtttgttaactacttctaccgctgagcagccatttgagtcaggcaaaaatcaacaaactggttgccgtaagcttttgcaacctcattctgccaattgtttagagcagattcttttgccaacattggttcaatccactgattagttggcaataattttagcaaatgatgctttgtgaattgtgaaaataacagattctcaccaaaataaaccgctaaccgggattgaaacttcggaacaatcactttttccaataaatgatttgcattattccgatcgccaatcattagaggtgcttggataaaatcggtttgtaaatcaaacgggagtcctttatgtgcctcaaaaatatcaggtttcatttgaataaaccaaataagttgatgtcgttccaactcttttaataacttaagcgcagcaatatctcccgcagttagttcaaactgattaaccgctatttctcggctggtcaactgactgctaactaaatgagttaattgttcaaaattacccgggtcttgccataacacttcactttgctcagcatttctcaaccatccatgatgcgttgctacccgcaatgtcagccagatagtccgattgttagatattcttttccttagtaaccaataggaactcgctgttgaccgggcataatttcctgcacttaaggtcatccccgctggaagtgccgcttgaacagctcgcgcaagcttatcatgataacctggtttgctggtaaattcatatatgtgttgagttgtgcgtaatttagccaaataaatcccttcaatattgtgattaccacaattgtagcatagggattttggatttaatgaacaatcacatctaccaaacagtatgccaaaagagagtgggacgaaaggcggttacgcggcaagaagttgccttttggcgcacgttttctctcggtaataatcgtgattacacaaatggggctgggacaaaattacttttgtcccagcccctttcatctcgactttctattcattacgattattattcagtgaaaattccggaaagatcctttctagccatgcaaccaaggatacatctactcatttttattttagccgtaaattaccgtttatgtcattagtcttcatcttttattcgatagtcatcaaacaaaggatgaagcacccaattttagtcgacagctaaaccgcttaaacaattgtccttttcaaacattctctttagcatctaagaactcacgaatcgtacttgatggaattgatttaattgccggcccaccaatttggtgtaaatagattaagtttaagtggccatctcgatttttcttatcgtttttaatcttgtcaaagacagccggtgaatcgagcaatgatgaactggtcggcaacccgacggcttctaaacgatcagttagcttttgggttaacccggcttgtgataatcctttttcttcaaaaatccgagttaaagcaaccatgccaatgcttactgcttcaccatgacgtaaatcaccgtcagctaaggattcaacagcgtgcccaatggtatgaccaaagttcagtaattgacggagtccaccttctttttcatctcccatcacaatattggctttgtactgaacagaatgcatacttagttcaggcgcatatttcaaaatgtcttcaggtgtttcaattgattcaattaatttccataaatcaccatcagacaaggcaccaaccttaacaatttcaccatatccctctaccaaatcccgctttgttagtgttgttaaagtttctggatcaataataactaaatcgggttggtaaaatgccccaataatattcttagtggtatctaaatcaacagccgttttaccaccaactgagctatcgacttgagctaacaatgatgttggcatctgaatcagactaatcccacgcatgtaggtggctgctaacagccccgccaaatcaccagtcacaccaccgcccaaagcgatgacaccatcatcacggttaaagccatcagcggccatttggcgagttaaatctgccaacacttcaagcgacttggattcctcccccgctggaaattggtaattgtgaaccgtaaatccaactcgaactaacgcatcagcaaccttactttggtaaagcggtgccacgttactatcactaaccaaggcgattttgcgctcggaccaaacactggagaccagctgcccggtacaatttaaaaggccagcctgaatttcaacattgtacgaatgatccggtaaatctactttgataatcttcataaagtaacctcacttttttcttcgttaggcgtcgtaattaattgacggattgcaaatgctttagctgccatttgccgatattcatcaggtttgagtgcttgggcaccatcagaaaaagcatgagccggatcatcgtgaatttcaaccaccaagccactagcaccaattgcaaccccagccaaagcttcaggtacgacaaattctgtatgaccggcggcatgactaggatctacaataacgggatagtgggtcaacttttgcaaaactggtacagcacctaaatccaatgtgtttcgcgtgtatttattatcaaaggtccgaatgccacgttctgtaatcatgatttggtgattaccgcctgcggcaatgtattccgcagcatttaaaatatcatcaatcgttgctgacatccctcgcttcagcattactggaatatttgttttgccgacggctttgagtagcgagaagttctgcatatttcgagcaccaatttgaaaaatatccgtgtaacgcgcaatcatatcaacgtgatcttgatccatgacttcagttaatacgtccatatcataagcatcagcggcggcccttaagtatttcagtccatcttcacccaacccttggaatgagtatggtgaggtccgtggcttaaatgcgccaccccgtaaaatagtggcaccaccactttttgcgacctttgccattttcatgacatgttctgctgattcaacggaacacggccccgccatcatcgtaaaatggtcaccaccaatttgactatgcttggttgtaataactgtatcctcagggtgaaatagtcgactgccttgaacagcagccggcacattatctatgatcgcatcagcagcgattttctcgtcctgagttaaatcagtctcggaaatcccttgaatcgcaactcggttatgatggacaaacacttcatgagttccttcaaatctgttcctaatttcgtcaataattgtcatctggttgtctttaattacaataatcatgatatcatcctcatttcttagaattcaaagttaacgcttatcaaagtataaaataaaaccccacagtggctgaaaacactgtggggtaaagaaaatttgtgtaaaaaaatggtcccacagtattttaaatggagaactgtgtgaccgctaatcatgctgaagaactattggtcgcacaggatgctgacaagtgcccgcatcccgtacgatgtggacactacctgaaccaatagtaataaaatcgattaattttgcgatttactttcttcatgattagaatctcctaagttaagttaaattttaattgtagttagcttataatttatcatcatgattgtcaacctttaatttcaaaagatgcttaaatgacaactaaattctcgattttaaaatctggatagataaaaacgttgtcggttaatatgaaaccagcttttctttaaagtcctcctcatttttagttcaaaaaagaccacttattcccttacactaccgggattggtggtcataatacttaatttaacttgttaaaccattttttaacttttactgattattggatatatgactcgtttagaaaatgggagttatatgaaaccaaatcaacaaatttaatatgttaaacggcaatctccagtcataattattcacaccactgcctaatttttcttgacattttcacataatcgccgtacgcttaatggcaattaaacatccgtcctaaataaaccattgatgtggagatcaagattgttgtgcacgtaaagagagccaccgctgctgagagtgtggtcgaacgcaaacagttaaatggaccacagagggttcttctgaaagttacgagtacgaagaaacgtcagacatacgtcagttgtcgggagcgtgctagcgctttgctaagggtgatgacggtcttttttgtcatcaaattaaggtggtaccgcggaaaatccgtccttaaacaaatcaaaagtttgttttgggcggatttttttatttagacgataaactcaaatatggaggaatccttatgatatctagatctaaacgatggcaattttccgattttagctgacaacacaatcaaatcggaggttcttatgatgacttttaatcaactcaaaaaaaatgctcaaaattatccagcaattccaattacattacaatttcatgttgactcttttgatccaattgccattacccaggctttcgatcaacctgaatcaccctgtttcttattaacgggtcaacctaagaaaagtgaagacggttatacctttatcggattaaatccagtcaaaacgttcacttatcgtgacggtatcatgacgacatcaaataatcacggtaatgtttcacatgaaacagttgcgttaaagactgttatcaaccaaactcttcaaactagccggactccacgactacctgaattgccaccatttgtcggcgggctggttggttacttcagctatgactacgctaagtacgcaaccacggcaaacctaccaaatgttcaaaatccaatgaatttagatgatgctgatctgctcctaattgatcaggtcattgcatataatcattcgactcaaactgtcacccttagcaaagtgattgcctctgctgacttatcggcagcttatgatttagtcatgactgatctgaagaagttaaaaactcaagtcttgagcgtgaccgatcgcaggcaattccctgatttttcaatgtcatcactaaccagtcagttttctttacaagaatttaccgagaaggtagctgaaactcaaaagcacattgttgatggtgacattttccaactaattttatcgaatcctcaacaagcaacgatgactggttctttatttacagtcgcgccaaccttgtttagagaaagtccctcaccttaccaattctatttccgccacggcaactttgaaacaattggtgcctcaccggaaacgctcattaccaaacgagaccagacactttttagttatccactggcaggcacccgccgtcgaggtaaggatcaacgtgaagatgatcaatttgcttatgagttgcaacacagtgccaaagagctttcggaacataatatgctaattgatttaggcagaaatgaccttggcagtatcagtaagtttggtactgtaaatgtcactgcttatcgccgattactaaaatttgccaacgtgatgcacttaggatcagtcatcgaaagtaccgcaaaaaaggatgtttcggccatcgatatcattaacgctgttttacctgccggtaccctatctggtgcgccaaaaatttcagcaatgcaaatcattggtcaacttgaaaatcgaaagcgtggtgtctatgggggttgcttgggatacctgggatttgatggtgacttggacttatgtatcggtattcgtttagcctatcggaagggtaaacacttagtggttcattctggtgctggaattgttgctgatagcgtggctaaatatgaatatcaagagtttaacaataaagcaagctcagtagttaacgcattaaaagaaaccgccatgaagggaagtgttaaagatgcactatcttattgataattacgatagcttcacatataatctctatcaattaattggtacattaaccgatgacccaattaaggttgttaaaaatgacgccatcacagtagatgaactgcggagtgaaaaccctgatagtattattctttcgccaggaccaggccgtccagaaaacgctggaaatatgcccgcaattctccaagagtttattggcaaagttcctattttcggcgtctgcttaggtcatcaagcaattgcccaggcttatggtgctaaaattgtccacgcaccacagttgatgcacggcaagtcttcgctaattaacgtttccgtaaataatgatctttttaccaaatgtccagaaacatttgaagcggctcgttatcattcactaattgtggattccgattccatcccgactcatttaacggttaccgctaaaaccactgatcatgaagtcatggcaatcgcggatgaaaaaaatgatgtctacggcgttcaatttcatcctgaatcaattatgaccgaccccgttgttggtaaacaaattgtgacaaactttttaaaaatgactacaaagacaatcaaacaaacgatttagtaaccagcaacctaaaagttcttgtgatcaatatttaaaatatgaaacaccctgaaattaggtttaaccaaaactgatttttccagtcttggtgttgaatccaatttcagggtgttttctaattttaaacagtatccggtgacgattactaaatcagtatacagattgcactattccaactttcaaagagagtcatatttcatccctccgatatccttactctgctttaaaattcgacttaaaaatatagccacatgatgggcagcgattcataccataattgatttgcatcggtcgatggcaatgtggacagtttccctgaacggatcggggaatctttttgaacccagttgcttgttttgattgctgattattcatgataacttcctccgatttttattaactataagcacttaactttgaatagctgttaaatattttgcgggtatcgcatctaccagccatatgccacttttagttggataaaatagtagaccatgattagcggcttgtttggctgcaatttggaagataaccggttgcggatcccggcgcttgcccacctgaatcgccattgcttgattggccgaaagatgaacaaaatcccgatccattttcttcaacccttcatccacaataaatctagctgccgcatgagttgtcccatgaaacaaacgatctggtggcgtcattggccgcgttaacggcttaacgggaatactatgaccatatagtgcccttatggtatcaccctcaatggcgtagcgctgcttatcactttgggccatgatctgttgaataacctgtttactaataggagttccaaagtgttgattaaatttagtaattaattcatccagattcacgcgaccatattgatccagcgtgacaccaattttatcgggatggtgcctcaaaataaatgataatcgtttgcttaatcttgtcagttcatgcttcattaatcaatcagtccctaaacgcaaaatttctatctgctattattatatatccaatgaattaaaaaccagcgataaccagtcgggctaccaatagtggttatgatatggtaagtgaccagatcaaataattatcaatttagtcccctgcatatgctaaaatcagagtatgtaaatttgctgaaaggaattccaaaatgaaaactatttattttgtccgccatggtcaaactttgctaaaccaatttcggagaatgcagggatgggttgattcgccattaacaaaaaagggagaatcccaagctgctaaagttggcgatcagttaaaagatctccaattcaatttagcagttagttctgatatgatgcgggcaattcatacccttgatattatccttaaaaaaaatcagcacactgacaacctcaaacgtgaaattcacaaagatgttcgcgaagtttattttggttccttcgagggcatcgacagtactcagacttggaatatgattggtggtccactggggcatttcaagcaagatgatctaatccgtgaacatggtcttttaaaagttcgtgattttatgcatgacgcagatccctttcatgaagcagaaacggcggcccaaattgagaaacgaatcaaacaggcagtcggacatcttcaagatgaacttgaggatggcgaccaagcgattgttgtttcacatggaacatacctacgaaatctagcaactatctacacggaaggtcatccctacctcagacaacccaaaaatggcggaattacaattcttgacgttacagatacccctaaaataatatcgtataaccagtagaaatggaattggttctcaaattctcagtaagccatttaaacctgggtagacatatcctttatgcgatggctagttattacgtcttgtcactaaataatcttcaaaataagatcggcttttatccaaccaataaatcattccataagcgacttagcaattgaataaaatgacgatttttttatttccccgccaaaatcatttgttataaaaaatcctgtaaaatcagcatggtgccatttcagctggttttacaggattttaagcttccgacccacttgaacttaaatcggctttctttgaagatgacttaatagcccagattattaacgttattgcgtttcgttttatcagtttgccagaagaacagtgtcttggcaactccaacaactttcttctttggaacgaatccccagtaacgaccatcattggaaacactacgatgatctcctaagacaaaatactcacccttgggaactttaacagcaccggtattcttactccagctctttgatagtgacttaagatcccagttaccggttccaattgtgcgttctttttgactaataaatttctgattaatagccttcccgttaacatagatattgccattattacttgaaacagtatcaccgggcaatccaattacccgctttacgtaatccgtgtttggttgggttgcactaggatccacaccatgagcatcaaaaacaatcacactcaaatgcttaaccttgctatggcggaaaactaataaccgctcattattaatcaaattaggttccatcgatgggccatccactttagcaaccgttagaacaaacattcgtaacaactcagcaattaataacccaacaacgattggaataatccaacttaatattcccttgaaaactttcattttaaactcctttacggactattatttattgataatacgatattaaaatgcaatcggatttaattttagcatactttcctaccatgacaacattttcagccattattaacagaaccataatttatttgcgctttatttgcgcattctattggcactcggtatgataacgtaagtgacttatcttgatagaaataggtgattaaatggcaacttccccaaacatggtcaaaaaaatttggctaacctttatcttgggaacaataagtgcgactgggccactctcaattgacctttacctgccggcacttccggaaatgacaaccagcttacatactcaaacgtcccttattcagcttagtttaagtgcctgtttaattggtctggcattggggcaattaatttccggaccactaagtgataaatttggtcgtaaacggccgcttatggttggcttttttatctttggaattgtttcattattaattgcattcagtcattcggtttatctgttgatattcctaagatttatccaaggcttggctggcgccagtggtcaggtactatctcgggcgatcgcttcagacatgttttccggatcattattaacccgcttttatgcaatgctatcggcagtaaatgggattttcccagtgatttcgcctgtgattggtggcttcatgatccgattcgtcagctggcagggaatctttgttttgctggcaattatcgggttcctgcttttcgttgccatttggctaggaatccgcgaaacattgccacccgaaaaacgattacatggcgatgttgttaaatcagtcggcgttatatttaatttgttaaatgattctaaatttgtaaagttgatattggcaaccggtctcgcctatggtggcttgtttagttacatttccgcgtcatcctttgttttccaaaatttctttcgaatgtcggtttctaatttcggcttattatatgcaataaatgggattggcattgcgattggttccgctattcctggattgttagcaactcatttttcagaggttgcccaaacaaaatttgttttaacatcaacattgttaacagctattggcttactgttaagctcatttttcttcaacaacctcttcatcgtcatcgctttggttttcctaattgtgacccaatttggcatgatttttacgttaaccacttcaattatcatgaatctttctttaaaaaatagtggcagtatttcagccctactgggactttcgcaaaatgcaatcggtggtattatgtcacccttagtcggattaatgggaaccggtacttatttaccaatggctactgcaatagtcggctgtatcggtatcagcttggtactgttcaatacggttcgttttaagccgataaaagattagccaagcatgtttatttactaccacaagacctgtttttaacctattttctggttgtatatcggtcaacataaatgaaataacaaatttccctaacatcaaaaaatcccgtaaagccaattttgcagaatgcaaaccggttttacgggattttactttaagttaaaactatcagctagatgactgtgtataacgattaccaggataaaccaccaaccgtgacagaccccctcacgatcattcaccttaaatctaaccgcttttactgagctaacttggtaatcttaccttcttggatataaacacttaaaatcgcaatatcagccggattaacaccactaattcgggtcgcctgggcaattgtttcaggatgaattttctgaagtttctggcgggcttcagttgcgatgccatcaattgcttcatagtcaattcgttcaggaatctttttagcttccatccgtttcatcttttcaacactagcttctgccttagcaatgtaaccagcatactttgtttgaatctcgacttgctcaatcactcgccgatccagtgacgtgtcagattttggaatgaagcgaagcagtgtttcatagttaacgtatggtcgacgaagaaagacagccgcaataacaccatcttgaagtggcttatcaccgtgttcttgaacaaaggtgttaacttcatcagacggtttaattcgaatcttatttagccgatcaatttcatcttcaatcgcttgttttttaattaaaaatttagcataacgcttatcggaaatcagcccaatgtcgtgacctttttccgttagacgcatatctgcattgtccgttcgtagcaataaccggtattcagcacgactagtcaacaaacgatagggttctttcgtccctttcgtaaccaaatcatcaatcataacgccaatatatgcttcgtttcgcttcaaaacaaatgggccctttccaagcgcacgacgcccagcattaataccagcaataattccctgcccggctgcttcttcgtatcctgatgtgccgttggtttgaccggcggtgaataggttcttcacaattttagtttccaaagttggtttcagttgatatggtgccacaacatcatactcaattgcataacctggccgcatcatttgagcgtgttccaaaccagcaaccgtatgaagcatcttttgctgaacctcctcaggcattgaggttgacaatccatcgacataccattcttcagtatttttaccttctggttccaagaaaagttgatgacgtttcttgtcagcaaatctgacaatcttatcttcaatggatgggcaataacgcggacccaccccttcaatgaccccagtaaacatcggtgcccggtcaagattctctcggataattttatgcgtggtttcatttgtatatgttaaccagcaagacaactgatccttaaccgctaagtaatctttgtcaggcgtctcaaaactaaagtgatgcggcttttcatcccctggttgctcttcagtcttagcataatcaatcgttgtcccatcaactcggggtggcgttcctgtcttaaaccgctccaaatcaaatcctaatttttcaagatttggagtcaacttctcggctggttgagaattatttggcccagatgcatacataagttcgccaataataatcttgccgcgagctgctgttccggttgaaacaacaaccgctttagcttgatatctggcacctgtattcgtaataacacctttgcagataccgtcttcaacaatcaagtcgtcgacaattccctgacgcagcgttaaatttggttccttctcaatcgtatgcttcatttcggcatggtatgcgtgcttatcagcttgggcacgtaatgcctgaacggctgggccctttccggtatttaacatccgcatctgaatataggtcttatcgatattatgacccatttcaccgcccaatgcatcaacctctcggacaaccgttcctttggcaggaccaccaacggatggattacatggcataaaagcaaccatatccaagttaatggtgataagcaatgttttattacccattcgagcagcagctaatgcagactcgcacccagcatgaccggctccgacaacaatgacatcataatcctcaccgcgatatttttgtttaacatcgctaactcgtaaacttttcaactgcaaattcctccaaatgtttcacatgaaacaaactattttcctaaacaaaattgactaaatagttgatcaattagttcatcttgataactatcaccagtaatttcaccaagaaaatcccagcaacgcgtcatatcaatttgaaccaaatcaaccggcatcccttcatccaagcctttaagaacatcttccaatgcgcttttggcctgattaagtaagccgatatgccgggcattagtcaccatgacatcattctgactactttcgatcccttcattaaaaaacatttctgcaattaaggattcgaggtgagtaagaccattcgcttttatcgccgaagttgaaataacattttttgactttgcaagacgcttaatttcgcctaaatcaactttatttggtaaatcagtcttatttaaaacgatgattcgctgtttagcttttgtcgcagcaagtaattctttgtcctcatccgttaatggctcactcgcatttaaaactagtaagacaagatcagcactgttaatcgcctttcgtgatcgatcaacaccaattttttcaactttatcggttgtatctcgaattccggctgtgtccaccaactttaatggaacaccacgcacattaacgtactcttccaaaacatctctggttgtcccagggacatcagtcacaattgccttatcttcgtgaagcaaattatttaaaagactggactttcccacattgggacgaccaataattgacgtagcaagaccatcacgcaaaattttaccttgttttgcagttgccaaaagttggacaattcgactatgaacgtcgttagctttttcccgcaacaagttactggtcattgtctcaacatcatcatattcaggataatcaatgttcacttcaacttgtgccaaaacatccaaaatatcttttcgcaaatgcttaatgagatgagataaatttccatccagttgactaatagcagcctgcattgaacgatcagttttagcctcaatcaaatccattaccgcctcagattgtgataaatcaatccgaccattcaaaaaggctcgttttgtaaactctccaggttctgccattcgcgcaccgttgctcagcaccaattgtaagattcgattagttgcaacaatgccgccgtgacaattaatttcgataatatcttctttagtgtaagtatgtggcgctctcatgactgaaagcatcacttcgtcaatttcttcatctgtcgagggatctacaatatgaccataattgatggtattgctggcaaccttatcaaggttcttaccacgataaattttcttagcaacatcaactgcttcctcaccactaatgcggacaattgaaataccgccctcaccaggtggtgttgaaatagctgcaatcgtatcaaattctgttgttgttaaaaccatgactaagcttcctcccacataaaaatacaacagacaatattaaaacacattttgtatattagtgcacaaaaaaagtgcccactccacgctagaaaaatctagcatggataaagcactttgactactttacctagttaagataagaatgattacctttatgatattttaaagacgctcatttgtcaatccaaaattaagagaagtcatctaaaaataaaatgacgcaacttatttgttaaagacaaattacgtcaaataaaaaattcgcaacaaaaagacgtctccttagccattcataggaaatcgtgattccaaaaacgctcccttagccttaaaattgccataatcaggccacatcaaaaagagtatgctatttttaatagtcaatcccttgaaagccaccctaaataaggcggttatcgtcatttatattaattaatagtcattgccataaactgtattttattttcggaagcaatcgcaaaggacgctgccagaacaccttatcaatttaacaaggaacaatccaaccaaatcagtcaattggctattttatttctgacttaaatatattggatccacttaatccaaaacaattttgaattaaagttactgcttaggtgccacaacgatcactcgatgtggttccttacccgttgaatacgtaataacgtactcattatccgcgagcgtattgtggatctgtttgcgctcaaatgaaggcattgggtttaagtaaattggttttccattggcgatcgcatcacgagctgtcttttccgccaactgctctagcgactcacttcttcgggcccgatagttcgcggtgtccaattcaacattaacattattagcccccaatcggttgataaaaatttgggatagattctgaagtgcattaatggttcggccatggcgcccaataagacggctttcctggtcagtgctaatatcaatatagatcgcatgtttactgcgcatatctaatttgagtttaaacgaaaatcccattgcttcaagcacatcatttagataattggctaattgttgagaaatgttttcgagatcaacggcttttttagtaacatcattatctgcctgatcaggacgagacagattagtgttactttttgcttcagttagtttttgatttgtgatcgtttgattctggtttgtgttctttttctttttaacgtcaaccttagctagtttgcgaccgataccaaagaagccatgtcttggctgttggaggattttaacttcaacttggtcctgtgtgagtgataaatcagctagggattgttctactgcgtcttggatggtttttccagagtaaattgtcataataaactccctttaattaatttaactgatttatgatagcataaattattaacttaataaatggtttccggtaaaaaacgcaaactaatcggaaacttgaaagattaatgtgatgtttgcaatcttcatttaaccaaaacttcactaatacgatataattgacattaaacccccttctggatcatttgggtaataaagtctctttagaatttagattctagttttcgttttagggagtgtcagattggcaaatactaaccagtatgatgctggtaggaacatccaagtcgaccgtcagcatcgcttaaataaactacaggaagctcagaaaattacccttgcaaacttaggtacctatgccgttattatgactgctgaattaatcattggttattggaacagcattactgttttaattgccgatgggctgaataatctgaccggtgtttgtggggcagctatcttaattgcgggcttaaagatttcaagaaaaccaccggactccaaccatgtcttgggacattggcagtatgaaaatattgccgctttcttgtcagcaactattatgtttgctgttagtatccaaattctggttgatggtgttttcgcagtgaaccgattcttgtctggtcaccacgttgttccaaacgggtggtctctgggtgtgagtctggcttcggccttagttatttcggtgcttgccagatttaatcgtgtcaggggtgctcagttaaaaaatcaagcattaattgcttctggtcaagatttaaagagtgatgcttggaccagttttggaacatttctgtccattggtggtgcttttcttggcgcccaatggctggatggcgttgctaccattgccgttggtattttaattttacatgccgcaatttcgatttttagaacaaccattatgagacttaccgaagggtttaatcccggcgtcattaatgagtacagtaagacaatcaatgcgattccgggtgttttaggggtccagggaattgagccacgctggctcggcgatcaaattgtgatgaaaattggtatctatctcgcggatgatacagaactgcaaaccgcctactcgattggcgaaaaggtcgaaagcgtcttaatgacccaatacgatattctggatgcggacgtaatggcttacccggtaagtctaagaaatgatccgtcaaaagttgactagacaataaagggattcaatttaaaaactttcaaatccgattagggcttcttgacaaggtttccaatcactgctatattttggccaataagttagttcgtaaaacaaaatgattcggtgagtaatttgcggccacctgcagagaatcgacggttgatgcaagtcgaagctggcaacaaatgaagatggccgataattggttggtgtaaatgacgtccacgaacatcaaacggaatggtctccgttaccagacacaccactttattgagaaagatttaaaatggttgataaggcttgttgcgtaatcaacaagcaaatccagaatggtaccgcgaaaaaacgcttctgctagttaccacagaggcgttttttgtatcctaatttttagtgaatatatgaaaatggagtgattatatgtcaaaattagcaattattacaggggcaggacagggaattggaaaaggaattgcgcaacgtttggccaaagacggttattcaatcgctgtcgcagacattaattccgatacagcagcccaggttgccaaagatttgaagttagcaggctactcagcaaagagttatcaattggatgttgccaatcgggaagatatgttcaacttagtaaaatcagcagtcaatgatttaggtaccctcgccgtttttgttaataacgccggcgtggcatttatcgataccatcgttgactcgactcctgataaaattcgtcggttacttgatgttaatcttcttggtacctactggggaatccaagcggctgctcagcaatttaaaaaacaaggtaaaggtggtcgaattatcaatgcagcctcattggctggtattgaagcatctgcacttcaaagtgcttattctgcctctaaattcggtattcgaggtctaactcaagctgcatccaaggaattagcagcagataaggttactgtcaatgcttacgacccaggggttgttcgaaccccactacgagatggtatcgataaacgaaccgcggagatccgccatatttctatttcggaacagcaaaaaaatgtcctcagcgaaattacgttagggcgtgaagccaccccagctgacgtggcagaggtggtggcatggtttgcatcaccagcagccgcctacattacaggacaatctatcttagttgatggtggcatgaggtatcaataaaaagataatctcttgtccttttaattcataataaacatttagatcacagttacttcttaaaacatttaagccaagttcaacaaaatcaaaggatcagagtgagataaaaggcgattagcttccagagtataattggattatcccaatattcagggcttgaatattgggataatccggatgtatggcaggaagggcttttgtctcacgtttttgcttggtaatagtcatgattacaaaaagcggggccggacaaaattacttttgtctcggccccgtcctttttattttttattattttcgcttactacgttttgctttacgaattgccttttgaacagctcgtttacgattacgttcagctttttgttttcgttcacgttcacgacgaatcttccaaggattttgaataaccagtgtctgaccaacttggaaagcgttggtaaccacccagtacaatgataaagctgaaggaagacttacggccataattaaaataaagattggcattccaatcgtcatcatcgttgtcatagaatttgattcaggttggcctttcattgctagccaagaagaaataaacgtaaacagcgcagccaagattggcaaaatgaagattggatccggatggccaagttgaagccagaagaaagtaccacttcttaaaatatcagttcgccagattgcttgatacaaagcaaacaggattggcatttgaacaattaatggtaaacaacctgcgattgggttaattcccgcttcggcatataattttttctgttcagcctgcagcttttgcattgtttcagcatctctagacgaatactttttttgcaatgcctttaactgcggttgaacttcttgagtttttctcatgcttcgcgtttgataaatcatcaatggtaaaatcacaattcggacaagaatcgtgaatatgataattcccattccatagttatcactaaagaatttagataaccaaataattgctcgtgagaagttaaggacaacccaaccatcccaaattcccttgctatgttcagtaattggcgtattgctacatgcggagagtactaccgttagactgaccaaagatagcaataccattatttttcttattttctttttcaacgtttttccccactatcataattggaatcgatcagttttgctaacttaaatacgtgaatcaagctggatttgatatcttgcatcgacatttgatccgttgatggacgcgctattacaataaaatcaacgtcttggcgcaaatccggcttcaattctagtattgcctgacgaattcgacgtttgacccaatttctatgtactgcattgccaatcttttttccaacggaaatcccgacgcgaaaatgtaattgattaggcttgtccaacgaatagacaacaaattgacgatttgcaacggagttgtgagtttcaaacactttttgaaattcggactctttttttacacgatacgattttcgcatgattcatctccacatatttctgtttaaaaataatgaaaaagaccactgaatggtcagtggtctatgcagacaatacttttctacctttttgacgtcggcgtgctaacactttacgaccattgctggtactcattcgtttacggaagccatgaacgcgagcgcgatgacgcttctttggttgatatgttcttttcataaaaaaatcctccttactcttttaaatcgcgtttaagcatttattaatatgttcaaatgcatttcccaaatatattaacataaaactcctattaatggaataccattttttatagttaggcaacttaaaaaaaatataaaatttgtttcatgaacaaaaggtgtggataactccgtcatttacgagacatcattttcttgatttacacaaggttatccacaaagaaacagaatgttcttaaagttatccacagcttgtggacatttttaattttattttgacaaaccttgttaacacagcgtttagttatccacaaggctctgtgaattccttgaattaaacttttgtttttccacttatccacagaagagttatcccaactgtctacaactgtgaaacaattatgcacaggcttgttttgcctgtggaaaacttttattgagaatgctagaattaatttgcatttcataaaacgactaaaaatcaggggggaatttcaaagtgcttgataaggattcattgtggcaaaaactaagtgaacaatttcgagagaacacaaccgaccttacttacgatacatggataaaaccagtgacacccattagcttcgatggatccacacttactttatctttaccttctgaattgcatcgggattattggaaagaacaactggctccaaatctcatcgaatatgcctttgttattactaagggtaatatcgaaccaaaatttattttggattccgatgtcaaaaaagaagaaacagaattagagtcagaacctacagatgacgctaacgagcctgagccggatgaagagttttcctttagtaaagaaactcatttaaatcccaactatactttcgataattttattatcggcaaaggaaaccaaatggcgcacgctgcagcacttatcgtatctgaagaacccggaaaactttacaatccattattcttttacggtggtgttggacttggaaaaactcatttgatgcaagccattggtaataaacgattagaggatcatccggaaacaaacgtaaaatatgttactagtgaagcctttactaacgattttattaatgctattcaaacaaatcgaaccgaggaatttcgtcgagaatatcgtaacgttgacattttaatggtcgacgatattcaattttttgcgcaaaaagaaggaacccaggaagaattcttccatacttttaacgatctctacaataatgataaacaaattgttttaacttccgaccgtgtcccacaggaaattccaaagctgcaggaacgattggtttctcggtttgcctggggattaccggttgatattacaccaccggatcttgaaaccagaattgccattctcaaaaacaaagcaaaattggacaatttagttattccaaatgatacgttagcctacattgctgggcaaattgactctaacgttagagaacttgaaggtgctttatcacgagttcaagcatattcgaaacttaaaaatgaaccaataacaactgacctggtttacgaagcattgcgcggtctaaaactaaccaagacaagccgtgaactatcaattgttgatatccaaaataaagttgctagttattttcatgtctcaataactgatcttaaaggaaaaaaacggatgaagtccatcgttgttccaagacagattgcaatgtatctttcacgtgaaatgacaaacaactcactaccaaaaatcggtaaagaatttggtggaaaagatcatacaaccgttatccatgcttgcgataaaatttccgaaatcattaaaatcgatattgatattagaaaagaaattgcggatatcaaaagtgagctaaactaaatggtataattggttgtggataattcaacagagaagtaataagttatgcacagacttatccacaagttgataactgctaattgccagtatcttttcagttatccacatatccacatgccctactattacttctgtttttttattaattaaataaaataattcaccactctctgggaggtagatttaacgcatgaaattttcaattggtcgcacagcatttacaaaaggattaaatacagtagcaagagctatttctacaaaaacaacaattccaattttgacaggacttaaattagttgctaatgaaaccggtattgttttaacaggaagcgacgctgacatttccattgaaacaacaataagatctgatgatccagataatatgttggttattcaatcagaaggcgcaattgtcctaccagctcgattttttactgatattattaaaaaattacctgaagatacgattactttagaagttggcgaaaattttcaaacattaattacttctgggcaatcgtcctttaccattaatggattagatgctaataattatccacatcttccggaaattcaaaccacggataccattccattagcaggagatctatttaagcaaattattagtcaaaccgttgttgcagtttcaagtcaagaaagtcggccaattctaactggggttcattttgtcctttctgaaaataacttgctggctgttgccacagatagtcaccgattaagccaacgtaaagtaaccttggaaaatccaatcaatggcacttataatttcgttattccaggtaaaagcttaatcgagctttctcgaatgatagacgatgttaaaactgaagttactttatcagttactgaaaatcaggcactttttgtaattggtaatactttattctattctcggcttttggaaggaaactatcccgacacaacaagattaattcctgattctcatgacacgcaagttgcttttgattcacctgatctcttagcagcaatcgaacgggcatctttgctatcccatgaatcaagaaataatgttgttaagattacagtagatccagataaaaaatctgttaccatctatggaaactctccagatgttgggaatgtcgaggaagatcttgaaccaaaaaccgtcgaaggaaacgaacttgagatttctttcaatcctgattacatgaaagatgcgctcagatcgtttggccaggcaaccattaatattgattttacgtcgtcattgcggccgtttacattgactccaaccgaagaaagtgagagttttattcaattaattacaccaattaggacattttaaagatcccctgttactttagatatgttgtagaacattattaaacctacaaagaggctgagcaaattttattttgttcagcctcttttaataagcgtgcaattataaggaaattaaccaatgatttaaagacaactcttagttatgtccttaaattacccaacagataatattcagacaacttactttacgattactttatgtatggaaagttttagataaaaagagctatttacttaatccaggtgtttattttggaaatggttgttttatttgtaccattaatcggaagccaagataatttggaaaatgtttttatcctgttttcacaaacatcaaggttgttaaaaatattctgccaactgcttaaaaaaagcttaaaagatcatttattgtccatatacgtactttttagcgctttttactctcataaggtaaaaatatcaaaaataccaaaacccgctcagaatgcttgagaatcgctataaacatgtacttttagtaaataaagaggtataattatactatgtaaaaaaggtgggtgaaattgtgaaaaaagagattttcattgatgggccttatattactcttggacaattattgaaagaggaagccattataagtagtggtggtcaagctaaatggtatttaaaagaaactgcagttaatgtcaataatgaacctgacaatcgccgtggtcgaaagttatccgatggtgataaagttgagattcctgatgttggcttattttttattcgctcaaagcaggaatctgaatgaaattaacggcaattgaaattcataattttcgtaattatgtaaatcaaacgcttaaattttcagatggtattaatgtattactgggtgaaaatgcccaaggaaaaaccaacttgcttgaagcgatttatgttttggcattgacccgtagtcatcgcacaaataacgagaaggaactcattaattggaatagccaaactgctcaaattaaaggtgttttacaaaagcgcttaggaaatgttcccattgaactggatttgggccctaaaggaaagcgggccagagttaatcacttagaacaagcaaagttatccacttatattggtcaactaaatgttattttgttcgcaccggaagatttgtcaattgttaaggggtctcctcaagttcggcgtcgatttatggacatggaatttggtcaaatgagcaatcgttatttgtataattctgcccaatatcgaaaaatactaaaacaacgtaatcgctatttgagagatttacatcagaaaagacaatctgatcgagtgtacttagacgttctatcagatcagttgtcagcttatggtgcggaaattatttttcagcgattacaactacttaaaaagttagaaaatttcgccagaataattcacactgaaatctctcaaggaaaagaaaagcttacttttgaatacaaaactgttgtttccaaagagcagctagggtccgtagagttaatttatcaaaaccttttgaagcagttcactgaaataaaagataaagaaatatttcgagcaacaactttgattggcccacatcgtgatgatctccactttgttattaacggtaaggaagttcaatcctttggttcacagggtcaacagaggacaacagcgttgtcggtaaagttagctgaaatcgatttaatgaaagaacagactgacgaatatccaattctattgctggatgatgttctgtctgaattggatgattttcgacagactcaccttttgacagcaattcaagataaagttcagacctttttaaccaccactagtttaagcggtgtgcagcaggagttgctgacaaatccacgaatttttaagataaaagatggcacagttgatttggaaaatagttaggagacatacaaatggctgacgaaaaagaaactaaaaaagaattagctcatgaatacgacgcgagtcaaattcaagttcttgaaggactcgaagctgttcgtaagcgtcctgggatgtatattggcacaacgagttcgcaaggacttcaccatttagtatgggaaattgttgataacggaatcgatgaagcccttgctggttttgctagtaaaatcacggtaaccgttgagaaggataatagcattacagttactgatgatggtcgtggaattccagttgacgttcaaaaaaagactggtaaatcagcactagaaaccgtattcacaattttacatgctggcggtaaatttggcggtggcggttacaaagtttctggtggtcttcatggtgttggtgcatcagttgttaatgcactttcaacggaactggatgtatcagttactcgagatggaaaagtttactacatggacttttcgcgaggtcatgttactactaaaatgaaggttgtggatcatgtttcggatgaccttcatggaacaaaagttcatttcttaccggatcctgatatttttcgcgaaacgacaactttcgacatcaaagttttaacggctcggctcagagaattagctttcttaaataagggtttgagaatcgttattcgtgatttgcgaccagagaaaccaactgaaaaggatttcctttacgagggaggtattcggcattatgttgaatatcttgatcgagacaaggacactttattagatgaaccgatctacgttgaaggaatcatgaatgggataaccgttgaagtctcgattgattatacggaagattaccacaatacattgatgacttttaccaacaatattcatacttacgaaggtggaactcatgaggaaggattcaaacgggcactaacacgagttgtaaatgattacgcccgtaaaaataagttacttaaggataatgaagccaacctctctggtgaagatgttcgtgaaggaacgactgcagttgttagtatcaaacatcccgatccacaatttgaaggtcaaacgaagaccaaacttggaaattctgatgcaagaaccgtcactgatcgggtgtttagtgatcatttttcaaagttcttgatggaaaacccaaaattagcccgaaaaatcgttgatcgtggtttgcttgcttcaaaggcgcgttcggcagctaaacgtgctcgtgaagttactcggaaaaagagcggattggaaatcagtaatcttcctgggaagttggctgataatacaagtaaggatcctaaaatatctgaactctttatcgtcgagggagattctgctggtgggtcagctaaacaaggacgatctcgacttactcaggctatcctgcctattcgaggaaaaattttaaacgttgaaaaagccagtatggatcgaatcctagctaatgaagaaatccgttcattatttactgccatgggaacgggatttggtgatgacttcgatttatcgaaaattaattatcacaaattaattatcatgaccgatgccgatgtcgatggtgctcacatccaaacgctattgttgacgttaatttatcggtatatgcgaccactaattgatgccggttatgtttacgttgcccaaccacctttgtatcaagtccgtcagggtaagatgcaacgatatattgattcggatgacgacttgaatcaattccttgggactttacaaccatcgcctaagcccgttattcaacggtacaagggacttggtgaaatggatgctgaacagttatgggatacgactatgaatcctgaaaaccgtcatttattgcgggttgaatcctcagatgctgctgaagctaatcgagtattctcgatgctgatgggtgacaaagtcgaacctcgtcgtgaatttattgagaacaatgccacatttgttgaaaatctggatgtttagtttttgtgtttcacatgaaacatcattagacttttggcaagtcatgaatggaggtaaatagtttggccaacgaaaataaccaaaatggagactattcaggtcgaattacaaatgttgacctatcaaaaaaaatgcggacatcatttttagattatgcaatgagcgttattgttgcacgagctttgcctgacgtccgcgatggcttgaagccggttcaccgtcgaatcttgtatgatatgcatgagttgggcgttacgccggataagccgtataagaaatccgctagaattgttggcgacgttttaggaaaatatcatccccacggtgacaccgcggtttatgaatcaatggttcgaatggcacaagattttagctatcgttatatgttagtcgatggtcatggaaactttggttccgtcgatggggatggtgcggctgcgatgcgttataccgaagctcgtctcagtaaaattgcaatggaaatgttgcgagacatcaataaagatacgattgattttgttcccaactatgatggtacagagagagaacctagtgttctaccagctcgatttcctaatttattagtaaatggtgcatctgggattgctgttgggatggcaactaacattccaccacataatttatctgaagttatcagtgccatccatgttttaatggataatccggaagcaaccacagctgatttgatggaagtcttaccaggccctgattttccaacaggcggggttgtgatgggaaaatcaggaattcgaaaagcctatcagactggtaaggggaccattattgttcgagccaaagttgaaattgaaggcgaagctactggcaaacaaaaaattattgccacagagttgccgtacatggtcaacaaggccaaattaattgaacggattgctgaactggcccgtgacaaacgaatcgaaggtattactgatattaatgatgaatctgatcgtgaaggaatgcgggttgttattgatgtccgtcgtgatgcaagtgctgaagtcattttaaacaatctgtataaactaacttttatgcaaacatcatttagttttaacatgttggcgattgttgacggaacacctaagattcttagcttgaaagagattttgcattattacttggaacaccaagtccaagtcattaaacgccgaactgcatacgagctgaagaaggctcaggcacgggctcatattcttgaaggcttgagaattgcacttgatcatattgatgaaattattaaaatcattcgtggttctcaaactggtgaagttgccaaaaatcaattgattgaaggctttggtttggatgataaacaagcccaagctattcttgatatgcgattagtgcgtttaaccggtttggaacgtgagaaaattgataaagaatatgctcagttaatgaaagatattgctgaatataaggcaattttagctagtcgtgagcgaattaaccagattatttatcaagaattgcttgaaattcaaaataaatttggtgataaacgccgaaccgaacttttggttggtgaagtcctcagtcttgaggatgaagacttaattgaggaagaagacgttattgtttcattaacccacaatggttatattaaacggcttccaacaactgaatttaaagctcaaaatcgtggtggccgtggtgttcaaggcatgggtgtccataatgacgactttgtggaacatttggtttctacttcaacacatgatgttctgctgttctttaccgatgctggaaaagtttatcggatgaaggggtatgagattccagaatatggacgttcagctaaaggaattccgatcgtcaatctgctgaatattaattctggcgagaagatcgaagcagttattaacatttcagatcgtaaacatgatattgaaaaagatcttttctttgtcaccttgctggggactgtaaaacggacgtcggtttcagaatttgcaaatattcgtagtaatggattaaaagcaattcatcttaaggatgacgaccaagttatgaatgttttgattgtggatcaggatcaaaacattattatcggaacacatcgtggttatgccgttagttttaaagcatccgatgttcgctcgatgggccgttctgccacaggtgttcgaggtgttcgacttcgtgaaaatgattacgtagttggttcggataccttgaatcctgacagcgaagtctttatcatctcagaaaatggttatggtaaacgaacttcagctggtgaatacccaatcaagggtcgcggtggaaaaggtattaagactgccaatattactgaaaaaaatggaccacttgctggtttaacaactgttagcggtaaagaagatattatgctaattaccaataagggtgttatgattcgttttgcaattgaggatgtttctcagactggacgagctacattaggtgttcatttaatccgaatggatgatgatgctaaagtagcaacaatggcaaaggttgaaaagcaggaagatactgacgattctgccgatgatcaagcaagtaacaatcaagattcagacgaacatgatgaaaattaagcaattaattagggattctagtcactcaaatttgagtgtttggaatccttttttatgtggtggaagaagctaatcttttgacttactttttgtaagtgatagactaagtttgttaattaagatagttatacattggaggtatatataaatggcagttgttaatggttataaacaaagtgaaaacgaaaagaaactaaatattttaaacttgcctgagcttgaacaacaggcaaaggaaattattccgactggtggttttggttacatatctggtggttctgaggatgaatggacacttcgcgctaatcgaaaggcatttacgcataagcagattgtgccacgggctttaagcaatattgagaaacccgtattggatacaactgtttttggctttccgctaaagacgccagtcatgatggcaccaaccgccgcacagggattggctcatgctaagggtgaagttgatactgcgaagggagtggctgctgtaggtggtttaatggcgcaaagtacttactcatcaacttcaatttctgatacagcagctgctggtgatggcgcccctcagttcttccagctgtatatgagtaaagattggacttttaacgagtcacttcttgatgaagctaagaaggctggtgttaagggaattattttaaccgttgacgcaactgttgatggctaccgtgaagcagatatcattaataatttccaattcccaattccaatgccgaacttaacccagtacagtgaaggaaacggccaaggtaaaggaattgctgaaatttatgcttcagctgcccaaaagattggtccaaaagatgttgaacgaatcgccagctatacagatttaccagttattgtaaaggggattgagtcacctgaagatgctctctatgcaattggcgctggcgcagctggtgtttatgtttcaaatcatggtggccgtcaattaaatggtggaccagcttcctttgatgttttagcagatgttgctaaggccgttaatgggaaagtaccagttatttttgattcaggtgttcgtcgtggatccgatgtcttcaaagcaattgcctctggcgcagatttagtggcaattggccgtccagcaatctatggtttggcccttggcggtgcacaaggtgttcaatcagtctttaagcatttagaccaagagcttgaaattattatgcaactggctggtaccaagacaattgatgatattaagaaaacaaatctgttggggattaactattaacaaatcgcatatgaccaagaatcagttatttataaatggttatttttagtcatagttgatagatgtgaaaatttgatacgccgattgaaatacgtcaacctaattctgggatgggccttaaaagccggttccgagattaaggttgatgtattttttagccatttttaatggatagttgtctttttttgcgtatataattagtgtaacgtaaattaataattaggcatattgatcttttaagtgaagcatggtatagttttacattgtgagtatctgggtaaaaacagagactctccttgctctcgggaagagggccataagtccataaggaggtgcaaatcatggaagaaaagaaatacgaaattacttacatcattcgtcctgatattgatgaatcagcaaagtcagctttaattgaccgattcgacaagatcgtaactgataatggtgccaagattcttaattcaaaagactggtcaaagcgccgttttgcttacgaaattggtggttataacgaaggagtttatcacgttattactttaacaaccgattctgatacagcattaaacgagtttgatcgtctatcaaaaatcaatgacgacattttacgtcatatgatcgttgttcgagatgactaattaatcattctaatatgagaggagcaattcagcatgcttaatcgtgcagttctaacgggtcgcctaacccgcgatgttgatttacgttacacgcaaagcggtgccgctgtcggcacgttttctctcgccgttgatcggcgttttaccaatcaacagggggaacgtgaggctgatttcattaactgcgtaatctggcgaaaatccgctgaaaattttgccaacttcgttcataagggctctcttgttggaattgatggtcgaattcagactagaaattatgaaaatcaacaagggcaacgtgtttatgtgactgaagtcgtggtagaaaactttgctttgcttgagcctaagtcttcgagacatgggaactcaaacaatcagcaaaacggtaatgctcctcaacaaaataacggaaatggcaataatccatttgataataattcaaataatccatcttctggaaatagtaataatggtggaaattccagtaactctgggaattctggtaacaataatccagccgatccatttgctaattcaggagattcaattgacatttccgacgatgacttaccattctaatgaatggctaaagatactaatttgaggaggaaatactatggctcaacaaagacgtggcggccgtcgtcgtcgcaaagttgattttatcgctgcaaaccacatcgaatatatcgactataaagatgttgatttgttaagacgatttgtttcagaacgtggaaagattcttccacgtcgagtaaccggaacaagcgctaaaaatcaacgtaaattaacaatcgctattaaacgagcacgaattatgggcttaatgcctttcgttgctactgattaatcataaagaagctatctaaaaatagatggcttttttatttacaatcgaaatgatataaattcttcagaaaaatttaaatcttaatttatgttagaataaaaacattaagcatattgattaagaggataaaaaatgaaaaattggttttcgcatgacaacggtgaattaccaccgtttgttcataatcgccggttaagacgaataatgttatttatcgcgttaatcgttatttatggcgttgtcatctcatttttatataatattattgcttcagctgttttgatcgttattagtgttgcaggattgatttacaccattgtgatgatgaatgagattagttcggatactaatcgctatattactgacttatcttatcgaattcatcgtggtgagcaagaagcattattagaaatgccgattggtgttatggttttaaatgcggatggtttaatcgagtggaccaatccgtatttaactaaatatttcaaagatgaaaatattcttggcaaaaagattatcgatgttgatcgtgatttgcagcagttaatgatgaaatatgaagagtctgacgagtttcacacgattacttggcgggatcacaaattaacaatgttgattcaaaaggaatatcacaccatttatttgttggatattacccggtacgctaatctcgaggagcgttataaagacgaacaaatttcagttggccagatctttttagataattatgatgaaattacgcaatcaatgacggatcaggaaatttctaatttaagtaattatgtgactaatgaattagcaacatggtcacaaaaatatgggatgtacctcaagcagattgacgatgatcatttctttctactagcatatgccaaatcgttaactgcaattgagaatgataaatttaacattttggatgttgtccgtgagagcacgtctaaacagaacttcccgcttacgttaagtattggaattgcgtatggcgaggatgatttaaacagcttggctgatcaagcacaaagtaatctggatttagccttgggtcgtggtggtgatcaagttgttgttaaatcacttgatggaactgctagattttacggcggaaagaccaatccaatggagaaacgaactcgggttagagcccgaatgatctcacaagcgcttaatgaactgatgagtgactctgaccagatatttgtccagggacataccagaccggatatggattcgcttggtgcctgtttggggattcgacgaattgctcaaatgaataataagaagtgttggattgttctggataaggaaaaggttcattctgatattcaacgactattagaagcaactaaaaaatacccggaaattagtgattcaattattacgccttcagaagcactgtctaagacaacggatagtagtttgcttattatggtggatcattccaagccatcgattagtatttcacaggatctttatgaaaaaatgaatcagaaagtggtgattattgatcatcatcgtcgtggtgaggaatttcctgagaacccgatgctggtttatattgaaccatatgcatcatcaacttgtgagctgattactgaaatgtttgaatatcaaccacatgaagaagaaccaattaatcgaattgaagcaacggcaatgttgacaggaatctttattgacacacaatcattttcaatgcgaacggggaccagaacctttgatgccgcaagctacttacggtctgccggagctgattcaatagaaatgcagcaatttatgaaagaaaatattgatagttacttacaacggaatcatttgatatcaatggttgaatttttccacaaagatatggcaatgattgtgggtgaagaggatcgcgtctatgatccggtaacggccgcccaagcctgtgattcgttgctaaccatgtcaggcgttgatgcatcctttattattacaaaacgttccgatggtaaagttggtgtttcggcacgtagcacaggttctatcaatgtccaaatcattatggagcgaatgggtggtggtggtcacctatctagtggggctacgcaacttgctgacaagtcaattgctgaggttaagcaattattgcttgaaacgattgactatatcgatgataatgagtagaggtatttaaataactttgagaatattaggagtgatcggttgtgaaagtaatttttctagaagacgtccgtggtaaaggtaaacgtggcgaagttaaagaagttcccgacggctatgcccaaaacttcctaattaagaacggtaaagccaagcaggcttcgcgttctgcaatgagtcaacttaagggtcagcaaaaggcggaaaaacgtcgtgaggttgaagaggttgaagaagcgcagcaagttaaagccaagttggaagacgataagacggttgttgaacttcaagctaaagcagggactgatggccggttatttggatcgattccaagtaaacaaattgcatcggcacttgataaacaatttggtattaaattagataaacgtaaaattgaattgtctgatccaatccgggtagccgggtatactaatgttccggttaaacttcattctgaagtcacagcacggatcagagttcatgtttctgaaaagtaatatgggccaatgattaaatgatgagtttaattaaatcatttcttgagctggcagtgagacaggacttatttgtgcagagaaagaggatctggctgggaatttccttaataactggttaaaataaaatagcaatatttaacttcattgtgaaaagaagcgagtgattcgattttgaatcactcgcttttattaggataattggtgtaaaataaaatattgaatttgtcactatagaaatttgaggaatttaaatgagtaatgattttgtaaatgaattaccgccacagaatattgacgctgaaaaagcggtcctcggatcaatctttttgagtacggatgcactcattgaagctatggaatttttggatccgacagatttttataagcgatcccatcaaattatttttcaagcaatggtcgatttgaatgaccgggatcaagctatcgatgttgtgacaataactgatttgttaacagatcaaaataatttggacgatgtcggtgggatgcaatatattgccgagttggcgggttctgtaccaacagcagccaatgtgacctactatgccaaaatcgtcaaagacaaggctattttgcgccgtcttattcaaactgcaactaacatcgtggctaacagttacaatactgaagatgatgtcacaaccgttttggatgatgctgaacgggacattatgaatgttgccgagaatcggaatcaatccggctttaaatcaattaaggatgttttaaattctgcttttaatgaaattgatcgtctttctcaggaaggcgacaccgttacgggactgtcaaccggctaccctgagttggataaaattaccactggtcttcataaagatgaattggtcattattgctgctcgaccggccgtcggaaaaacagcatttgcgttgaatttggctcagaacgtcggaacaaaaacagataaaacggttgccatttttagtttggaaatgagtgccgaatcattggttgatcggatgctgtgttccgagggtagtatcaatgccaatcatttgcgaacgggacagttaagtgaagatgaatggcaaaacctggttgttgcaatgggcagcttatcccgagcaaacatttttatggatgatactgccggtattaagatgtctgaaattcgagcaaaatgtcgacgactagctaaagagaatggaaatttaggcttaattgtgatcgattacttgcagctgattgaaggtggcaatcgagaaaaccgacaacaagaagtttctgacatttcacggcagttaaaaaagctggctaaggaacttcatgtccctgtgattgcgctatcgcaactttcacgtggtgtggaacaacgacaggataagcggcctgttttgtccgatattcgtgaatctggatcaattgagcaggatgctgacattgttgctttcttgtatcgggatgattattatcgtgacgaagacgagtcagataatgatgataatgatggcggcggtgaagatgacgaaaatgacgttggtgaagttgaagtcattattgagaaaaaccgttcaggtcctcggggaactgttaaacttttatttgttaaatcgtataataaattctcatcaatatcatacgcggatgcatcataagcgattcattcgaaatagccaacgaaccgtgttaggatacacaaaaggactgagatctactcagtccttttgatttgctgtcatttatgcaaaaaaataacaatcacggcttttaatagcagcgtgattgttatttaaatggtatgtaatagtgggcagtcaggggctcgaaccctggacccacggattaagagtccgttgctctaccaactgagctaactgcccatcactaaccgacttaaatataatagcatatggaaaaaatatttgcaacctgtgtttgaagtttttttagaaagaagggagcatagtcacaaattaaagggactcgtatttaataaaaaagataattttataccaaaataatatggctgagacttacagtttgggcatttcttaaagaaaatcacagctgtgttataatagcaacatgttggcgtgtgcacatttttaaaaataacaatacgaaaatccatgttaggagaattgttaatggcaaagaaaatattagtcgtagacgatgaaaaaccaatcgtcgacattgaaaaatttaatttaaccaaagaaggctacgaagtattcgttgcttatgatggtgaagaagcattaaaacaagttaaagaagttgatccagacctcatcattctggatttgatgctacctaaaattgatggccttgaggttgctcgagaggttagaaaaacaaaggacactccaatcattatggtaactgccaaggactctgagttagataaagttctggggttggagcttggtgctgatgactatgtgactaaacccttctcaaatcgtgaattggttgcgcgagttaaagctaatctgcggcgccagggaacctctaataacagcgggtcaaatgaaaatgacgaaaacaaagatatcaaaattggtgatttggtaattcatccagaagcctactcagtttctaaacgtggtgaaaatattgagttaacgcatcgggaatttgaattacttcactatttggcacaacatattggtcaagtaatgacccgtgaacatttattgcaaaccgtttggggatatgattattttggagatgttcgaacggttgacgttactgttcgtcgacttcgtgaaaaggttgaggatagtccaagccacccaacttggttagtaactcgacgaggtgttggatattatctaaggaacccagaaagtgatcaagcataggacttttagaaacaatgaatgtaagaggtaatagctggttgtgaataatcgaattaagttttaccaatcaatcaaattcaaaatagcgctggttttcgcccttgtattattagtaacgcttgaaatcgttggggctgtttttgtgaggcaattggaacatcaaaatctaacaacgtttaaaaatcagattcaattacaaacctacgtcagtaattctctaaaaacagaactttcccgtcgaaatgaatcagctgctaactctcgaattagagcaatcttgaacgactcgggaagcagtagctctgcgcaaatccaagtgattgataataaagggacaattcgaggaaccaatcaaattaataatcaggctatcgttggccaaaaaacgactgataatgacgttaagaatgcgatttatagtagtcaaaaagttgagaagaatacctatgattcatcaagtaatacgcggtattacacctcaattaggccgttgattaaaggatccggaaataacagtacgttagttggagttgtttatacaaaagccaacttggacaatgtttatcaaagtattagcagtgtgaccgtgatttacttatttgcggcttcgatagcgattattttaggtctattaatctcgattgtgatttccagggcgattactcgaccaattgaagaaatgaagaaacaaactatccgaattgctcgtggcgattattctggtcaagttcacgtttacggaaatgatgaactaggtcaattagccagcgcagttaacaacttgtcagttagggttgaggagtcacatgaatcaaccgaatccgagcgtcgaagactggactcggttttagctaacatgaccgatggtgtgcttgctacggatcgacgggggaacgtcattattattaatgacacggcagccagttttcttgatttggatgagaatcaggcaatgggtcagtcaattttagatgtgttagatattcgtaaggattacagtctgcgtgacttgttggaaaaaccggacgaactgattcttgatttttcaagtgacgatcacagtcttatcttacatgcccatttttcattaattcagcgtgaatcgggttttattagtggtttggtttgcgttttgcgtgatattactgaacaacaacgaattgatcaggatcgtaaacaatttgtttccaatgtttctcatgagttaagaaccccattaacaagtgttcgttcttatattgaagcccttcatgatggtgcttggaaggatcctaaattagctcctaagtttttgaaagttactcaggatgaaacagatcgaatgattcggatgattaatgatttactgacattgtcacggatggattccggaactcaaaaaatggaagttgaacttgttaatattaatgagttatttaactatgtcttaaatcgatttgacatgatcttaaaaaaggatgatcatcctgagaaaacatacaagatcaaacgttactttacaaagcgggatctttgggttgatttggatacggaccggtttactcaagttcttgataacttgatgaacaacgcaattaaatattcacctgatggcggtgcgattacctgccgcttgtatgaaactcgaaataaagttattttaagcatcagtgaccaaggtttaggaattccccgtaaggatattccccatatttttgatcggttctatcgggttgataaggcccgttctcgtcaacaaggtggcagtggcttgggattagctatttccaaagaggttgttgaagccttgcatggccaactttgggctgaaagtgttgaaggcaaaggatcaacattctatattgccttaccttatgaaccgctagaagaggaggacttatgggatgaagtttagtagatacctgataccaatcgcactaaccatcgcggtggttgttagcctgacgctttctgttgttttatggaccaatccagctaactatcgaagtaaacaaaattcagaacagaatccgcaaactgaacagttaagtaaaccgaagagttacgtgtatacgccaattcaggcagttcatactaattcggatggtacccaggaaattttggttaaccggttggtcaacgcggttaccgaaattaaaaaaacgatgcagggttatcatgatgctaaaattaaaaccttaagtcgtgattcgcaaactaagtatttaaatatcgccaatcgaccggattcaattatgttgaattactccagtccggtgtcaattaaagtcgttaatcaaatcgttaatcatcggtttaaaaattttcccaatcacactgttaatcggattgttttaccaactaataattcaacgaaactgtatttattaaatgataagaattttgcagtgtatcaagttagtgttcaacaccacgatttaaagagtttgaacaaagtgttggacatgaatattcgaaccattcctgcatcattacgcttatttaacaagcaaccaatggtttatgtggatgattcggttcaaatgcaaccctataagtatttagttgatcgacagtcacaggattactttgtaagtcgactgatgaataacgaagaatcacaaaatgttactgctaaacgacgtcgaaatctgctaatttatagcgatcaaaattcactgcagctaacgtttaattcgcaaacccgaatggtagaattttctgattatcgaactaataaggatcagcgagcaattacgtcagttctcaataattcttacaaagatttggtcaagttgggattgccgttggataacgtgcgtttcttccgctatgataccaaaacccgaacagtgatgtatcgaacctttgttgaaggattcccgatctttagagcgaatggttttgggactatttcaaccaggattatgaattcgagtgccaaacgattgaacttttcactggataacccagaagtaccaattccaagtaaacgtggttacacaaccctaccagcaactgaggtggttattagacgattagttgcccgtggatacaagaccaaagatattcaacaaatgcgaattggttacggttggcagaaagataaggagtcacagctgctgattaatcttattcctgattggtatatttattacaataatcaatggcatagttatacatctctaatgaatcaatactagaagagaggggggagccaattgaactttagacgaattgaattaattttcttggtcacatttattgcgattgatatttttctttttgggatgtttgagcagaatacaaatcaacaggccgacaacatgtcggatggagactctgattcacaagttgttaaggaaatgcgagacgaccagattgaggtgagtcacttatccgagaagaaaaactttgcctattatctgtcagggacccaaaatgatattttacgacaacaaatggggcagttagctaatcagactccccactatgtcagccacgaactggaaagcgagtttaaagaaccggtgacggttaataaaacaacgccgcagaaatcaattaatcagatgttaaatgatccaacgtttgttcttaatggcggtcagtattcttacagtaagaatctttcaacctccaggaatcttgtttacagtcaaaaggcaatggggagttcaatttattctagtgaggcccaaattagttttactttgaatgccaatcatcaaattgttagttatacgcagtcatatcttcaggatgttaaaagcttacgagaaaaatcagagacaatttcggaaactcgtgctttaatatggttgtatcaatataacgaaattccaaacaatactaaaattgcttggacgaaattgggatatacgaagctattgtcgattgataacgaccgggtcttcattccaacttggattattggtattaagccacaaaactctccagaaatccaattgaagaagattaatgcatttactggtggtattatcaaagagacaactggaaatctaaaggatagtcaggacttatctgacttaactaattaatgttgggaagaagaacgatcatgaataatgatgaaatgcaaattagtgtgcttgccagtggtagtaccggtaatgtcacatatgttgagacaccacagcataagattctgttggatgctggtttaagcggtaaaaaaatcgcgaacctcatgaagtcaattgatcgcgatattaacgatgtcgatacgttgcttgtgacacatgagcattctgatcatcgtcagagtgtgggtgttttggcaaggcgctataatttaaacgtttatgccaaccaaggaacttgggatgcaatgagttctaaaattggcaaagttcctgaggatgagaaaaacatttttccgcccgacacagttatggactttggtgatattgatattgaaagcttttcagtttctcatgatgctgcagagccccaattttacgtgtttcatcatcggaataaatcgtttgtggttctcacagatactggttatgtttcagaccggatggaaggcgtgattaaagatgccgacggttatttattggaatgcaatcatgatattgaaatgctggaaaacggtgagtattcatggccgttgaaacagcgaattcttagcgaccagggtcatttatcaaatgaagatggtgcgaatacaatgttagacgtggttggtcatcgaaccaagaagatattcttaggtcatcggagtcagcacaataacatgaaatcgctttgccatttgaccgttgcgtcaattttagcggatcatgacatgggtgtggggagcgattttaaattgtatgatactgaaccagaaattgcctcaccgttgatgattatttgagggattagcgaaagaatctttaaacacgatattattacttggtgttattctacaagttaatagagggctggggcaacggaaaatttgttctggtcctttttggctagtaagattgaattaatggataagcatgattgattcttgttatccagtatcaattttgaaaaattataaaagatcctttaaactttcctaagatattaatcacacatttttcaagaaaaaagtttattataaaactaagaatatataagggggaacactaatttggcacaaaaaaatggttttggaaaaattattgtaactgctgtagtggccggtgcactaggtggcggaattacgtatggcggtgtttcgtatttcaacagtaacaacaatagtaccgggacagaattaatttctggcagtaataaaaatggtaataccaagatcagcaatgtgaaagtgaacctcaatactcaggcagaaaaagcgtttaatgcaactaagagtacggtcgtttccgttattaatcttcaacgtgaaagctctggtgataatagcttagctggcattctcggtggtttggaaggcggctccagttcttcaggaagttcaaaaaagagcggtgaattacaggcttccagtgaaggctcgggtgttatttacaaaaagagcggaaacactgcttatatcgtcaccaataatcacgttgtttcaggtgcgaatgctttggaaattatcttaaatgatggatcgaaagtttctgctaaagttgttggtaaggatgccgttactgatctagccgttattaaaattaactccaataaaatcaataaagtagcgacctttggtgattctgataacattaaggttgccgaaccggttctggcaattggatcgccacttggttctcaatatgccacttcggttactcagggaattatttcagcgaagaaacgagaggtaccgcaaacctctgagtctggacaacaagttggtaacgcaacggttattcagaccgatgcagccattaatcctgggaactcaggtggtccattaattaactttgccggccaagttgtcggaattaattcgatgaaattagcgcaggatcagcagggaaccagcgttgaagggatgggctttgcgattccaagtaacgaagtcgtgacgattattaaccaattaatcaaaaatggtcaggttgtccgaccagcgcttggaattggctacaccgatctttccaatatttcagaacaacagcaacgctcaattttgaaggttcctaaggatgttacctcaggtgcggttgttctccaagttaatgctaattcacctgctaaacgcgcagggattaagaaatatgacgtcattaccgagttggatggtactaagattactgaacagagtcagcttcgcgatattctgtataagcataaggttggcgataccatttcagtcacttattatcaaaaaggtaagaaagaaactggtaagattacattgaaccaaaaagcaaccagcaaggtattaagtgaagcaagtaaataaatagtgatttttaagtgcttttaaggctgcttatgctagttaagtccgattagaaacccgattgtttggtttctaatcggactttttttcagttgggtctgaagtgatctaaaggtttgaagttaccggtttctacgggtgcactgtagccgacgctgaatatcgggaataaagaaactgaacaatcataactacctaacttaacggtatgttttgtttccgaacgagtcaattaaagtaagcccttttttatgactattcgatatcagatccgaacttagctattaattttgcaagtaaaattcagttaagaacagagatgatcaggtttatacacattaggcctgtggataagtctgtggacaatccacaagctacttgtaaaatagtggtagattagctgttagaagttgtccactaaatgccaaaagttatccacagttttgtggataactttttttcaagaaaaatattactttgttcagaactatagatgctgttataatagggtttgcgtagttggattgcgaacacatgttgttcacaattttgtggataagtattttggcccttgacattttagcaaaaaatgcgggtgagtaaaaaaatggttattcacataaacctgtggataagtttgtggataacttgtttataagcaccattttttacacaggaaaccaaaaattttggaggacttgatccggtgaatatcaaattagtcgttgttggtaaattaaaagagacctattttagacaaggaattgcggaatacgcgaaacggttatcgcgtttttgtaagttcaagattgtgggagttgccgatgaaaaggcacccgaatctctaagtcaggctgaaatggatgacgtgatggataaagaaggttcgcggattttagacaagataaaagatcgcgaatacgtatatgcgctcgcgatcttgggaaaagagcggtcgtctgaagcctttgccaaagaaatcgctgacctcacaacctatggccattccgatattacgttcgtgattggtgggtcgttgggattgtcaaaacacgtgttggatcgtgctgatacccaaatttcgtttggaaagtttacgttgcctcatcagctaatgagattagtgttgactgagcagatctatcgggcatttatgattaatgagggtagcccataccataagtagaaatgatttgccggaaattgttattaagcttttaggttttattatcaaggtattgaataacagatgaatacccttgggaagcatcgttagtcgctaaaccaaggttcaataactgcaactgatttgcgatcaaaattaatttggcatttcaatccatatggaataatggttcgcggataactgtgaccaaagtttaggttaaatagaattggcgtatgcaggtcttcggtaacagctaatagttgttgtttgtaggattcgtagtaggtattatcttggggtttgccgacaataatggccgaaacggcagatagtacgcccacttccttgagtttcaaaagcatttgtctgtaaagtgttggggaagggcgttcctcactggtttcgataaacagaattttgtcctgccaatcttctttagatgggaatagatgatatttttctgcgattggtttttcgtcaggataacggttacctgctaaaatgtcgtagaagctgtcgatacagccaccgagaagggcgccggttatcttgcctgaaccacgtaagacttcgtaacccttcgtttcaaaatgttgaattcggggagttcctaaagcagatggcgaaaaatcagttcgttcttcataccagagtggactggatttgatttcggtgggtgattgattattaaagaagttttgaaaagcgtgcttagtatacggtagcattaccggaccaagttcggctaagtcatttaagaaatttgggccataaaagcttgtcatgccaagttgatagaacattagatgattaatcgttgtatcggaaaaaccagtaaacagtttgggggaagtttgcaccgcccgaataaagtccgaatcattcagcaagtatggtaataagcgataggtatcatcgccaccgataacgcagataattcctttaattgattggtccaaaaaagcagtttttaaatcttgagcccgcgcttcgggatggtcttgtagaaattttagaccctttaaagcgttgggcatgatgactggattgagtttaaacgatttaagacgtttagttcctaattttagctgatgtttggcactgatttcacccaatatgccaccggaaaggctaacgattgcaaccttatcgccaggatgaagccgattgggcttgatcatgagaattcctccttgcttgtcaaaattaagtttcattataaggctttaatgtttcactaacaatggcgggttgtccttgttcggctgatttgctatacttttaactattaaaatggcgatgacgttcgcccttactcagtagtgtgaacacacaatgagttgatgacgtctactttaacggttgttaaggtaggcgttttttatttttgaaaggagaacggatcatgagtagattcaattggcaagatatcgggcagtttgtcgcaatttttattggcggcgcaattggcggcgtagggcgttatgaactcagtaattatttgaatgagtttaaccaatttgcaggaacgacggccgttaatttgattggctgctttttaatggccattatgatttatgggatttcaatgcggtttgatttaccggaatggttgatgctggggttgggaaccggtgtgattggcggttttactacgttttctgccctgatgttggcatttatcactaattatcagcaacacatcattggtgtttttgtttttctgactttaaatttaattggcggttttttaatggccttatttggctatttgtccgctaaatggattaatcgggggcgagggttatggtcatgattggcctggttgctttaggagccggaattggctctgctttgagatatatcattacccttgttggtaaacgactgtggccgaaaatgcccttggcaacctggctgattaatattagtggggcgtttttagcggggctggtcgttggaattcatcccaatcaactactgacggtgtttttggttaccggaatctgcggcggatttacaacattttcgactttcacgatggatacgtttatcttaatcaagaatagtcaatatcgggtagttgctatttattatctcggatcgactttctttggaattggtgcgatttgtctcggattgtggttcggtaacctggcaacttaatcgcaattttgttggcaacacggtttgccgtataattaacctattatgtttacaaaaggggtgatgatcattaacaataaacgtgcactaatcgcttggaatgggctacaaattatccttggcgctttcatctatgccgtcgcaatcaccgattttttgattccccatcaaattggcgaaggcggtgttaccggattaacaacgattggttactatgccttaaatattccaccggctttaaccaacattgtcgcaaacggcattttgattttgattggttttcgatttttggatcggcaaacagttggttattcactttgggccgtgatttggatctcgatttttttgaaactgccacgattattaaattatcacacaacgcaaaccatcatcccggcaattgcgggtggtgttctcatggggatcgcgatcggggttattttccgtggtgggggaacgatcgccggtagtacaattctggcgaagattatgaaccgctactttgggatgatgacgggttcggcaatgttgttctttgacctcattgttgccattccctcgggatttattattgggtttcaaaatatgctattaacgattgttgaactttatgttggtgcagcggttttaaatcgatttctttcaaaatttggcgcccgaaaagctgttaccattattaccaatcaaaccgaagaaattacgtatgagttatcacaacggcttaagcagggaatcacaattatcaatgccaagggctattatcatcaggaaaaacaaccaatgatttacgtgatttgtaccaataagcaggcggcgcaactcgtaccgctgatttcagaaattgatccgactgctgttgttgtcgttgatgacgtccatagtgtcaagggcgagtcaattgggaagatcctttaatagatcagatcattgaaacaaccattctatcaaaggttaacgggtaactatgctacactgacggtaaagaaaaatgtaaccgctttactatcgtttttgaatcggaggtctgcaaaatggattctttaaaactatcagatattaaaacaattgccaacattggtgccggcacaatgggtcatgcaacggctttgcaatttgcaatgtacggttatcacgtttatttattggatacgacacagaaagcattaaatcatgggcttgatttgattaaacacgatcttcaaacatttttaggtgccaatatcgttcaagctgatgaagaaacggatattttagcccggataatcccaactacagattaccagaaagcgatttcaaaggcagatttcgttattgaatcaattgttgaagatttgactgtgaaacaattagtttggcaaaaggttgaacagttcgcttctgatgagacagtttttgcaaccaacacgtccggacttagccctactgcaattcaatctaagctgcaccatccagagagattggttgttgcgcatttctggaatccagctcaattgatgcccttggtggaagttgttcccggtaatctaactaatgaagcaacgattacattgacaacagcattaatgaatcacgttggcaaacatgccattgctttgaaacgggaatctttgggatttgttggcaaccggattcaactcgcggttttacgtgaggcgtttaaaattgttaaagatggcattgctgatcctgctgcagttgatgacattattaaatatagcttgggacgtcgctggtctttggtgggaccgattgccagtgcggatctgggtggattggatgtctttaaaaatattagcagttatctatatgcggacttggcaagtgaacaggagaccgatccacttctagagaagatggttgatgaaggcagacttggtctgaaatcgggcgaaggattctttgattggcaaggtgataaaggcaaagagattgtcgcgcagcgggataaaaaattgttggacatggtgaaaagcgataaaaaattaatttaactgtttgaaatgacttggtgattgtataataaaactcattaaatctatgatgggagattcaaatatgattcatattcggccggttacgatcaacgatgcgccagctttggttaacatttattgttattacgttgagcaaaccaacattacgcttgaatacaacacaccttcgatttcagactttaagcaacgaattctttcaattaaagagaagtatccttatttagttgcggaaagtgatggccagattattggttatacgtatgcccatgattataaaggtcgggatgcctatgactggtcagttgaggtttcaatttatgttacacgtgaaacattggctaaaggagttggcaccgcactatatcaggtacttgaacatgaattaaaacggcaacacgttgtgaatgcttcagcttgtattacagcagggaacgctcgtagtgaaaagtttcatgagaagttcggctacaaacagacagcagtctttaagcactttggtttcaaaactaataagtggttggatgtcctttggatgaccaaatcgttggtcaatcagttacctaaaaagccggcaccgtttattccttatcggcaattattacaggacacagatcaatcagcatcatagttggaaaataaaccaaagagtggatcaccagtacatcgtttccggaatataaagggtgtcatcaaacaaatcaggtctaagaataactggtgacaaatttgatatagctgggaaaatacttggtggccactctttttgccttagcattcgtttttaggataacttttaacagggaagtgacgagtcttctggaaatcgctgaattgtcaatcaacatttgatataattgatacagataattgtaagcgatttcacaatatataggaggattactatgtcacatcaaccgataacaattggtaagactaacgtcacagctacacgacttgggctgggaacgaatgcagttggcggttataacctgtttccggatttaaaagatgaaactggtttggaaattgtcaaagccggccttgaacatggaattacactgttagatactgcttatgtttatggattagggcattctgaggaactggttggtcaggcgattaaaagctttgatcgtgaaaaaataacgttagcaaccaagggtgcccatgatttctcgtcgggtcaagaagtgattaataatgatcctcagtttttgattaagcaggtcgatgccagtttaaaacgattgggaacggattatttagatatttattatattcattttcctgacaaaacaacgccaaaggccgaggccgttggtgcgttgcagaagttaaggaaacagggaaaaatcaaggcaattggattgtcgaattttagcctggcgcagattaaggaagctaatacggatggctatgttgacgttgttgaagatgaattcagcctacttcaccaggatcacgcagttgagatgatgccatatctgaaagaaaaccagatcagttttatcccatattttccactggcatccggattgctgacaggaaaatatgatcagaatgttaaattttcagatgatgatattcgcagtcaaattgccgattttcaagagccacggtattcaaaagctttagctgccgttgaacaggtccgaccaattgcaagggatcatcacgcgacagttgctcagattatattagcgtggtatatgaaaaatccgttaattagtgttgtcattcccggagccaaaaagccggatcaagttattgcaaatgctaaagcaatgcggatagcattgaatgattcagaatatcagaccattgataccgcgtttgcagactttaaaaaagtaaagagcggcaaatcgttggctgatcctgagtaataaataaaacgaacattattattctcgatgaatgtgaatgccttttacttgaatcatgtagttgcgatctattaacctaggatcgtagttaaaatttagcttttagtgaaaggatgattctaagtgaaaattggattgattggtgctggtcatatcggtagtaatcttgctcgcttggcggttaaacacggtcatgatgtcatcatcagcaactctcgcgacccgaagacgttgcagaatttggtgacagaacttggaccacatgcgaaagcggcctgggcaaaagatgcggcagctcaaggggatattgtggttgtcacaatcccgctcaaaaattatcaaagcgtaccagttgagccattgaagggcaaaattgtgattgatacgatgaactattatccaacgcgggatggtcaaattgtcgctttggataatggcaccagtacgactagtgaacttcttcaggctcatttaccagaatcaaacgttgttaaagcatttaattcaatttttgccagtgatttgctttcgactgcggcatcaaaggacgatcctaaccgacgaacattaccaattgctggtaatgaccctgaggctaaaaccgttgttagtcatttaattgatcaatttggttttgatacttatgatgttgggcagttgcacgaggggttccgatttcaaaatggcaccccagcctatacgattcgcgctaatcgggatcagttaatttcggcattaaataaggcttaataataaggtttagatataataaagaggctgagacaatagtcgttatgcccagtctctgttagtgtaaacacgattattaccaagtaaaaacgcgggacaaaaggcaacttccggccgtgtaaccgaattatccaaatattcaaattcagaatattcggataatccgattacactctggaagttaagcgccttttgtcccgctctgtttttgatatagaaccgattcaatgacaaaaattacttccgccattcccaagccataaccatttccatgattgccattacgaccatggtgccaccaaacaatcgcaaaacgaccaggatggtaatgtatgggttaaatgctaagatcgcgccaacgacagcaagtaaaacaccatagataataaatggaatgggtgatacatttacaaattgccgattactaattgactggacgatccgggtaatgcccaagaccattaaagtgattcccaagacgatcggcaagaatgccaacaatggtttagctaaaatcataataattgcggcgatgatcagttgaagaatgccaaccggtaaaccgaatccgggatcatcaatccggttgcgttgccacagataaccaatgatattgatcacaccgaacgcggccacaaatgaagctaatgtgataataaaaatatccaacgttgcgtccggttcaaataggaagaacaatccaaaaatgatgtaaagcaagcttttaatccaaacatattttcgaatttggttaatgaatttgttcaaaccaagcacccccaatttaaattgcaaatcagccacgtcatcatttggaaaggctgttttacaacttccaattttaatggtagttggtaattcgtgagcattaaccaactgctgtatcatcttaattttacgagaaaaaatggtaaaacaacagtcttttgtttctgattggtacttttttcagaaagccatcaggaagggacacagccaatctttgaaatatcggcagttttatcaaggattcatagtcgggtcattgataaagttgccgatactaagggggcatcagcttaattggagaagaaaatctaaaattgattataatctctaacttgcgtcaaaatagctattttagaacttccctactgaacttaaatattggaataactaatagtgataggaatggtaaccatatcatgctgtcgtaaacctttaaaaaggcatgatttaattgttgctttaaatgatgtttaatttgattaatgacgagttggatttgcccgttcaaattgattgcctttttatgaacctgctgctgcaccgcctgtgaaacagctatctttaactgatgcttaactgacagagggactttggataccggcacttttattttctggctcactatttgtagtttgtggtgatagactttctgagataaacgctgggttgtttcccgtgaaacatgaatggaattgaatttgacactatggttactttcagtcacgttggtattcttaggattcaactttttctgcaatcggtgttgaactgctgctttacttttagctggtagggataacgctgtcacttgcccttcgctataaataagtgttttttgtttggcagaatcgatattatttgaaaggatcgtcataaagacagcaattgccaaaaccatcccaacttgacgaaggacgttggcgacactttgggagtcggtcaatttactgccatgaaagtcggcaacggctaaaatatttgcggttgcggcgactaatccgtaaccaatgcccaacataatggcggcaataatcaggtcagtgtaatgatgatcgatattcattgttgccaacagatagtagctgctgccgattaagataaatcccagactaattaagactttattgttgatttttttcacaaataaagaagtgatgatcaccgatatcatgacagcaattgaatagggggtaattagtaaggccgcgtgcagctcactctcaccatgtacccgggttaaaaatgtgggaatgataatggccataccacccagaaaaaattgcacagaactaatgaaatgccggcaccgtcaaaattacgactttcaaacagggacatattaatcatcggcgattttagtcgctgttcaagtaaaataaagaggatcagcgaacaaccagccgttataaatagtccaagaataccagtagaatgccatccccaactatttcctttgatcagtcccagagaaagtgagaacagcataatgatacttaaaccggcaccaaaccaatcgattgatagggtatcttttgattcatttcgcattgataatgccagcgggtaaagcagcagatccaaaacaactaatgggacgttaatgaaaaaaacccaacgccaaccccagtattgtgagacaaatccgccgatacttggtcccaacgcaactgccagtccctgaacacccgctaatgctgccacgattttgtgccgattttgctgattactaatttcgagaccaattaccatactggtcgggatgatacttgctgccccgatgctttgaatcgttcgcgcgattaacatcaatacaagattggttgaagctccggttaaaagcgaaccaatcccaaagataattaaacccataaatacgaatttatttctgccgattttttcggcaagtcggccaaatgggataataaacgtcgcaaatacaatggtgtaaatatttaaagtccacgataagtttgttaggctaaccttgaacgccgtttgaatttccggcaggacgatcgtcataatagacacatccatcatgcacagcaagttaccgagtaacaagatgggaagtacatatttaatttgtttcatcaatatcctcctagaggcatttgcaaacaaagttgattgaaatgccacctttctaggcaatgataattgcgcaatatcatctgtcacacaaatggccgtttgctacacatgtgacagatcacctgctttttagtatactaaccctaagagaaaaaaccagcctttaacgacaagtgctacatatagctgaagacgtgacaggaaggacaatgaatttaaatgaatggaaaagaacggatggcggaacagtcacgaacatggctaatggacgccttttttgagctattgcagacgaaaccttatgaaatgatcacggtaaaggatatttctgaacgggcacaattatcaaggcgaactttttatcgtgcatttaaggataagaatgatttattaaacgtttatggcgatggattaattcgggattatattgcagcccttcaatcggttacagccgataagttgaactttgaacgggtgttaaagctcttttttaacttttggtggatcaagcgagatcgggtgcgtattttaattcatcaaaacttattcatgaatttattgaatcggatgaatccggaagcaccgcgattatacgatttatttgatgcgccttggcatattgagggcagccaacaggaaattgcctatattatgagcttttcggtcggtgggttctggaacgtgttgaatacatggctggctaaagatgatgatcaagcacaatcaccggcgttggtagcggactcactcgttcaagctttaaataagctttcacgttcgtaaggatctttttaagaaggggataaaatatgcgatatccgaatagtcatcttgcgagattcatcgatcggcccaaccgatttatttcccattgtcgcttaattgaaacaggggaggttgtgaccgttcatgttaaaaacaccggtcggacaacaattctgcagcccaatgtaacaacagcgctggttaaaagcgataatccggcccgaaaaacccaatatgatttagtggccgcaaaaaaatatgatcagttttggattaatattgattcgcaggcgcccaacaaaattgttaaaaccggtttggggaataacgtgattcaattacccggtattcaacaaattacccaagtgactcctgaggttacttttctggattccagattagacttttcaggaattggcgatcacagcaaaaagtttttcttggaagtgaaaggtgttacattggaaaaccgtggtattgcggcgtttccagacgcaccaacaacacggggattaaaacacgtgaaaactttacaaaaagcccttgacaaagggtacctgtcctatctattatttattattcagatggagaaaatcactgctatgacaattgacacagatattttcgaacccctcgctgttgagatttccaaggctcaaaaaagaggggttcacgttttagcttatgattgccaggtgacccaagattcattgaatttggatcagccggtgccatttgatttaaatcaaaaattcgtgagtgatgggttgccatcctcgattaaaaaacgacagtaaacattagagtaacaactaaagaggtaatcaattaatgcttcaaacatcaaaacaaacaccaatcaagagtccatttaacaatgccacaacggctgagaaagtgatgaagggaattgatttaagaggcaagaatgtcattgtgaccggtggatacagtggaattggactaagaacaactgaagctttagctaatgctggcgcgcatgtcattgttccggcaaggacgatttcaaaagcgcagccggttactgaacggattcgcaatgctgaactcggggttcttgatttgatggatccggcatccattgaccgatttgccgaaggatttttaaattctggtcgaccgttggatctgttgatcgaatgtgccgggattatgtttccaccattaaaccgtgatcggcgtggtaatgagtctcaattttcaactaattatttaggccattttcaattaacggctaagttgtatccggctttaaagaaggcacaaaatgcacgagtggttgtcatgtcttcacgtgcgcaaagttggaatggtgttgattttgctgatcccaattttaatgggcgtcaatatgatcctaaggtggcttatgcccaatctaaagtcgcagatgcgttatttgccgttgaattgaataaacgggctgagacagacggcgttcaagcctttgctgttcacccgggattagttcccggaaccggcttgggacgttatacaacgcataatggggcagttcgacaggcagtatcatttgtattaaatgggatgcatatgacccacttagtcaatgcccagcatgtgattcatgctaaactgcagcatcaagatgaatatgattatttcaaaacagctgatcagggagccgcaagtacgctttgggcagccacgagtccgttgttaactaataggggcggcgtattcattgaagattgtaatattagccaagaggtgtcggctgacagtgattccaaatatggtgtccgaccttggtcgattgatccacaggctgctgaaaggttatggggaattggcgaaaaattaacgggatgccgatttttggactagttattgaaactggcatcaaaacaggttaaaaaatcccacggagcgcaatcaatttgttacaatcatttcacaaagaatgacaattcagtaccaaatgacctgacccccttgaaattcaattttgacatgctaacataagcgataatgcattagtgtgagtgcatcatagtttgagttgatcgcacatttacaggtttgttggaaggaagcaacatacaaataatgataaacaaaacattgatcttcggccatcgtggctatcctcagaagtttccagaaaactcattagacggctttgcgtatgccattaatcacggaattgatggcttggaatttgatgttcatttgactaaggacaatgttccagttattatgcacgatgaaaagattgaccgaaccaccaatggaactggcgaaattcgttcgtatactttcaaagctttacgaacttttcagcttagtgatggtcaaacaatcccaaccttaaaagaattacttgatcttgctgaaaataagccggttcatttaaacttggaatttaagacaaatgaaattcactatcccaatattgaacagattgtccttgatatggtgaaaaattacgatttggtttatcctgtgatctactcatcatttaacttggattcactcaaggtggcttataaaattgatccaacgcagcagtattgcttacttgctgatcacgatattaagaatccacgtgatctaatggctaaggaacatttggccgggttgcatttgagccattatcaacctttgagaaacgttaaagaacggatttggaccgttgatgatcccaagaaacagaaagctttgttaagccaaaatgttgccggtatttttaccgatgactttgaatctgctgaacaggtggcaagttcattggcttagctgtttaaccgattaatatttaagtattgtttgaagtaaaatagttggtgtcgtttctggcactggctattttttatgttgcggtagaagagcttgttgtttgacgtataataaaaatatcttttggatatctggaggggtattatgaaaaaactgataatctcgttattatgttttggtggattactatttggtggtgtaataaatccgcagtcatcacacgcagccgcttattctttaaaagtttttccaaaggtattgcggcatacttggtatcattatgatggtcatggcaggtatgatcaaattacatttggctataagcattatcgaatgcataatttctatgaaaagtgggatgtttatcacggcaaaatccattatcgtaatttgaaggcaacgcgaattagtcatcaccctaattggacttttgcaacgccggtttactaccaccggatgcattggactaacatatatgggtggaaccaaagtgctggtggggcagatatttggacagattcccattattatgcaaccagaaaagttgccaaggcattggggaataaacattttccaggtgttttatactatcctaaaatttaggtcatgataagttgataaaaaaatagagagtgggacgaaaggcggtaacttccagagtgtaataatcgtgattacacaaaacgggactgggacaaaatcgcttttgtcccagcccctatcactatttagtaagtatttaaaaggagattattcttttatttgcttgctgatgcgttagcagtcttggtgcttgaagatgttgatgctggtgttttagcaggtgtcgttgtgggtgtcttgactgaagattgttgcttatcaacgactttgcccttggcatcataataggcttttgcataagcaacttgggcaaccgtatttgtactataatccggattataggctttaccagccgcaaaatctttcgttgcttgagcttgagccttattggtgataaaggtattgtcaaggttagtacccttggcatcataataagtttgcgcatagacggtttgacctaaagtgtcattactataattagggttgtactccttaccgttttgatagtcggtttgggcttgtgtagtggcgtcatcaatgactttgcccttggcgttataataggcttccgcataagcaacttgggcaactgtatttgtactgtaagtcggatcataggctttgccagccgcaaaatcctgtgctgcttgggtttgggcccgatcggtaatgaagtcgttgtcaagatcactacccttggcaccataataagtttgtgcataaacggtttgaccgacactgttgttgctataattaggattgtagctcttaccgttttgataatctgtttgggcttgtttaatcgctgcatcaacgactttacccttagcggcatagtaagcttgggcatatgctacttgtgctgcactgtcgctactgtaattagcgttgtaatccttcccggcagcgaaatccttttctgcctgagatttggcaattgtagccggatcagttggtgttaccggagtagtcggtgttgaactggaactactggatgacccaggtgttgtagctgtagaattatttgaggctgccggagtcgatgaattgttatctgaggagctggagcttgttggggtggaacttgatgttggcgttgttgtggtggtttgggttgatgttgttgcggttaccttagccttgttgattttgccaaacctgacgttctttttattcacccaaccagagattgattttgcattaacatgtgctttaacgtaataatagatggtgccaccctttacctccatgtggcggtatgtatagaaagtggtatgtttatagttgttcatattgtgaactttcttaactttttttgcagtcttatatggatgatttaacaggacagatttgttgtttttgtagtgaacagcatatttcttggcggttggtttattccataatacataatgagaataggaagttgttttggcagaagcggttgcagcgccaaaacctcccagcatcgttaaagcagctaatgatgatagtgcaagttgattgattcttttcataaaagatccctccagatagttattatttcggtgtttccctcaataagacggataaaataaaattgacttttagttaagtcaacaagttgaaacatacttttgactatcatcttctttcctatttttattaatagttatcaaaaaagccaggccaaagaaattgatgacaaaccaccctaagtagggcaagatggatttaggaatgcagttatccattgctgaattcatctctcagctttaatgactaatagtttgacaggtaattcattctcttaagaagcggacgatgcttatctaacagcttaattttccgtttaagcagaccaattccgttaacggttttgattgatgtctcaccatctctcaaaacataatctgaattggtaaagctaacctgtcttttttatcatttgagtatccttaacgtattgagtttaaattatcaataaaaggagtgaaagacaatttttattgattaaaaaataaatttggttatctatgataatagtctgaggcttaagccggatgttgaggggaaccaaatccctcgtgtatgtttccagaattttagcatcaagcggtctttatgatgccacttgtttaaataccaagtaccatcgggattttcaccgctaatttttcaatcgttttcagaatagtgatacctaacgatgaacagtttaggttgatgaccgactgctaaaaattttttctcgaaacaccttggctagcggactatttgtgtccattttgataaccagcaacgtcaacagcgtcgatttatgatttgaagccattgcgtgttttgcttttcatttggtgttattcaaatatcttttaatgggacagatgttttagtttcacggtcacgcttttcctgaatttggccattgctgataataactaaatcaatcctgagagcaaagcggcgtatggctattgattgcacaacctttttgaggcggattctttttcacgatatcccacaattttcgacaggtaaactaaaggtctttgatacagttccaataatattacaaaaaggagtgaatgacaacgaaaaaccgaaaaaaaaataataaatttcgtaaagcttcgccgttatatactcttggacttgatatcggcactacttctgttgggttcactgctgttgatgaagcgcagcgacctatgcgtgcaaaagggaagacagtgattggtgtgcggctctttcaagaaggtcagtcagccgttggtcgaaagaatttccgaacgacccgccggcgattgaaacgacgccggcgacgtctcaacttacttaagcagttttttagtgcacctttgagaaaaattgatcctactttttttaagcgtttgaaagcttcaagtttatcgcctgcagataagcggcgatatttggcaccggggttgtttccaaatggtggcgacatcaagttttatcaaaaatatccgacaatttatcatttgagactggcactgatgactgaaaagcggccatttgaccttcgcgaagtgtatttagcgattcatcatattgtcaaatatcgtggaaactttttaaatccactaccggtttcagcttttagaggtcgaaaccagcgttttgaagatcagttttctgaattaaatcagctatacaaatcgttagagggcgagtcgccatttcaatttgatgaaaaaattttttccgagttggacaagcaacttttagttaatgacggtcgaaaaatcgatcgccaaaaacaactggcaaaaaaggggttcacaaagacaaatgaaaaagggattgatgcccatcatcaaaaaatttcgtcagcgttttcaaaggctgttttcggctataagtttcggccggatgtgctcttaaatagtgatcctaataaatcaattgacgaatttattaaatttggggatgaagattttgatgataaactggtcatcttacgcgagtcacttaatgccacgcaaaaagaaattttggctgtcacccaacgaatttattcgcagatcatccttaatgaaatagtcccaagtcgagcaactttatctgaagcaatggttagtcgttatcaaaaacaccattctgacttgcaattgctgactgaggcctgcaaaaagatgaccaaagataaggcggcgcggattcaagcagcctatacagactacattggtaaaggggacggacataagctagttcacgatcagtttgttgcacttattaaaaagaatttggacccgtcggaagaagggcgggatttggcagaacggttggctcaggatgactttatgccactgcaacgaacggctttaaatcgggttattccgcatcagcttcaacaggaagaattggaccggattattgaaaatcagggcgagtactatccttttctaaaaacgttaaatcccaatcgttcacgagctggggttgccaactatcagttggacgagttggtgagttttcgcattccgtattatgttggtccgttgatcacggcaactgatcagctgcatacttccggagccaaatttgcgtggatgacgcgtcgggctgccggagaaatcacgccgtggaactttgatcaaaaagttgatcggcttgcttcagcaaatcagtttattcgtcaaaatatgcctaaggataatcatttgcttgaggctgacgttttaccggccaatagtttgacttatcaacggtacctggttttggatgagttgaatgctgttaaggtaaaccataagtcattgacggtttcacaaaagcagcgcatctttaatgacttgtttaaaaggcaaagaacagtgacggttctaaatcttcaaaattatttaaagtcgattgaaaagctgccgacacttccggtaattaccggagtctctgatagtgagcgttttaaaacaaccttatcaacctatcttgattttaaaaacatttttggtggtaaagtggatgattcctcccagaaagagaaatttgaaaagattattttatatgcgactatttttgaagatcatgctgtttataaagccaagttggatcagatcgattggctagggcaacagcaaaaaacggatcttctttctaagaattatcaagggtggggacaactttctgaaaagctcttattaggattaaaaaatcaagccggtcaatcaattctggatgaactttggcaaacaaataaacggtttcgggaaataatgaatgaagctcattttgcgaaacaaatcatggcatccaatgcggccctattgagaaaaaaagggcttgatgatgttttatccaccgcgtttctatcaccccaaaataagaaagcaattcggcagacggtcgaagttgttgacgacattgtgaaggcaatcgggtgcccacctcagaaaatatcgttgcatttttccaaagcacctgccgatgcaattcgacatgagcgggataatgccaatatcattcttcgaacatatcgaaatttacctgccaaaatggtggatgaccaattaaaagctgaattacaggcaacggcggaaaagcatcaggtgttgtcggacaagttgtacctgtactttactcagcttggccgggacttatacactggtgaaatgcttaaaatgagtgagttggaaaatgatatgattgatcatattatgccccaaacgtttgcttacgatgattcggttaataaccgtgtgttggtgtctcaaaaccattcgtcacaattggggaagacgtctggcgaaaaatctgatgccaagatgattcggttttggcaagtgctgcgcgacaataaattgattagcgaacagaagtatcaaaatctaactttggactctgatcatttatctaagtcgacccgtgaacaattgttgaatcgctacctggtcgaaaagaatccgattacgcagtgggttgccagtgtcttaaccgaaaagtatggtgataatgggactcgggttttaacaattaatccaagaatggtttatcaaatgcgacgccaatttaatttggttaatttgcctgaagttaatgattatgatcacggtcttgatgcttatttggcggcgtttattggaaactatgtggatcgccgatatccgcggttgcgatcctactttgtctatggtgattttagttcatccaaagagattgcttttagactcaatcggttcaactttttgtttgacttagggcaggctgaaccgaatgagttggcggattgggaaaccggtgaaatgatttgggataaggcagcggcaaacagtgtgttgcgtgacgtataccaatataaattcatgttgatctctcaggcggtttactctcggcagggtgcgatgtttaatcaaacaatttatccggcaagtcaagctgctggacgacagttgattcccgttaagaaaaatcgggcaaccaagctttatggtggctacagtggtaatgttgatgcatatctggctattgtgcgcttgggtggtccaaaatccgatcagtacagagtagttgggattccaacgagaatggtgggtcgcttgcaaagcgcgatgaaacaaggggccgatacttatgccaatacgttgcataaaatccttcagccgcagtttaccaagcgaaagaaaaatcgtcagacaggttattatgaagaaacaactgaaccctttgcggttattctggataaagtttattatcggcagttgattattgatggtcagcagaagttcatgctgggaagttccacctatcaatttaatgccaagcaactggtactgtcttcaagggcgcgacaaatattgagtggtgaagaacggttaaccgatgaaaatggcagtcaggatttgattgatgtttatgatgaaattttaaccaaaatcgatcgttattttgaattgtatgatcaacgacacttcaggcaatcgctgcatgacggcaggaagcaattcatttctttgccaattcacaatgtttatcgtgccaaccggctgattgaacacggaaagtacgaaacattatctcagattttgaatggtctccatgctaacacgatgatgaccaatttacgttatctggggatttcgtctccatttggtaaatttcagtcgcccaatgggattaaactatccaaggatgcggtcttggtttaccaatcaccaagtggcttgtttgaaagaagagttcgcttgcgagatctttaatggtggtgctattgaagcctttgattgaacatgtaggcatgataaaataagaagtagaccttttcgacagagaaatgattcaaaagttttgccctgtcgaggagtgagttttagcgttaagtcagattaatgaggataaacttacttcaataaacagtggtccttagcgtcacggtttattaaaggttagaatcagaggctgggacaatgtcatttgtcccagcctctattcgtgtaaacacgattgttaccgagcaaaaacgcgggacaaaaggcaacttccggccgcgtaaccgaattatccaaatattcaagttcagaatattcgaataatccggttacactctggaagttaagcaccttttgtcccgctctggttcgttatgtaggcccatataatgggtcagaaagttaaactcgataaaactatcttgcttgattttaagttgttaagtcagattaataaggacaaatcttagttaaatattaagctaaaatgttacggaattcaagcaaagttgggccggcaatcaggaactttctgtttaagtctgggtcaaattcgagtatatttatttaaacgagtgccgggttttatcaattgttaattgaattaataagatgagtggccccaaaagtgcctttaataggctggttgctaacgtgaggacaatgcccaattgatcatcgcggcgtttaatatcttcaaacatgagttcattatgtattttttcacgattggttaagtaatggtgttgatactgactttgatgattttctgcttttagcttttttagtgaggcttggccgagtgacacgtttttgacaaagaaatgttgagatgtgactaattttatttgggaaatggctgataagagcagccaaatgttaaaccagtttaaggttggccgaaatcggtatcgacaatccaggctaacaaaaatgaacaaaatcaaaatgattcctaattgccaaagtaggtaaaagcaagttttgattttcatattatcctccctatttgttggataaagaaactaataacgaagcctttttagatgattaagttgggtggctcaggtaaacgggtcatcaactttgataaatattttgcctttaattataaatgatattttcaagaaataaatagtaatcgataaaatgattatcgacgtagtaacggcgataccagtcaaaatgtgaaataaaaaccagctatcgaaccatgtaagcgtgtcgatggcggatagtggaatggcgcgatattcctcagccaaaacgtgcaaagtaaccgcagcttccggccatataagccccacaaacaatattcccaaaccaggaatattgtttgtggggcttatattctggaagctaaccgcggttctttgcactctttttacattagatttacattccttcaaccaacaatttacattcacctgcaacaatgaaaatgtacttaaataaaacaagttgaggtgagatatttgtcaattacattaagaaatatccgtaaagattacgaccaaaacaccgaagttctcaaagatgtctcggttaaagttgaaacgggagagttcttcgttattgttggcccttctggttgtggtaagagtacgttgcttcgaatgattgcaggtttaacaccgattactggtggtgaagttcaaattgacgatcaagttgttaatgagttgcctccaaaagcacgaaagttaacaatggtttttcaaaattatgctttgtacccatttctaagtgtttgggataacgttgcgtttggtttaaaagcacgaaagctcgacagtgctgatattaagcaacgggttgataatgcactgaagatggttagtttaacaaagttgcgaaaacgaaagcctcgtgaattatccggtgggcagcgtcaacgagtggcattggctcgggcagttgccagtgatgccaagatttgcctgatggatgaaccattatctaacttggatgcccagctgcgaattaagatgcgtcaggaaatttatgctttgcaacggaaactgggtttaactttgatttatgtcacccatgaccaggttgaggcaatgacgatggccgaccacattatggtgttgcatgacaaacatgttcaacagattggtacgccatcagaaatttatcagacaccggcaaatgactttgttgccaaattcttcgggacaccacaaattaacattttgccggctaaacgatctgccgataatgatcatatcttaaatgtttcctctgatttggaaattgcccttaatcaaccagtgcctgctgagaaccttaaaattggtgttcgtcccgacgactttaaaattgaacgggctgatggtgtcagttcaaatgcggttgtgaaaaatactgagttcttggggaatgaaacgattgtttatgccacgatgaatagcgggagcgacattcacgttgtcgttgacggtcaggttgcctttagaagctacgaaccggtgaaagtaacggctagttcaaaattgctgttctttgatcaaaatggtaaccggattaacttagcaaaggaggccttggtacatgcttaaatcaccagcgtccagtcaaacaaaaccactggcagttaaccaaacaaagcagagaacaaaaacaacctttgctttaaacgcgaaggataagtattacgcttggatatttttgggcccatcattattaattttaagcgtctttattttctatccaatgatcaagacgttgtatctgagcttattcttaaccaatacggttggcaaaccaactgtttttgttggcttgtcaaattacattagtttgctgacatcagctgattatttatcaagtttaggggtcacaatggtttacgttttcgcggttacaattttaaccattgcgatcggattagttttggctaattacgctagtaaagagttagctggaattgggatttttagaacattattctcggcaaccatgggtgtttcagtatctgttgccgccatcttctggctatttattttcaatccgtcgactggtttcctatcactaatcagtacgtggctgcatttaccacaaatcggttggttgactgatccgacggctgcaatgattgccgttacgattacaactgtttggatgaatttaggatttacttttttgattttacttggtgcgattcaatccgtcccaaccactttgtatgaagccgccaacgttgagggtgcttccccgcggtatcaatttttacatatcacgattccaatgatttccccaacgctgtttttcgtgtcaatcatcactttaattgaagcctttaagagctttggcctgattgatttgatgacgaaaggcggtccaaccaatgcaacaaatatgttggtttaccgaatttacaaagatgccttttacagtgggaactttgcccaggccagtgccgaatcaattatcctgacagcgattattgcattgtttacgtggttgcaatttaaagtcttggaaaagcgggtgaactactaatgaatattgttgcgaagccgaagttgtctcacactattttgaattatattttgttgattgtcttggcagctgttgttttaggaccttttctgattggtctatggaccagttttctgccaacgatggatattgccaaagggaactttttaagcttgcatctttcccttcaaaattatattgatgcatttacccaaacaccgattatccggtatcttggtaacagtttgtttatttcagtggcaacaatgatcgcgcaactgatcttctgttcaatgagtgcttatgcctttgtctttctgaaatttaagtatcgtaattttctgtttggtctgttcttggctaccatgatgctgccatttgaagctgaaattattcccaactttacaactgttaaagcattagggttactaaacacttactcagttatgattattccgtttttaacatcggcttttggaacgtttatgttacgacagtcatttcttcaaatgccggctgagttaaaagaagccgctgatatcgagggtcttggccacttccaattctattggaagattgcgttgccgtataacaaaataagtctgttgacgttgggtgcatacagcttcctgggtgcttggaatcagtatctctggccaatgttaaccacctttagtaatgcttatcgaccagttcaaaatgggttacgtcaacttcaatccgaagaaacgtttaatgattggggcatgattcaagcaaccgctgcgattgtggttattccaacattgattgtcttgtttgttggccaacattacttcaagtcaggaatgaatgaaggtgccgtcaaatgattaaaaattggattacctttattaaaaagcattggtttccggttgttgcagccgttgttattgttttaggggttgtggttgttggatctgctagaaatgccaccactgccaaagccggtcgaaccccaattgtcttctggcatgaaatgggcggcccggctgagcaggcattggataaaatggttgattcatttaacaagtcacaagataaatatgaagtcattcctcaatatgagggcgtctacgatgaagcagttcaaaagattattcagagtcacggtaccagcacgtcaccagcggtctttcaatcgtttgatatctcgaccgcgcaaatgatgcacagtaaatatacaacaccggttcaaaagtttatgaatgaagataagagttttgatgcaagtaagatttcaccagttgcccgttcattttactcaaataaaggccaacaattggcgttaccattcaatacatcgcaaccggttctgtactataatgccacgctattaaagaaatataagattacaccaccatccaagtcacccagttatagtgacgtcactcgggtggctgaacagctgtataaacgttcccatcatcaggttaagggaatgacgatagaaatttatggttggttgatggaagaggcgcttgccaacgctcatacatcattaattaatcacggggatggtcatgcaggaaacccaaccaaaatcaatttaaaaaatccaacaacggttaaattcttaaagtggatccgaacgaacatcaagtctggtgatttcgtcaactacggttccggtgcgagcgctgaaaccaacgaaatcgcggccttcttagctggtaaattagggatttttgttcagtcttctgcttatattgggcagttgacgactggtaataaagataaactgggaatttcctacttcccacatcccgatggtgtcaaggctaatggtgtcggaattgggggtgctgctctttggatttcaaatgataaaccgaagaaggttcaaaagggtgcctatgaatttatgaagtttgccttaaatgcaaagaaccaagctaattggcaggcggcaaccggctacttggcattgaataaggactcacagaagcaggcggctttgaagaagctctatgcaaagcaacctgaagcacgggttccgggtgagcaattggccagtgccaagccaaacgatacaaactccggtattttaatggaggggatgcagctaacaagagagttggaacaaaccgcaatggaatctgtttatgagggcggcaatattaacaaggcgttaacaacggcgagccagtcgatgaatgccagtttgaagacgacgaatagggcggacaaaaaatagagtggtccagaaatcggttagatcccagagtataaggcaaccagccgaatattctggtcctgaatatttggctggttgccttatacggccgggatctgatttcttgaccacgtttcggccaaataacgcacagaaccccccgtaccaaattatgttagtacccaattaacttcacaaaccgttttgttgacttaattttgaatgagttttaaaggagaaagagattatgacaaataaaacattgattttcggtcatcgcggttacccgtttaagtttccagaaaattcattagatggttttgaatacgcgattgatcatggtgctgatggattggagtttgatgttcatttaaccaaagacaatgtgcctgttattatgcacgatgagaagattaatcggacaaccaacggaaagggaaagattcaagcatatacttacgcggaattgcaacaatttcacctaagtgatgatgaaaaaatcccggctttgaaggaattgcttgcgcttgccagtcaaaagccaattcatcttaatcttgaatttaaaaccaacaagattcactatccaaatattgaacgaattgtccttgatatggtcaaagaatttgatttggtttacccggttatctattcatcgtttaacctggattcgttgaagatcgctaataaaattgatgcaacccagcagtattgtctgctttcggaccatcaaattgaccatccgcgtgaattgatgattaaagatcatctggctggatttcatttgagtcactatcaaccgcttcgaaatgtcaaagagcggatctggacgattgatgatccagttaagcagcgaaatttgtttgccatgcacgttgctgggattattaccgataatttcgaaatggctaaacaggttgaagccagcttgggtgcggttgttcaacagcgtgtgtaattaattattgtgaatcactaggtagttccaatcaagaaatagtaataacatcctccaatatttctcgataaatatgaagccagagcgggacaaaaggtgtttaacttccaaagtgtaattggattatccgaatattctgaacttgaatatttggataatttagttacacgaccggaagttgccttttgtcccgcgttttcgctcggtaacaattgtgtttacacgaacagaggatgggataaatgactattgtcccatcctcgctcttttggataccctgaaattacagaggcgttaatgaagtggtctcatttttagtgacacggtgtcatttctgtgatatgctttctaagatgaattagtgacacagtgtcatgccactgggtatatccaaccaccctcattgtgattataaaattggaggaatagtcatgactatcaaattaattttcgcgatcgttacaattactttggcacttgttttttacacaattggtgtgttttcggagcggcactctggatcgttaaggatcaaacacattgtgatgtttggccttggactggtttttgatacaactgggacgacaattatgtctgcaattgctaaaaacgaagtggcggcatccaatttctctctgcatcaagtaacggggatggccgcaattattttgatggcgtttcacttcttatgggcgatctatgttctaatgaaagggacggaaaaagccaaaagtaggtttcataaattcagcttggtagtttggctattttggttgattccatatattgtgggaatggttattggaattggcgtgtaaattgaaaaattttcattattaaattgttccgagaaaggaattgtttcatgggaaaaaggaattcaacattcgcgatgatcatcttgattattggcgtgtttatgtcggctttggataacggcattattgccagcgcgctttcaacaatcaattattcatttcaagttagtgaagttcaaggaacgtggggaattaccggctacacgctggggatggcgatttccaccccgattattggcaagttggctgataaatttggtcggcgaaaattattcctgattgaaattagtatttttgcgcttggatcattactagtggcactgagtccgtcatttgttttctttttagccgccagattaattcagtcagttggtggcggtgggatttttatcattgcttccagtcatgtattatcgacatatccaaaagacaagcagggtggtttacttggtgcactgggcgcagttaatgggattgcttcagtagtaggtcccaatcttgggagtttgattttaaatctgaccggtcgctggaattggctctttttaattaatctgccgattgcacttttcgtgattattagcggttatttggcaattcctgagacgaaagccagtaatatcaaaacaattgattttaaaggattggttctattaagcctgggtattttaagctttatgttggccattaccaacttacaaagtaatgctttagttggtagcttgttaaaaattcaggtttggggtttgattgggttaggcattattctgtttattatgttcattcgagttgaaaaacgggtttcagatcgggtggatccctttctgccttaccagttattacgcagccaaggatttgttttaacactattaatgggccttttgtctggggcgttaatcggaatctttgtcttcatcccaagtttcgttgaacagcgttatggaatttcagctgataatagtgggatttggatgagtggtatcggattaggttcgattgttggtgcagcggttgggggatcattgacctctaaacttggctcaaccaaaacaattgttatttccggatctttatcgacagtcggctttgccttaattgcttatttaagtcccaatccgctttggtttatcgtgtcctcaacaattgccgggattggctttgggatgttaatgggagcgccattgtctgtactgatggctgaagttgccagtaaaaaggataacggggttgcccttggaactttgtccgttagtcggcaagtcggcattacgattgcccccatcatttacgcaacgattattcaaagcggattcagcagcattcaaatgaacacgtccattgaacagtattaccgaggccttcagcgaatgaccggcagcaatcaacaccaactattaaaggttttttacgcgacagctcagcaggcataccaacagatgttttggctggcaataattgcttcggttgtgattgcgctggttggctggtatttgatgaggcggaaacatagattgttaagttcatgatgctcctgatatttattacaataacgaagccttggatcggtttattgcgattcaaggctttgttggttcaacgtatgtttacgcacttcaattatttaacagtaatcgggatgttgtaatctcacgtgttcgtaaagattctgtcacgaatacgtatgatcttgattttactaatgcagcatccatgtatttaaagaattttggtcatggtcaaacatttgaatatttcaagcatgcgaataaggattattggtgggttgtaactaaaggtgataatactgaagaaaattggggaagccagattgcgcgaatccagtttagtccaaacacttatgacacaacgccgtatgatggtaatactagtgttacacggctatctagtatcagcagtgcgactaagaatggtaagattcttcgggtagaagcagccttatcttcaaccaatgcgcccgtatcaggcagtagcactaacagactattactcatcgctggtatagataccaattacaatgctcattttacgttatatgataacgataaagttaatgatgcgttggataacgttgatgcaacgcatggatttgttttagttttcaggtggtaataaaaagataatgccatatccatacagcgaactatttttagagtatacatctgctgcaattttccatccagagaaatctttcatggtatagccttcaaaccctgttgcattcttaaatcctgcaggtattgctctttggatgtattgcctgtaggacatttggcctgattcgagttgtttaatttgagctttagtaccatcgattgaactcatttttaattcatcaagttgtgatcctaatttttttcgtaaatattcgccctgttcatctggtgttccattcatatcgtctaaggttttttgtaacttgggatcgtgaattgtccctggaaacgcgtcgataacttgtttctgtaaaggtaagctggtttcggcaaagttgtatcttcttagatatcctcgccaaatatagcccttaactgtttgtgcactatttgatacgtaataaaagataccgattttctttccgttagtcattttgaaacttttcgaaacagaccaaacggttttaggataatttttgaggttatgaagttttttagtaagattacgattccagatatatgcatttcgttgtgttttcgcctgaaactttggcatacttgtagaatagttttttgatttaataatgcggtaagcagctcgagtagtatcgggattggtggtgaaatttatgcaactaatgagcaagccaagaataccgataaaaaacatttttttcattattttcattgtcaaaatatctccctattacttataaactaattgtttaaacacaactctttatggttccagaaagttcacaaatccatacccattatatttaccacgcttatttgacaaccatacagcaactttccaattttcaaaatcattgagggaatatgcttcgctgcgaaaatcaggagattgtttaattgcttgtggcagtgatctttgaagataagcgttaaacgagatccttttgtcttgtaagtcgattaaagcagctttacttcccgtaatcccggtaaccttatatttgttaaattcagaaccaagtttatctcgcatatattcattacgttcatcgagatttccagataattcatcaataattttttgaagatgggcatcataaattgttccaggtagcgaatttaaaacttcttgcttgcgtgtcaaacttctttgccttgataaatagccgcgccagactaatcccgtaatagttttaccgggattctcgattcgatagaaaatgccagtcttttttccattggtcattttatagcttttggtgacatacaaatttgcattgggactattttccattttatatcgcttttgggttaaattgttattctaaacatagacgaatttagttgccgtgcgactgcggtaagtcggcaggatgtttgcataacttttggacttgatggtgtaatagggaatgttgttggtacttgcactttttggtaatgcagcccctgataggctgacgcaaacgactaacattaaaaataacacccattttttcatttgaatattcctcctcttcgtttattgcgaatgtgtcaatgaattttttgacttaaagtgcactttaagtagtaagctacatgaagttaagaaaggggaatgaagatattgacaaatggattaattttaggtgctcacggccaaattgcacaacttgtccggcaaagattgctagccgaaactgatgttcatcttactttatatttaagaaattcgggtaggattaaaaagactaatccgcaaagagagacaataattgatggggatgttaatgattatcatcagctgacaaccgcgatgaaaaaccaagacattgtttacgctaatttgggtggtcgatttgaaccaatggccaaaaacattgttaaagcaatgatggcaaataacattaatcgattgatctatgttaccgggttggggctttatcatgaggtacctaatccatttggtcagtgggttgaagactcagttggccacgatgtgatggcagacacccgccgtgctgctcagataatcgaggaatcgaaaattgatgccacgattattcgcgcagcttacatggacaataacgatgagatcgattatgaattaactgagaaagggactcccttcaaaggcaccgttatatcacgaaaaagtatcgcggacttgatcgtaaaagtgattaagaatccgaaattgtacgaaaatagtagtttgggaattgccaagccgggtacgaatggtgatcgaccaatgttttaaataatttacttttttggtgacaatcagcaatcgtgattacactaaagggggctgggacaaaagtaatcttgtcccagtccctatttgtgtaatcacgattattaccgagtcgaagtccctcagagtatgaacggcctttagcttcatctccagtgtaacgaaaaagatccagtcaggagctgatttttatcagtttctaactggatctaatcttagattgtttaaaattgataatttccaaccctcttgttcagtcttctacaattcctttcgcttaataatggttaacgatagtccaaaacaaacagctagaattgcgaagcttgtccagatgtacggttgaaattgattgactgtaatttcttttaaactgattttaacggtaacactgaagaaatcgatgtattttaaccagttccatttagtgatcatactaagaattgagataagcatcggaaaggcaacgataaaaattgcacttccaatcaatgaactggttaacatgagaatcacaattgccatactgaaaacgacgtcgataaagaacgtcacgatgactgcggttaataaggttgtactaaaaagatttccccagctggtgccaattttgcggcccaatgcgataccggttagaatgcctgcaagataaaatgcaatgacttgaatgaaaatatctaaaagcattgttacgaatttagcgataatgaatcctgaacgggaaattcctgaaacaagggtgtttttataagtttgctggctaaattcataaccgattaccatgacgaaaatactaatgaaggcatacattaacacgctggaagaaatggttagtcctcgagtcccagataataaggtccattgcatattggccagccggcctaagaagtccgcgggtgcgctaaccataatcccgccaacgtttttagaataaacggtgatcacactaaagaggatgactaagattagcaacaagtaatggccaaaagtgtgagtttgtcgataaaaatcagctcttaattgattaatcattgttggtcgcctccttgatgctgcaataagtcggtatagtattgttccaatgagccttcctgccgtgtgatattggtaaccgcaacgccatttgtgaccagtgtttgattaagcttggccgtatcaattgaaaagttgtgaatcaggatttgatgatcgttgaggaccgtaaatgaaccgatattgtcattatccaatagttgggcagccagcttaacatcgctaacccccaagagaatgccggattcattttccttatctaaagtttctttggtaacctctttaataaatttaccgtgatggataaacccaaattttgttgagacttgatacagttcagttaaaatatgactggaaattagaattgtggtgtttcgttctcgattaagctgttttaataactttcgaaacgcaacgattcctgatggatccaagccgttgattggttcatccaaaatcaaaaaatctggttgtggtaagagtgccaaggcaagtccaagtcgttgacgttgtcccaatgacaggtggctggctttggttttttgtttagctgataggccgacgaagtcaatcgtttgatcaatcaggtgcttatcttgaataccatgttggatcgcggttaatttgagattttggcgaacagttaattttttaaacgcagctggtgtttcaataaccgcaccgacgtgtttaagtgcctgttgataatgagtggctgattcaccgagtaacgtgatcttgccatcagccagcggtgacaggtgggtaatgaggcgcatcagagttgtttttccagcgccgttttcaccgattagtccatagatatcgccacggttaatcgaaaacgtgacgtcatttaatgcttgaaaatgaccaaaatgtttactgacgtggtcgaccgtcaaaattgtggtggtcatgttgctcatctccttttcatgatttacaatacatggcaatccttaagtaccgacataagtaaaccttaattaaacctaaattgtggccgctggcttgacgcggtacacttaacttatataaggagggtctggttatggcagctgcaaccattttaattgttgaagatcatgaggatattcggactttattaagggatgttttggctcccgactacacgattgttgaggctgtcgatggggttagtgcgctttccaaatttcatgactctcagccggatctggtaattttggatctcatgctaccgggaattatgggggagagtgtccttaaaacactccgcaagacgtcgcaagttcccgttctggttttaacggcgattcaagataaacaaaaaatcgttgagctgctggaaaatggggctaatgattatttaaccaaaccgtttgatattgatgagttgattgcccgcgtcaaggttcaattacgagccaatcaaccttcccagccgcaagctaaaatgcttacttatggcaaagtctcgcttaaccaggaaacccatcaaatcttggtggccggtcacgagctggttttacctaagaaagagttcgcgcttctacaaattttaatgacccatccccaccaggtttttcaaaaagcacaactttatgaaaccgtctggggcgaaccctatgttaatgctgaaaatactttaaatgtccatctcagtaatttacgaacaaaaattagtgctttgtcgattgattcccaatatgtcaactctatttggggcatcggcgtccgatttgattaggggggtaacgacgatggtagtagtacttctaagtatgctttgtttgctgttggctggtgttttgctgttaattgttatcgacattcgacgggtaaccaaagagttaatttacattaatgagcatacgacaaatgggtttgtgacggccaacacaaattttcccttaattcgaaaactaatcggtgccagtaaccttagtctcaaggttagtcgaaagctgcagcaggctcaggctcatcaggaaaatcagattcgaaagatgttaactaatttaacccatgatattaagacgccattaaccgtttcaatgggttatgttcaattgatggctaaatcagcaacgcaagcacaacaaccacggctaaagcggattgaacgcaacttggattcagtgaattactatcttcggtatttaatggactttaatcttatgcaggaaaaaagtaccacccttaaggttaagcaggtgaatgtttcgcagctgttggaaaacgaattgttcaactattatgatgaatttactaaacaatcgttggaaatgacaccagttattgaaccggatgtgatgttacagaccgatgcaaccttgctaattcgagtttgccaaaatctaattggcaatattttaaagtatggtcaaaagcaggcccaggtaactttggcacccattgatgatacccatattaaaattgaatttgcgaatcggggaaaccaactgcccaaagatccagcccagttattaaatcggttctacactgccgatcaatcgcgatcggatcaaagcgttggcttggggttcagtattgtccaatcattggtgaccacgctgggtggtcgattacacttatcaacagaagatggctggtttcgggtggcggtgattttgaaaccattgaaggattgaatgatcagaaatgatcttttcttaaaatataaataatcccaatacgccttcatgtttaaagggatattgggattatttagtcaactggtttgttttcggtgcaaatacccagttgccagtcgataggcgatacaaaatatggtcagaaagcaaccaacttcacaaataatatcggtaacgtgtcaaattgccaagaagatacttggcagggcagttggaaataagaattggggaataaaaaaagtcacacagccggcaattaagctcgcaaaatcttccttggtgaatatttcagtcggtttcctaaatctggtaaaggagaaaattgatcgtgaaaagtgaatcccgatgacgttaccgcaactggccaaaaccagcaacagtaatttgagtccgatggtggttgcggtaaacaaagaaaggtagacagcacatgcaatgcctaaaccatcaaaaattgagagccatttcatttttattcggaagatcacctttcgttaatttggaagtgacttgatcttttaggagtgctgatggcttttaatgccgtgataaatggtttcaacaagaagtgttatgaaatacagcaaaacatagacactcgcgatcaagccgaagatagcgagcaaaaaattattttgatatatcaagcctaagattcctacgattaaatcaatcgatgttaccggtcccaaaaaatgttccaaaaattgaaaccattttgaatattttgaaagaaatactttataacgttgccgattcaactcatgtcctccttgtgttaaataatgggatcagtcttgttgtgtgaatgatagatatagatttgatttctaattggttatagcttactatttcaagttatcatggctgttttttaatgtcaatattgtcagcgacgaaaaaaatggattagacttttgtgaattaaatcaataacttctcttttttactggtttatcggtccacaatgtgatcggcgaacaagctgcaataacgattgtggctgctaaatatggacttcacgaatgttctgtagctatggcttgggcaggatcatccgcaaccattaaaaagaatgcaggtaacaatgcttaaagcactgcgaaagtttgcaactgggattaataatatatggaaaagttgatcatttgtggttgatttgcagttccttgaaatccgccagtgggttatgtataatttaaaccaagaaaaatgttatgataatatacgaaaaatgtgttgatggtttgttcggtaaacgataaattatgccaaaccttcacttagtaagtaagggaagcgttcatcgaagtattagtaatggatagctttacgcaaagttaattaggagatatcgaaaaacgattcacgctaataaatttacagtttcagctttaatattattggtcggctttgctattaataacttctcttcatgttatgccccggaaatacgtattattcatcttttctattgttgtgctatctcgttttggttggcagccaatcgaagtcgcaaaactattagtgacattttttagaatcaattaatctaatttggaggtatttgtttggtagataaaatggcaaaacgagttgcgcaacatcccgtcatcactgtatggtttgtgtttatgattgggcatattattccactgctagctcaattaatcacagtcgatgattttatttttcaagaggcagtcgtgacagttgccatttatttggcttggatttgggtcaatcggaaaaatgtgtctcgtaacaaaccagttatctctgttttaatgattctgtttggtcttttgctagctggcgtagcttttcacattattcctgttaaatatgtaatactaacttacttaattgccggtgattgttggttaggatcgtttgggttagcagttaaagaaatgagaaagaattcaaatgcatagaaatattctagaaacgttaaatagcaattttttataaaatatgttatattgcggttgcaaagaagagttattgagcattaagacaccaaatcccttagaagatcggacttctaagggatttttttcactatttatgtagtagcggatgggttagatgttgcctagttctttttacttgcggtgtttcccatctaaccaatgggagaaccaaattgtaagggtgagaataatgttagatgataagcaagagaaaacgtcaatttccattacaaccaacttggcagacaagcagcgggctactaaaatttttaactctctaggacttaatctttcaactgcgatcaatatctttcttaagaaaagtattgctgaaggcggtttgccatttgaagttaaagatccattttatagtgaagccaatcaagctgaacttaatcgtcgtttcaagaaagttagtgaaagtaaggacatttatcctcaccaactttcaaatgacaagtaaacgagctggtagtatttttaaatgacacttgggacgattagatgtaggtggaagttatacagatgggaaaaagtattttttgtgtaaatcgtcagtccgatgacttccatctgtaattgctggaataataagctttgatattgaaggagtgattctgagcaaatgaaagaattaacatattatgtccaaccaaatgagcaaagtccctcgtttaaagctttccagatgctaatctctttaagaaaagaagggcgtctaaagaaatcattagcgggatatcagttatctatcgtgaaaattggcgcagataaggatattccgacagtgattaataaacagctattgaatctgcttaagaatcatagaaatgatgcgctaccgatcgttacattagacgaccaaatcatcaaaattggtggatttttaacaccaagtgaactttcacgacgatttgaaggcttatcgttacaaataaacgatgatagtgaccaataactatacgctaaaagtggccaaattgtgattgcttatgtcgatggtcgcagttacattaaacaattcgaacatacggaacaagcctgtcgactaattagcttaaatcgaaagtatgcctctattgaggttcaagataatcccagttttcaaattaaaggcattgtagtcggcacccttagtaattagacaggttatttaaaagccccctcatcaggaaattcttgatgagggtgcttttgtttatccaaattggcggtaccctggcgttaagtggtcgtagggatgatgcactatttagctgaaatgacgatatgctataagcgtcaaatcgatttgatacagaaaatcttttaattccggagttagaagatttaaatcaaaaaacattaaatttagaaagaggtaattattatggcagaagccacaaaaagatttgaattaaaaatgccgggtaaccaagtggtacaaaaattttatttagattctgacaacacggcatacgctttacaaatgtacgggaacagcggaaaggatatgaagttgtgttacggaactattgaccctaaccaagcagttattgactttaccaaacctggctttactcaaataaacttgtataattttgggcatggtcaaacttttgagccattcactgattcagctggtaataagtgggcttgggtggcaacttatgctagctcaaccgaaaaagacaactttggtgcttcctgggcaagtcggattggtgttattaagcttgatggtcaagctaagaatgccagtgatgtgccagcaattacggctttgaatgctcagccgctgtttgaggcattgcagtcaggcagtgttaatgctaaaacggactcaagaatggttaagagcgatagcttttacgtctctagtcggaacattacaaaatatgtttatccgcaaaaatcttggcaggaaatggaattatctgataaacgatcaccagaaaatggcggttacaattggttgtatttcactagtggacaagcagacgcaaagtcaaaaccaatgattattcgcgcaccctggaatatttttagcgccactcctgtcgaacgtgtcatgacctttaaggatctatccggggcggtagaaatcgaggcaccacaattgactggtaacgatattctgtttgggattgagcaaggcccatccggtaataaaactcattatatttacagtgttaaaaaatctattttctagatgaaaaaaaccttcccgaataaggaagggatacatattatttactttatttgggaattcccaattgaattgagcacgctccataatctcgcatgtcccgaaagtctggtaaggtaactggatatcggtactgattagctaagttaaagcccctttggtcatcataagagtccgcatagccgacaatgtctaagccaatgtcgtaattagacatgctatttctcttgtcttgatcgtatcccagctctgtaagccgttggtcaatcagtttaacggctttagagggtgccatacgttcatagtaagtataatttccctcgctattaaacgaattcaaatctataactttagtacttgtaaatccgttcaataaataagttttttggggtaaagaaacatacaggctcttagacaaatttagattaattttggaattaggaaacagcttagcaaccagtcgagttaactttagcgctttattgctatttaggtcgttaaggtaagcttgttggctattaaagagcaccggcaacttaataatgctttttttgaaataaccataccaggcaatccctttaacttttttattgtatgccgaatataacttgtaatacacttcgtttttgcctttaacgggcttcacgaatgccttggaaaccagccagacagtgttaggatagttttttaaattatggatccgtttggtttgggtattattccaaatataagctttctgacttttggtgcttgaataatacggaatcggccctgtaaatttggagccatcaaaagaatagttgcttggaatggtgttggcagataccgagccaacacttgatagaccaagaaaaatagcccctaacagtaacagaaacgacaaactcttttttagcatattaaatacctccattacatgcattataacaaaaaaggatacttactttaaaagatgtgagcaaacgaaacaatgtggtcaacaacttaagagattctggtaatggtttacaatataggaaccgttttggccgaaaagttagaatccatagtagcacggcaagagctgacgacccgtatgaaggattactacgatctaaacttatttgataaagtcaacgacaaaacattgattttgaaatgttaaagaatgcgctattaggaacatctcaaaaacgtaggacagaagcgttgttacctttatgtaaggaaattatcacacggttgattcaccggtccttaattaaaacggcggtgggaaaagtatcgtatgtcatacgtgtacagtaaagatgtttcatatgaagatacatgtacggctgccctagatttagtcaacaacagttgcagctgaaaagtcagtcaatgaaacactaatttccaaagtggtttgttttttatttttcaaaaaattggtttaatagttactctttttgttttaaagtgtaaagaattaacaacaatacattaagtgctacaatgaggctaatagaagagggggacaactaatatgaataataagctgtttgttagtaccctttataagattctttaaatctcgaggtgacatgttttgagtaaacgattattagttttgcttacatcttttgctttatggatagtaactattacaattgttgtacttgcatttttacatcacgatccacagtcactttttccaatattcgcatataatcgaatacatggtatttttggatggagtttagctttgtctatagccgtaacggtaattttctttcacgtgtctaagcaaccaaaggattaaaggtggagttaagcctatgtctttaatcacataattaataacaaaaagtagcggtagaaaagcgagcaatttcattttaaacacatttattattcattatttatagtaaactattagagacaaaaacaggctccatgggttatcagaagcctgtccttttagcagtattcttgaattttgatgtattaattcggatctaaatgaatactggattaactctgtaagtaatgtatagaaacctgactatgcatattattagaaaagaatactattaagactttttaaagtatttctttaaaaataccggaatacattcaattataaagaatacggtcgttatcccgaccgtattaaccatataatggaattcatattattcatacttgttcaataaattaagcagtccatcgattacgaaccaccagctgtatgctgggtcaaatgctagtactgatgattactgggtaactcgggttgctcgtttaccaattgacggcatctccaaggcaccagctgatgtaaacttcatcacttatctaaactatatgggaacaggtaaagataaaaatatgaatttatatcgggctgatgcagccttgtcatcagataaaagccgtttggcagtttggactcaagaaggtcaatatggagccaaaaaaagagtgacggcttttaagaccaaagagttaaaccgaatcatggatgcagaaggcaatattaagtgtaccaacaaacgtatggcaaagggtggttcggcctatgtatcaagccgtccaattaatagttactcttaccctcaaagttcatggcaaggaatggaactatctgaccgaattaaggcgggctacaattgggtttatttgactagtggtcaatctggagatccaactgttattgctcgtgccccttggaatttccaatctccggcacctcaaaatgtaacagcgtccatcaaagacttgggcagccacgagcatgaaactgaagctcctcagttatatggcaattatgtttatttcggtgtagaagaaaagactcccgatagcgggaaactgaatgagcgttacatttatagcattccaaaaaactcattcactaattaaactaacaaccaaaataatcgctaaaattttagtcgattaagctggttaaaaagtcccgtaaggatagcatacactacccctatgggactttttcatgagcaatcggcaggctttaatcagcaccataattatttgaccgtgccggtgcttcgaaatacttaatgcccccaactgtgaaaaaactagctaccatatcatatgacttgccagtatatttgtatggggtatgcagattattaattgttaagcgataacgatatctatctccgcttaaacgagttgtcttaacgcctgaaagtctacggtgaaaatataagtacttttttgaacccttgttaagtacgtgactaattttgacgtaacttgatggtttttgtgcgtaacgccactcgagtcctccgtcacccaaaggagtctgatcatatttataaaattccagatatccatctgatgtaattcttaaggcattactagtaaacgatgagtcatgataatatttaacggcccgatctttaaaggcacttacacccccagaatagagaatattattgccataggataaagtataagccggtcgcttcacaagagtatacttcttcggcgaatatgaaagataaaccccaaattctttagttggttctttaagatttagctttttctttaaggcatagctaactccaacccaaccagacattaaaactttatttgtactccccaaatcaacttccccattaacaatcgttcccttgggtagtgtaacttttttccctccgtacttaaacgttgtattttgattaaatcgataatattgatggtgttcgccaatcttgttgatataaccactggtaactctgtgaagtccaatttccttagctaaagctaatttatttgatgaaaaaactaagatcaggaataaagaaaagctaaatactgcaattaaacctgttacctttttcaaaataatttactccttcccttaatgtttttcgtgttttttaacggattgaaatcatttttttcaaatggcaggaactcaatttgttcctttctaagagtatcataaactcttttttgcccatattattcgatctatttgggaattccaagctgaatggcacacgcttgataatcttccatgtcgcgaaagcctggcagagtgactggatatcggtactgattggctgtctttaagtcactttgctcataaaaggattgcgcatagccaacaatatttaagccaatgtcgtaatcagacatactatttcttttattctgatcataccccaactccgtaagccgttggtcaattaatttaatggatttagagggcgccatacgctcatattcactaacggaccacttaccagtttgcttatttaaatccagctctttagtatttgtaaaactatttagtagataagcgttttgaggctgagtaaggtacaggctcttagacaaatttagattaattttggaattaggaaacagcttagcaaccattcgagttaactttagtgctttattgctatttaggtcgttaaggtaggcttgttggctattaaagagaaccggcaacttaataatgctttttttgaaataaccgtaccaggcaatccctttaacttttttgttgtatgccgaatataacttgtaatacacctcgtttttacctttaacgggcttcacgaatgccttggaaaccaaccagacagtgttaggatagttttttaaattatgaattcgtttagtttgggtattattccaaatgtaagctttttggcttttggtacttgaaaaatacggaattggccctgtaaatgtggagccatcgaaagaatagttgcttggaatggtgttggcagatactgagccagcacttaatagaccaagggaaacagcccctaacagtaatagaaacaacaaactcttttttagcatattaaatacctccactacatgcattataacaaaaaagattacatatttagaaagtcctgtccatgaaaagaaaagattcaatatcagtaacttaatcactaaaccgatcaataatagcctcttcatttacttaaaactgtatcggtgaccgttatcatttgccaataactctggctgaagttaagcatctatcacgtttattgaagattgttttaccaagtgctaactcggattcaagctttgagttgacccaaaatagaacctaagtgttgttgaaatgatcattaaagcccaaaacagccaatcattttaacagattcgttaaaatgattggctgttttgaagctatgaataattcgggtaaatataagattccgtagcgtatcaaaaaatactaattctacgagatcttttagtaatttaccccgggagtgattagattttggattatttagattttccaatgacaattgtttgaccattaagaccatcgctaattggcagatatttatttgagaggtatatcccaatgataaacttttggtggcgcgtctcagcaccataaccattcgcgtttagaagctgtttgatctttacatatcgctgattaattgaaagatgatcggaatacatattcgtgaactactcggccatgaatgaccgagcttctgggaacacaaagtagtatttaggatatgatatcggtatgccgaaaacctaacttacagaactccgctcttttaccatggctagttcctaaccg

SEQ ID NO: 679 - DNA, 24076 bp, Unknown
  Metagenome-assembled genome
tgaccattatcgaactaggattcaaatggaattatttgcttaattcaattaatgcaaaagaaaaagcaaatcctttcggatttgctatataagctgatatcaacctcagttgacaaagagccaatataatttataaaaaaacagattccaatcacacaaatgaccaactaggacaacaccatcagtccagtcattcagataattgaaatctgttttttatttttcgagaccttagttcattataactaaagtcaaatcaatttacgttaataataaataacaactggttcgtttgtatgcgtatacttccaaacgctcggcatctttgatggtggattatttaagcaaccatgagaatgatattgaccacgggcacttggatttccataaactaaagccggttgccatggtgaatcatgaagcccaacaccagacattgtgattggctcccagtagccaaccggagaagcatatttcgaaccatcactatttttaccacgtaaggtcgcgtgacgttgacgatacataatgtagtaagagccctttggtgtcgcattaccaccagtcaatgttccagacataatcggtactttaacctttaacttaccatctttataaacgtattcttccaagttcttcaaatcaacagccacataagtcttaccaacacccttagtaccgtaaccagtcccaacagcataattgctcaatttaagtgttgctgaatcctgtttttgaagatttttcaaaattgcgtttgaaagtgtcgtttgattaatcttccagccatacgttccaccagccgcaattctaactcgtttaggcgccgtgatcgttaacgacttaccagctgtgtctactttagcggcaaatttggcaacccagtttttaatttttactgaattaaacttatatttaccagtcgcagtcggttggccatccgttagccaatttttagcaacaaaatggtacgttttattgtaagtccgcaatgtcacggtatttttcagagcctgttgtaattgtttcttctgattaacaatcgttgtactggttggtgttgcggagacttcctttttcatcttcacagaaatcattaaattatctttagcttgtttcttaaaagatttaaccattgctgctttatcaagttcgtttccttgtttaccctttttaacaactaacttttggtttttcaaaaggacttttgaatcacttgttggtgtccggtcagtgttaatttgatcgattcgatttttaaattgcggcaataacgtcttaattctataagcatattgcttagtcgaaacgtctgacttggcatttaattttttggaagtaattaaccccattgaactgcgatctttgaataattgcttaacatcactttggttaattttaattcgtgaattacgaacaactaaataattgccattctcatcaatatgggtgttattcaacttcttagtagcctgggctactgttaaccctgaaacatcaacattattaatttttgtaaatttaaaatgattctgaaagtagatatgtgatccgataaatccaccaaaaaccagcaggacaaggaccaacagacttcgcttcaatagcgatcccttgtgcttcttcctgctaaacttttcttttcgtgacactttcgccagcccccttatgaacataagtttgtctttattttacgagatttatcaatgacaatctaccaattattcccgcattaatgagacttaagcaaaacttcaagcttatctcatttaataatactcaagatacaactatctatgttaacatcgtttggaaaaaattgcagttaaatgtgacaaacttgttacaatcctattttatcatcgtacctattttgattacttaatccttattaacttaaaaagcaactcccggccatataactaagagccctccaaattccaaaatcaggaattcgggaactcacctgctacctagccgaaacgcggtctaaaaagcaactcccggccatataactaaaagcctcccaaattccaaaatcaggaattcgggaggcttttagttatattctgggagttgagcgctttttagaccgctcttaatttttaaacgaatgaatgggtgccgggatccttccaccacggtttacaaattgggccggactattaggattaaccggcattaccggtgcatagccgaagatcccaccaaagtcaatctgttcgcccacctttttgccagtcgccggaataacccgaaccgccgttgtcttattattaatgaccccgattgctgcctcatcggcaatcatgccgctaattgtttcagcaggcgtgtcgcctggaatagcaatcatatccagtcctactgagcagacagctgtcatcgcctctaatttttcgagatttaggttgccatgctcaactgcccgaatcatgccgctatcctctgaaaccgggataaacgcaccagataaaccaccaacatgttcgcaggccataacgccacccttcttaaccgcatcgttcaataacgctaatgccgctgttgtcccgggggccccgacgctttctaatccaatttcttctaaaatttcggcaaccgaatcgccttcattcggcgtcggtgccagagaaagatccacaattccaaagggaacatttagtgcttcagccgcaacgttgccaacaaattgacccattcgagttactttaaacgctgttttcttaattgtctcagaaacggtatcaattgactcaccacggaccttttccaacgcccgtttaacaacgccggggccactaatcccaacgttgataactttatcggcttcgccaacaccatgaaaggcaccagccataaatggattgtcttcaactgcattggcaaaaataaccaaactcatgcaactaaccggatcaattgcagccagtttcttcacaatatggcccatttgctgaacagcatccatattaatgcccgcccgggttgaaccaacgttaactgaaccacagactcgactagtttcactcagcgcctcaggaatcgaatcaatcaatttatgatcaccagtttggtatcccttttgaaccagtgcagaaaagccgccaattaaatcaacgcccaaaacctcagcagctttttccattgtttgagcataagcgacataattatcatcatgacaggccgctgcgatcatcgaaatgggtgttactgaaattcgtttgttaacaatgggcaccccgtactcagattcaatccgctccgctaccttcaccaaatccttcgcacttgtcgtcaacttatcataaattttctgacgggctttatcgccatcactatcaatacaatcaaacagcgaaattcccatcgtaatcgttcggatatccaatttctcttcagagatcatctgaatcgtatctaatatctgattcttttccaactctctggcccccttaaagtttttgaatggcatcgaataattcttggcgctgaatatgaatatctaagcctgtctcagtacccaaatctgttagaccctttttaaccgtttcaaaattaattgttttttcattccattcacccattaacatcatggtaaagtcaccatccattaacgtctgcgaaatatcagtaatattcacctttaatgtagctaatttctgggaaaccttcgcaacaataccaacttgatcgtgtccaattaccgtaatgactgctttcatttttctccatcctttcaactcaaccacttgttatgtcaacaatcatacccgatatttaatttaacggcaatcacggttttaatttatccgaatgaattttcaaaagtagaattcatccggttaaaaatgatataattagcaataaaatttcagtaaaaggatggcaatgacatggcaacagaaaaagaaaagtttttagccggtgagccctataatattatggaccccgagctagctgcagatgaaacgaaggctcgccgactctgcaaaattattaatgagctcgacgatactgcaaccgatgaaaaagaacatgcaattcggcagctgtttggctccgccggaaaacgcccctggattcagccaaattttcgttgcgactttggctataacattcacgttggtgatgattttatgtgtaactacgataatgtgattttagatattgccccggttaccattggcaatcactgtatgctggcccctcacgttcaaatctattcagcctaccatcccctcgatccggctggtcgggaacaatacatcggcttaggaaaaccggtaaccctaggtgacgacgtttgggttggtggcggttcagttatcttacccggtgttacattaggaaataatgtggttgtcggggcaaattcaacggtcaccaaatcatttggcgacaatgttataattgctggtaatcctgctcgcattctccgaaataatccacccaaaaaataatttttttcgaaatcaatgttgacattctcatttttagggtgtaaattatgaacaatcattaaattcaaattaaaaagcaatgaagagaaacgccattttgtaattgcgatcagagagttgctggtcggtgagaagcaattcgcaatattcaatggtgatcatctctgagctgtgcagccaaacgtatgattagtaggctacattgggtacacccattattgtgtcagcgtatcgcgaaagccgtacgtgtgagattgtcctagtaatagagcaataaatttaaggtggtaccgcgcagaagcgtccttttaattatccagttgggatagttaaggacgctttttttgagcttaatgagatattattaaaaggtggtgaggatagatggaatcggagattagtatctctaatgatacaccgggtcagattcagattagccgttttaggatcaagttcacacatagttctattgaatttattaaacacatagcttcaatcacatatcatacttcacgtcgtacatttatcctcgccacatacctgagcggggacaaaccgattaaataaaattttggaggccacgcttatggatgaacaacaagcaacaatgacattatcaactaaggaaaacgaactcgcaaagaaattatttaacgcttatcagacgcatcaggcgttaaaaatgtcagactgggatggtaccgttacagatgaagatgctgcctatcgcgttcaacgacgattaacggaactaaaaggagaagacgtcggtggttataaagtttctttaactagtaagcaaacccaagacatgtttgactctgattctcccctatatggcgcacaagttaaaagtcactttgttcaatcaccagttaccctgcaccagggagaactaatggaaccactagctgaagtggaaatgctcttcacagcaaaggaagacttatccagtaaagattcattagaagacctcatgcacaaaaccaaagttgcagctgccgttgaagtccccgactcacgttttagtgactggttcccaagtttatctaaatatatggtcatgtcggatgccgcggttggtggtttcgttgtttatggtcaagaagttaataccgatcagttatttgataacgtcgatgatttagcccatgttaaatgtgagctattccatgatggcaagaaacttaaagatggtgcttcatcagaagtgcttggcaatccactcaattcacttcactggctggttgaaaagctggaatcacaaggaatgccattaactgctggtcaacgcgtatcaagtggtactttcctactgccggaaaatttaacttcaggtgattggaaagcaacctttgataagggattgggtgctgtattcttaaaggttaccaaataagtttcaattaaatttcattaatcacctgttatgaaattaatgctactgcaacttttttctaaagatgttaacagccacagaaagctgggaggctacttaaaataagcacagattaacttgtcctaattatttactggtaatattgttttagatcgaagattaattgataaaaatgaaatgaaataaaaatagtcggttagtaaaagcggaaaattttactaaccgactattttttgcctaccctgaccatatgttcgcatttgttcttgacttttcgaacgagtgttcgtatgatttagacatagtcattaattatgattcgcaggtgataatcgtgacaaccccccttgatgataaaaaagcactacccatccacgatattatgtgtattgattgtaaatctttctttgcatcaactgaagctataaagcgtggcgaacaccccctctctgccaaaattgcggtaatgagtcgggaagaatctgctggtggtttaattctagccgctagtcctttctctaaacagcactacggtgtcaaactcgggacccgtcgctttgagatgaacgatcaaatgggacttgaaatggtcgaacctcacatggctgattatattgcccttaattacaaaattaattttatttatcgccaatttacagatgaccagcactggttcccctactcaattgacgaaagcttcattgacgttagtcatagtcataagcttttcggttcaaatgttgaaattgctcatcagattcaaaaaagagttttcaataaaactggcattattacaacaatcggaattggtcaaaatccactgcttgcaaaattagcactggataatgccgccaagaaacaggaaccctggattgctcaatggacttatgatgatgttccgaccactatttggcagatccgtaatttggcagatatgtggggaattggtgaccgaactgcagctcatcttaatcgcattggaatttacacaatcaaaggattggcctttgctgacctaaataaactcaaacaaacttttggaatcctaggcgaacaattatactaccatgcatggggaatcgattactcaaatattagtaaccggtatcttccccgatcagatagtaagggatacggcaattctcaaatcctaatgcgtgactatactgatttttcagaactcaataccgtcttgggcgaaattgccgaccaagttgccactcgattacgaaaaaacaatgtggtcgcccaagtcgtcactatttttgtcgggatggcaacaactgaccaccagggccggacacatttttcagcccaaacattgatcgaggcaactgatttaacccactcaattgccaatgcggttcattacttgttgaagtcaaaatgggatggtagtgctgttcgctcagtcggagttagatgcagccgactttctcccaaacatgatacacaatttaatttattcgaagatcccatccgaacgcttaatcacgaaaaattagagcaaatcattgacgagattcgtaaaagatatggttataaagcacttatccgagcatcttccaagactagaggcggaactgcgattcaacgtgcaaatctagtcggcggccatcaggcataatagtcaccgaagccgcaatattgacactaaatctatgatcttatttttgaagggagtcatcattatgctaacagaatccaaaaaattaattacgcaataccgtcattattttaaacgccttccccattatcaatattggttagtcatcgttgataaccactttaacgaccgttactatttcttcctatataatcggcgattcaagaccaagctggttcggtcttatgagttattggctctagttcatgataaacagaaatatcaacaagtattagcggatttaaaatcggttagccaacttagtattgaatatcgtgataccgatcatttagtcgaaccaacgccagaaataaaggtggataaaattcatggtcatcacttttaaggttagctaactaatacgatgctactcaatttgagcgctctgcgttgttcttatccaagattgtttccagaccatggtgaccatttgtgtcgttctttcaaataaataatgacttttcaatgcattaattataattttgattgcgcttttggtttataattagcttatgttaatttaatgggttaaatcttattttaattagaaaaattgctagggagaacttaaacgaccggtttaatcatcaagctaattgaacccagttacttaaaaacaacattcccaagattgcttattcacgataaggatggaactccttaaacacagtttaaattgaaaggggcaatttatatgttaaccgtcaggaagaatttgctaatgctaattgcgacaacgttttcgctaggaattgcaactcaacttgcagtaaatacacccgcttttgcgaaaaccaagtctgccaaagtgatcaaaattaataaagcaccgtttaaagcctatcgtgctaaaaagggatacatatatagcaacgccaagttaaccaaacgcattcacaacgctaaaaattatccaaaaacaacgttgtattctcaaaaagaagcaattgttaaaaaaagcgatgggaaacaggctgtctattattatgtaatgagtaagaaccgaaaagtccaaggatatatttggcatagatatttaaccccagtctctattaaagacaatattgcttctagtgaaaccagcactaatcaaccaatctcacaaaaagcattagttaacctcattaataaagctccggatatggatcccacagaatctattcgcagtttaaaaccaattgattatattgctaacgaaacgatttttgatcttggctataatgtctttcgcttctcaccaagttcaatgttcaaatcacatcaggccacggtctatgtcgcttcaggaaaattagctcccctcgctcaggcagctatgactaaatggaataacgttttaggatcccaagtttttaaacttggaacggcaaaaacacacacactagccattcgattgggcaacggaactaaagatggttgggatggcttatacgatggtaaggggatttatattgatcatactcattttaataaccctaactatcccattgcttatatgagtgagaacctgggatcccaaacatcttatcagcaatattggactggcgtcattgctcatgaacttggccatacacttggtcttgatcacacaggttatcaagctgatttaatgtacgcaccaaatagcgatggtaattttattacaaaatatttgtggaagcgtccaatcgaaagatcatcaactggcttagatggcactgagatgggcacaattacgcaacgtgatttaaatcgagctcgattaacaagggttttaggctattggtaaccagagttgatcaaaagacgtttataggctaatcgttaactccactttgttgtggagatagcgacgaccttttttattatattacggactcgaagcttctcagagcatggccggtctctatcttcatctccagtgcaacgaaaaaaaccgaggatgggacaacaaccattttacccagtctccgttggtgtaaacacgattgttatcaagtaaaaacgcgggacaaagggcgcttaacttccggttacaccctaagcgccctttgtcctgctctctggatctaatcttaaattcgttttaaagcattttaataatatttaaattaaaatcccgaaaaatcatgtcttcacacttgatttttcgggattttttattaacccaaacagttagttctaagtataaatttcaaattctggactaccctgttgataactaatcaaataaatgtaacttggcaattcgttggcaggcttccgtaaatcttggctcatcaattaataagccaaccctaacaaagccttcgccaccttcaccaaatccattacccggtgcaaccgcaactgctgccttatccagtaagagatcagcaaacgactcactagtataccccttcggtaccggcatccaagcgtaaaacgatccacccgacgggtatggttcccagccaatagcccgagctgctttaaagaattggttacgacgcttttcatataaagcaaccaacgttttgacggttgattgatcactatctaaagcagtgatcgctgctttttgaattgctgggaagacactaacaaataagtgatcctgaattaaattaattgcttcaatcatatcagcattaccggctgcaaagccaattcgccaacccgccatattgtaagatttggaaaaagtgtaagtctcaattccgatatctttggcaccaggtgtttgcaggaagctaattggtcgcttgccatcaaagccaatcgcaccatacgcgaagtcttgaacaaccccgaccttattttgtttagcaaacgctaccgtcttcttaaagaattccggtgttgcaacagcaccagtcgggttatttggataattcaaatacatcagcttagctctatcaacgatatctttatctaaagaatcatagtctggcagaaacccattttcttctttaagtctcattaatttcaacttaacttgagccaaggcaacaccagaaaggtaatctggatacccaggatctggtagtaacatggtgtcaccaggatttaaaattgcaaacggtaattcaaccaacccaattttagaaccacctagaatagcaatttctttttcaggatcaagttcaacgccatattcgcgctgataaaaattagctgcggctttctttaattcaggatcaccacggaattgagaatatttatggttagcaggtttggctgtctctgcctgcatggattttacaatataatcaggagttggttgatcagggttcccttggcctaaattaataacatccgcaccagttgcaacttttgcatttacttttttaaccaggctggcaaaaaattgctttggtaaattctgcaatacttttgattcttcaaaattcacaataattcctcccgtatgtttaagctaaaattcattacctttaaagacaactcattcacagcactgctaaataagtgactcattgatagccaaaaaggtatcaatattctaccttggttgataataacttaattgaattcatccaactcatcgaaagttgtggttggactcccaataatcatcaccttaactttaaactcatagctttcatgatcgctcattggctccaagtgtataaaaaaagtcctttatcaaattctttgataaaggacgacagaagccgcggtaccaccttattaagcagaaaaatgctcactcattgattgctgtaacggacaagtccgaaaccggctaacagacattgcttgccagcttttatttaaaggttaaaaggccatctttccataatgcaatcaatcatctctcagctaacaatgattctctgtcactaatgcagttacggtactcaccttttaagttaatatgaatattatgaataataatttaataaatgtcaatggtttttaattaatagttaatctgtcaggaacccgaattttgcgaatcaaattactcaaatcatccccctgtcttggtctcctaatcgccactcgtttcttttcaaacttattcaataaaacaagttgacgttaaatggcgtcattgcagttctaccaccaaagtgtcacctcaataaattcaatgattgtctctttacttcatctatacatcacccttattttctggtatcatagtcacattgccatatgttatattatgttacatagaattaggaggaataataatgaaccgaaaagtttcaaacgccctcagctgggttgttttattaatggcttttctattttgcctcgggtggtccagctcgaccgcccatgcgaaaacgtatcaaattggaactgatgtcacctacccaccatttgaatttgctaataagcagaacaaatacgttggcatcgatattgacattatgaatgcaattgcaaaagaggaaggatttaaagtcaatatcaaaccagttggctttaacgccgccgtgcaatctgttcagtctggtcaattggatggtatcattgctggaatgactattaccccggaccgggtggctaaatttgactttggaactccctattataaaactggagttgttatggcagttgccaaaaatagcagcatttcaagctttaaacagctcaagggaaaacgggtggcactaaaaactggtactgcagccgccgactacgccaacagtatcaaaaagaaatatgggttcaagaccgttaccttcgatgactcggataatatgtaccaagatgttgcaactggtaattcagtggcctgttttgaagatcaacctgttatgcaatatggcatcaaacaggggcttaaacttaagatcgtaacgaaaccagctaatactggttggtacggctttggtgtaaaaaaaggcactcacaaaacattaattgctaaatttaataaaggcctcaaaaaaataaaagcaaatggcacctatgataaaatcgttggtcgctatttgggcaataaaactaataaaaaagtcaaaggcaaaacatttacgatcggaactgacgttacatttccaccatttgaatttgccaacaaacaaaataaatatgtcggcattgatatggacttaatcagagccattgccaatgagcagggctttaaggttaaaatcaaagcacttggctttaatgcggccgttcaggcggttgaatcggggcaaattgatggtgtgatcgcgggcatgtcgatcacgaatgctcggaaggctcaatttgacttctcaaaaccctactttaattcgggagtggtcatggcagtaaatcctaaaagcaaaatcactaaattatcccagcttaggggtaaaaaggttgctgtaaaaaccggaactgccggagcagattacgcaagtagtattaagaaaaagtatggttttacgacagtcacgtttgacgactctaacaatatgtaccaagatgtgtcaacgggtaactcggcagcctgttttgaagatcatcccgttatgcaatatgcaattaaacaaggaacaaagttgaagattgtcaccaagccggcattaagtggtccttatggattcgctgtcaaaaagggccataataaagcgctactggctgctttcaataatggtttagcagatttaaaggcaagcggaacatatgataatattaaagcaaaatatttaggatccgacgaatctgcaactgctgctaaaactaagggaagctcttctgaggatcggaccttcattggtttaattaagcaaaatcaaggtgcccttctttctggattaaaggaaacgatgtggctaacggttgtctcaattttctttgcaaccatctttggaattgtggtcggcttattaggagttgttccaagtaaatttagtaatagcatttcaagtatcctcatatatttattccgaggaatgccactactggtgttagccttattcatttatacaggaattccaagcttaactggcgaaaaaatcccagctttctttgcgggtgttgttaccctaacctttaatgaaggtgcttatattgcggcatttgttaagggtgggattgaagcagttgatccaggccagatggaagcagcccgtagcctaggattaccatttggaaaatcaatgcggcgaattatcctaccacaaggcattcgaattatgattccatcatttattaatcaatttattatcactttaaaggatacttcgattttatcaattattggcttacttgaattaacccaaactggtaaaattattattgcccgaaacctagagggctttaaagtttggacaatcgttgccttaatgtatttgattattattacgttattgacctggttatccaattgggttcaaaggagaacgaaagtatgagcgaaaaggtaaaggtttcaaatctagtaaaaacattcggaacaaatgaagttttaaaagacattaatttaaccgttaataacaatgaagttgttgttattatcggcccttcaggctcaggtaaaagtactttgttgcgaacacttaataagcttgaagaaccaacatccggatcaattgttattgataacgttgatattgcaacgaagggtgttgatattaataccattcgtcaaaatattgggatggtgtttcaacattttaatctttttaataatttaaccgttggtgaaaatattatgttggcaccagttgagttaaagaaggaggataaacaacaagctgctaaacaagctaaggagttgctagaaacggttggcctggaagaaaagtttaatgccagagttcagtcgctatcaggtggtcagcaacaacgggtagcaattgcccgagccttggcaatgaatccagatattatgttgtttgacgaaccaacatcggcattagacccagaaatggttggtgacgttttaggggttatgaaagatttagccaaaaaagggatgacaatgatcgtggtcactcacgaaatgggatttgcaaaagaagttgcggatcgagttgtttttgtggatgacggtaggattcttgaacaaggaacgccagaccagatatttgaacatcctaaaaatgaacgacttcaagattttcttaataagatattgaatgtttaaattaattcaggtagattagagttgagatggattttgtctcaattcttttttgttggactgctggatttaaatatcaaaagtgggctaattaatttttatgatctgatttaacttggttaactggttgttttagaaagttatcgaggaggaaaataatatgaaatttctgttggtttgtgcatctgccctaacactttgtactggtgctgtcggggttactcattattgcacaactccccatcaccaaaatcagccacgtgtagaacgtggttgtggcatgaatcgttattaattggttttcattaaaacaataattgaattaagcataccttttatctccgtgaaacaggttttatcaaccattaattatctttgatcaagagtcccacaatcataggcaaacaggtttaatgattgtgggactttttttagtgaaacataactttaataattatttgtaccacaaaagcacctctcacctgaaccaaataaaaccagattctcagtatatttgctaaatagtgactatccgtatgtggcctcgatattcgaacttgattagatgcatcattaacaacctgtatcattttcaagattaaatagtgaagaagtaacaccccattaagtatggcactttagagaacgagttatcgcctccttctcgttagaatcatatgtcccctgcttccaggacaaagtggaaactttccccctccccttgcttctcctattgctcaacagctattttccccaattattgtttaagtactcacacttgagaaaatagagatttaaaattacttaaatttttttgatatgagtcgctttttgtaacactgaattctatcaattgtataatatgtttgttaggggatattgaattgaaagtcaacacgttttggggaatacatatgacccatcttttaatccaataaataatgaataacagttatcgcttgtcgcgttgaactgtgaaagaggagatctacaatgaagaaatacgcatcattaattgccacggctggcatgttgttaagtatggggatgcctgtcgtcacatttgcaagtcaaaagttagcattatccgcaacggttaagccgattacgaactcgatgacatctatttctggcaaagcaacccaaggggccacggtcaaaatgtatagtaacggtagctataaagcaaaagccaagaccaaaagtaacgggaaatttaagattaatttgaaagcccctctttcaacgattggtctctatcaattacaaatatcaaaagttggttttaaacccatcactaaatcatttacagttggtccaactgattactctagccaaattaatccattaaaaagtcaattagcagacgctcaaacccaattagttggtgttcaaaatcaaattgattcaatgcaatccagtgttcaatcacttagcagttcatcatctttaagcgctctccaatctgaattgaaggccgttcaaagcagtctagccagctccacagacccaactgcaaatgcaagctatcagcaaaccatcaccgacttgcaaaaccaaatcaataactataattcttcaatgaacgctgctggatataagccaattgtttatcaagtccaatatcaagacttagaacagcaagccgttactttacagcaacaaattaataaattgcaggatcagattcaaaagctccaggacttatctgtccaataattagcaagatgaataacaaaaaaaacaggatggagaatccgttaaagctgggataaaattacttttgtcccagcttttttacgataaagaatatttctaataacttctaactttctatgattaaactatccaactgcttgactcaaaatatatgtatttgaacgtacatcatcaagaaaattctaagaacttgctgtttattgatgaatgctcaattaaagaaagaactccaacgagctgacattcacgctgaatttaacctttcatgggttcacactcgtgctttaattggtgttccaccgcctatatttctcaatgtttaggccatgagaatatcagcaccacgacccggatctatctgcacattattaaagaattggaaaacaaagaatcggaaaaaacgactgactatatggatcaacttttgaatattaattagaagaattgtgccaacctttttatgcaaaaaacacccattgtgccaaccgaaatgacaaagtatactaaacaatccaaaatctttagacacaaaaaagcaggaacgttgttaaatcaacgttcctgcttttaaaaactacgctatataatgcttagataccggaggtggggttcgaacccacacgtcctttaacggacactggattttgagtccagcgcgtctgccagttccgccactccggcataataaatgattggccaatccatggttaaaggcggtaatcggattcgaaccgacgatgaaggttttgcagacctctgccttaccacttggctataccgccatgattttgactaaccctactgggttagctggattcgaaccagcgcatgacagagtcaaagtctgttgccttaccacttggctataacccaatcaaagggcggtaggtgggaatcgaacccacgcgtgtcggatccacaaaccgatgtgttaaccacttcaccactaccgccatagtattattaacagggatagtaggagttgaacccacaccgacggttttggagaccgtagttctaccattaaactatatccctatgatggaggggagtggattcgaaccaccgaacccgaaggagcggatttacagtccgccgcgtttagccagacttcgctacccctccataaaatggcgcgggacagaatcgaactgccgacacatggagcttcaatccattgctctaccgactgagctaccgagccataccatcatataataatactaatatgttgtgtattcaattgtcaaatacataacaacggttcgtacgagactcgaactcgtgatctcctgcgtgacaggcaggcgtcctaaaccaactagaccaacgaaccaatgttgctatggaaatggaggatacagggatcgaacctgtgacctcctgcttgtaaggcagatgctctcccagctgagctaatcctccaaaagtgacccgtacgggatttgaacccatgttaccgccgtgaaagggcggtgtcttaaccacttgaccaacgggtcataaaacttattattcgtttacggagagtaagggattcgaacccttgaaacaggcttttacccgtttacatcatttccaatgatgctccttcggccagctcggacaactctccaataaataataactccggcaggcgggctcgaaccgtcgacaacctgattaacagtcaggtgctctaccaactgagctatgccggaatattgcgtggcaacgtcctaccctcgcagggggcgatcccccaactactcttgcggccgtgctgaagcttaacttctgtgtttcggcatgggaacaggttgtatccttcaggctatcgccaccacctatgagaactggtgcgctcatccaactagacatatttttctttgaccgatacaacccactcgtggttaagtccatcgaccgattgtactagttccgctccgtgcatcgctgcacttccccttcacctatctacctgatcatctctcaggggtcttactttccatataggaatgggaaatctcatcttgaggcgagtttcacacttagatgctttcagcgttttctcatccaacatagctaccagcaatgcgcctggcggcaacactgtacaccagcggtgatgtccatccggtcctctccgtactaggaacagctcctctcaaatttcctacgcccgcgacggaatgggacaactgtctcacgacgttctgaacccagctcgcgtaccgctctttaatgggcgaacagcccaaccctgggaccgactacacgcccaggagtcgatgagccgacatcgaggtgcaaacctcccgtcgatgtggactcttgggggagataagcctgttatccccagggtagcttttatccgttgagcgaggcccttccatacggtaccgccggatcactaagcccgactttcgtccctgctcgacctgtctgtctcgcagtcaagctcccttggcctttacactctacgaatgattcaaccattctgagggaacctttgggcgcctccgttctttgggaggcgaccgccccattcaaactagccacctgacactgtctcccgccacgcttagtgggcgggttagagtgttcacacacaagggtcgtatcccaccatgcccgtccaccgaactatcgttccggttgcttacggtctccgacctatcctgtacaagctgtgtcaacacccaatatcaagctatagtaaagctccatggttctttccgttcctgttcggcggtaacctgcatcttcacaggtacttataattcaccgagtctctcgtttagggcagtgctcagatcgttacgctttcgtgcgggtcggaacttaccgacaaggaattcgctaccttaggaccgttatagttacggccgccgtttaactggggcttcatttctgggcttcgccgagctactcatccaccttcgccttccagcaaccgggcaggcgtcagcccgctatacgtcatcttaacgattttgcagaaactgtgtttttgagaaccgtcgcctgagcctcttcactgcggcggcacttgcgtgcagcacgcggcctctcccgaagtacgggtcattttgccgacggttgcttccacgagagttcatcgtgctcacctaggagtctctcctcgactacctgtgtcggtttgcggtagcggtagtagatactcactagaagcttttctcgcagagtgacatcagccacttccctacttaaattcggtccgcatcaagttgtctactcccggttcgctaaagcatttaactaacaccagacttgcagcttcgacgcacatatccaacatgtgcgcgcacgggcttagcctttctgcgtccctccatcgctcaaacattcttaactagtacaggaatatcaactgttgccatacgtctacccgtgcggccctcgacttaggtcccgataccccctgggaggacgagcctccccggaaaccttagtcattcggtggatcagattctcactgatcttgctactcataccggccattccattctaagcgctccactatcccttacgatctagcttcagccgcccttagaacgctctccctattcacgcgacctaatttggtcgctatccacaagttcggtggtatccttagccccggtcattttcggcgcagatcactcggctagtgagctattccgcactctttaaattgttggctggcttctgagccgaacatcctagctgtctatgcaactccaccgcctttccactagtatacactttaggaccttattggtggtctgggcctgtcccctttcgacgatggatcttatcactcaccgtctgactcccggatataaatctatggcattcggacgtttatctgaattcagtaaacccgtgacgggcccttagtccaaacgtgctctcctccacgattctccttttccgaggctagcccctaaagctattcggagagaaccagctatctccaagttcgtttggaatttcaccgctacccacacctcatcccagcacttttcaacgtacacgggttcggcgctccagtgcgttaccgcaccttcacctggacatgggtaggtcacctggtttcgggtctacatcaacatactgaaacgcccgtttccgactcgctttcgcacggctccgacttttcaatcttaaccttgcatgtaacgtaactgcgccggttcattccaaaggccacgctgtccacccattacgggctccaacattgtggcacatggtttcaggaactatttcactcccctccggggtgcttttcacctttccctcccggtactggttcactatcggtcactagggaattagccttgggagatggtcctcccgattccgaccaggttttcacgtgtctgccgtacctaggatcctgaactggggtaacaatatttcgtctacggggctacacccgactgctggccggtccttcccaaaccgttcgactatccgttactttggtaacctcaaatgttcagtcctacaaccccagggaagcaagcttctggttctgtgtgtgtgggctgttcccacttcgcgtcggccgctcctattgcggaatcagcattgcttttctcttctggtgggtactctgagatgtttcagttctcccaccacgttctgccatactagctatgtattatcctaagctaccatcgataaatcactgcgcatgattgggttttccccattcgaaatctccgtcgatcaaagcttacgtacagctccccgaagctatcgtgtgttagtacccattccttcatcggccttcctagtgccaaggcattcaccatgcgccctttttaacttaacctcatcactcgtgacggattaattgagtattaactcgaataaacttactaataaaaactcaaaatacgcggtgtttctcgcttaatgaatgaaattaattcaataaaagaaaattgataatttctagttttcaagaaccaattcttgattacgcttacgatcaatggagaatagcggatcgaaccgctgaccccctgccgtgcaagcaggtgctctcccatccacggagctaattcccccccccataacaacaaagtttgttgagtgggcctaaactggactcgaaccgatcgacctcacgcttatcacgtgcgctctacccagcgtgagctataaggcccaataagctttatctaatttgagagtagacctccaaaaactaaacaaagttttgtctcgttgtgctggttccgattattccttagaaaggaggtgaccagccgcaggttctcctacggctacgtgttacgacttcaccctaatcatctgccccacttaggcggtttggctcccgaaggttaccgaaccgacctttgggttgttgcaaaactctcatggtgtgacggcgtcggtgtgtacagcccggaccgtattcaccgcggcatgctgatccgcgattactagcgattccgactcgtgcaggcgagttgcagcctgcagtctcgaactgagaatggctttaagagattagcttgccctcgcgggtttgcgactcgttgtaccatccattgtagcacgtgtgtagcccaggtcataaggggcatgatgttgacgtcatccccccttcctccggtttgtcaccggcagtctcgccagagtgccaactaaatgctggcaactgacaataagggttgcgctcgttgcgggaccttaaccaacatctcacgacacgagctgacgacagccatgcaccacctgttctccgcgtccccgaagggaacgcctaactctcttaggttagcagtccgatgtcaagacctggtggttcttcgcgtagcttcgataaaccacatgctccaccgcttgtgcgggcccccgtcaattcctttgagtttcaaccttgcggtcgtactccccaggcggatacttatgcgttagctcggcactgaagggcggaaaccactccaacacctagtattcactcgtttacgcatgactaccaggtatctaatcctgttcgctacccatgctttcgaggcctcaggtcgcgttaagaccaacagccgccttcccactggtgttcttccatatatctacgcatttcaccgctacacatggagttccactgtcctcttctgcactcaagtctcccagtttccgatgcacttctccgtttaagccgaaggctttcacatcagacttaagaaaaccgcctgcgctcgctttacgcccactaaatccggacaacgcttgcacctacgtattccgcggctgcttggcacgttacttagccgtggctttctggttaaaataccgtcaacacctgaacagttactctcagatgtgttcttcctcaacaacagagtttacgagccgaaacccttcttcactcacgcggcgttgctccatcagactttcgtccattgtggaagattccctacttgctgcctccagtaggagtttgggccgggtctcagtcccaatgtggccgattaccctctcggtcggctacgtatcattgccttggtgaaccattacccaccaactagctaatacgccgcggggtccatccagagtgatagccgaacatctttcaaactgaaaccatgcgtttcagttgttatacttattagcacctgtttccagtgttatcccctgcttccgggcaggttacccacgtgttactcaccagttcgccactcatccatgctgaaaatcagtgccaatcgcacttcaattcatgcgggatcgttcgacttgcatgtataggcacgccgcccagacgtcgtcctgagccaggacaaacttcattatgattgtttgtgactcattaatatttactagcgaaattgacttcgtccaattaacatttgaataaaccgaagttgatatccctcgcactcgttggaaacaagaactttgggttttcattttcaaacgggttcactcttactcgacgtatagattaagttagaaccaagttaagtcccgtgacaatgtcaacgattttttgaatctttattcattcacatcaacacctcttatgataccaactgccgaatgttagcaacgattgaatattaaatgtctgaatataattcaaataattatatcgtggttctttatacaacatggtaaataataccagctattggcgacagaggtcagcacaaataaaaacaataagccaatgtatagtttgcaacaaaccttttagagcttcctgagcccatgcctgtctatcttttgaccgaccccaaattagttgatgctaaatccctcatgaacaccatacgacgttgtccaattaactgccggtgtcgatctcatttctgtggtgctaccggtggcaggggcacctgagtttcttccaacatctcaacgatagcggaaatttgccagtgaattcatcaatattgtaagacaaacacatcattcttcactcacactgacggtaaagctgtattgtatcatggctacgacataataccctaatggcattcagaaatatgagacgatcagcacaatcatgaaactcatggcccatgagattaacacaggcgaccgcggcaccgagtggacgagctggttgaaatgccagtaaaccgtaccatggtacgtgcatcactatacgcattactaaaacctctttatcactatagtatacaaaagcttgagaccgataagctaacatcagccgctcgcctataggcttatcagttcgcctaatcttcaatggagaacagattcaactcagcgtctgtgcctaatgctccaaacggtttgtcagc

SEQ ID NO: 680 - DNA, 18271 bp, Unknown
  Metagenome-assembled genome
tcttcgtggtagttggttttgatgaacggacaggaaatgcccgttttttgttcaataataatatacaaaaaaatctgtcattaataatagattaaatctattaccaacaacagatattgtacagccataaaaattgcccttgaaactctttttcttttggatcagatcaaaagacgagtaagtaaaaagaaaataaactatttattttcttcttttaaattttcgacttctgggactctaaattcttttcgctccaaagcagcaataattcgatttaatcgatcttgatcaacttctgccggaagggtaaacataattcgatgaactagctcaccttcctgtgcatctaatgaaataacactggcaatggaggtgtacttcgtaatgattttagcgatttcttctaggtcaccacgttcgccgctggcaacaacggttaagacatagctgccgacgttgacattccaggattgagaaagcatgtctaacaaacgagtgtgtgttaaaataccgtaaaagtgattttgagcatcaagaactgcaatatacggtaaatctttaattgaaaagaacacttggaaaaaagctgagttaacattaacgaacttggttgcattttttaagagtgtcgtgacaggtaaggacatatcaccgccacgggatttatggcgataaatatgcattttataaatgtttcctctaaaaattgttccggtttcatctaagattgggacacatcgatatccggaatcttccaaagtggttagtgcttcttcaagggttgcatcctctttgacagtcactaagcgttctttaggtttcacaagtgtttttaataacatatttattttcctccagttaaactgtataccttataataacatagcccgatttagaagagtatagaataaaggccttaattttaataaagttggaagaaaatgagagaggtatgccagatgttggttaaatcccagaatataaggatgcactgggatacgttttagtttggaagcgatcaaagtatgtttaattttgtaaaaaacagctttcgtatccttatatctgggatcgagtgtttaccaaagtaaaaagccaaaacaaaatcgagttttgctttggctttcaagataaattaaattaaaattaaacgatttatagttgtgccataccatttgcagtagtcttttgaagcgtttctgcagatgctgtcatcttagctttttcatcatcgttcaatgggacttcaatgactttagcaattccgttagcattaataacggcaggtgtcccgatataaatatcggtaagaccatattcaccatcaagtggtgcaccaacaggaagaattgtgttttcatcacggagaactgctcgtgaaattctcatcaagcaggttgcaacaccatagaatgttgcacctttacggttgatgatttcgtaagccttgtgacgagtttgatcctcaattgttgctaggtcgtcagatgataatccggctttctttgcaacatccaagaatggttgaccaccaattcgtgcagctgaataggcagcaaactctgaatcgccatgttcgccaagaatgtaggcatcaactgattgagggttgaggtccaacttcttgccaagagcaactcgaagacgggcactatccaatgatgttccacttccgaatacacggttctttggaaaaccagagaacttttgtgcagcataggttaaaatatcaactgggttagcagcaacaacaagaacacccttaaatcctgaaccaacaagtggcttgataattgattgcataatcttcaaattcttattaacaagatctaatcgagtctcgcctggcttctgtggtgcaccagctgtaataatagccaaatctgcatcagcacagtctgagtagtcaccagaataaatgtgttttggtgaagtgaatacctgagcatcttcaagatctaaggcatcaccctcggttctctttttgataacatcaacaatcacaaactcttcggcgagtccttggtgcatcattgcgtatgcgtatgaagagccaactgcaccgtcaccaataagtgctactttttgacgttctaaagtcaaaacaatcatctcctatttcatatttagtccgattaaattataccacagagaagtgtgcgctttcacaaaatcgcttgacttgtaatgaatttctcattttaatcgggattaaatgcaggaggagattaatatgatataatttgtacgttaagttaaactagacacgagctgaacgaaattcgttcggccttttgttgttgaaaaaagaggataaataaatgataaaaatgattgttggtttgggaaacattggcccccagtatgagaaaactcggcacaatactggttttatgattgttgaacagtttgctaaacaccatgaccttaaaataaaaacacgcaagatgaatgctaaaatgggctcaacctttatcaacggagataaagtactagttgttgaaccaaccacatttatgaatgattctggaatcgctgtaaaacccctaaaagattatttcggtgtgtcgacggaaaatattgtcgtggttcacgatgatatggatttaccgatcggaaagattcgaattaaagataaagggtctgctggtggtcataatggtatcaagagtttgattaacaatctcgggactgaagccttcactcggattcgagttggcatcgctcatccggataaaagcaatacggttgttaattatgttctgggaagattctctaaagatcagttgccactattcaagcgggccggggatgatgcagtaaatgcacttgacgactggcttgaagggatgaccatctctgatcttgaaaatcgttacaactaaatgaaaggacgatggatgtgcaactagatcaattgctaaccaagattccgcagtatgaccaaattgtatccgggcttacgcctaaaagtcggcaactagtgactggaattggcggttctgccagaacagtattgatcgataatttaatccattcaactagtcggcccattgtcgttgtggttgatacactatttcatgcggatcaattgataaatgatctgggcaatttaatgccggatgatcaattgtttgagttcccggttgaggagcttggcgctgctgaattagccaccagttcgcctgaatataaggcccagcgcgttttggctttagacaaattagcgagtggggaaccagctgttattgtaacgtcggtttctggaattcgacgactgattcctgcaaagagccagtttttaaagtcaaaattaacacttaaaattgacggtgactatcatttggaagcattaaagttaaaactccatcaaatggggtatgtctttcaaaaacttgttgcagcgcctggtgatttttcaatccgtggatcaattcttgatatttttccactaaaccatcaggatccggtacgaattgatttttttgatacagaagtggactcaatgcgactttttgatgtcggtaaccagcgaagtattaaaaatattgatcaaattcaaattttaccagctactgatttgttaataaccgatgagcaacgaaagaaaacggttaaacaacttagagcacgtttgacgagggagcaaaatgaacttgaaggcgagggtgccaagaaacttgccggaaatatcgagccgcaaattatggatcttgataatgggttaagcgatccacggtggttattatttgccgatattatttatgacaaccattattcattgttggattacctcgctcccagtggggttgtggtatttgatgattattcacggattaacgagtcggttcgccagttaagcagtgatgacgatgagtggcttcaagataaaattaaaaatctggaagtcttaaaatcaaccagctatacaaacgattttaagaaggcttttcaaactaatcaacacgcaacaatgattatttctttatttcagaagggattaggtcgaatgcggctcgatggaattgaagacattacgattcgaccaatggaacaatttttttctcaaatgccaatgctgcggaccgaaattttaagatggcaaaagcaaaaacaaactgtcatcattatgattcaggatgaaaaacggatgcaaaaagttgcccaaacgctaagtgattttgaaattccagtaacccaaactgataggaaccaattgttaccgcagaaagttcaaatgatttctggaaatctggataatgggtttgaactaccatctggtaatgttgtgattattaccgaaaaggaaatgtttgggacagttgttaagaagcgacctcggcaaacgacgtttaataatgctgaacggattaaaagttatactgatttaaaacccggtgattacgttgttcacgttaaccatgggattggtcgttacgagggtatgaaaacgatggaagttgatggtaaacatcaagactacttgacaatttcataccgtgacaatgccaaactattcattccggtcacgcaactaaacttgattcagaagtatgtttcctctgaagaccggcatcctcggattaataaattaggtggcagcgagtggatcaaaactaagcgtaaagttgccgctaaaattgaagacattgctgatgaattgattgatttgtatgcgaagcgaggttccgaaaagggctacgcctacccgccagatgattccttgcaggctgagttcgaggctaattttccatacaccgaaacgccagatcaattacgaagtgttactgaaatcaagcgggatatggaacaatcacaaccaatggacaggcttttagtcggtgacgttggctatggaaaaacagaagtggcactaagagctgcctttaaagcaattgaagttggcaaacaggttgcgttcctagttcccacgaccattttggcacagcaacattatgaaacgatgttggatcgttttggcgagtacccgataactgttcgagttttatcacgtttccaaactcaaaaacaagttaaagaaaccttgacagggttaaaaaacggtacagtggatgttgtggttggtacccatcgcttactatccaaagatgttaaatttaacaacttgggattgttaattattgatgaggagcaacggtttggcgttaagcataaggaaaagattaaggaaatgcgttcggacgtggatgttttaacattaacagcaacgccaattccaaggaccctgaacatgtccatgatgggcgttcgtgacctatccgtaattgaaaccccaccatccaatcgctaccctattcagacgtatgtcattgaacaaaacgccgggacgatccgagaggcaattgaacgagaaatgtctcggggtggtcaggtgttttatctgcacaaccgggttgaagatattgagcgaacggttgagcaaattcattcgttagttccagacgcaagggttgcgtacattcatggtcagatgagtgagaatcaaatggaagacattctctatgattttgtgaatggtgagtatgatgttttggtcacaactacgattattgagacagggatggatattccgaatgtcaatacgttgtttgttgaaaatgcggatcgaatggggttgtcacagctctatcaattgcgcggtcggattggcaggagcagtcgggttgcatacgcctactttatgtatcagcccaataaagttttaactgaagttggtgaaaagcgtttggaggccattcgtgactttacagagttaggctctggattcaagattgccatgcgggatctttccattcggggtgctggaaatcttttggggaagcaacaacatggatttgttgattcggttggttatgacctatatacgcagatgttgtcagacgcggtttctaaacgccggggtaaggaagttgaatttcggactgatgccacgattgaacttgatctggaagcatatctgccgagtgattacattcaggatagccaacaaaaaatcgaactttataaacgaattcgtcaaattaataatcaagatcaacttcatgaggttgaggatgatttgattgaccgatttggagattatggtcaaccggttaccaacctattacaaatttcagaattgaagatgtatgccgattacgcgatggtcgaaaaaattcatcaagagactccaaggatcgcaatcacttttgctcagcaggccaccgacgaatttagcagcaagcaattattagaggctattgctcaaacaaaatttcgggcaacaatcaatagtgctaacaaaaaatatcaaattcagttaacagttcaaccaaacatgaagaattggttaaagcagttaattgcgttggttgagcagctttcaatgacacgccaaaagaattatgctggcaaggtaaagcctcatgacaaataaatcaagacgtaaacaagttctaatgggaacgttattgctaacagtctcgtcatttattgctaaactattaagtgcagtttatcggattccgtttcaaaatatggttggtaatatcggtttctatgtttatcagcaagtttatccaatatatgggattgggatgacttttgcactgaccggcctgccggtttttatttcaaaattagtggttgatactaagaatccaagtgatcaggttgctgtcgtgtatcgaattcagacgattttaattttaatttcagcgattatttttggtgtgctgcaatttggagcttcatttattgcttttcagatggctgatccccggttagctccagtaataaaatcggttagttggatgtttttatgggttccgtttttggcaacttggcgcggttattttcagggccaaatgaatatgcggccgacagcgtattcgcaagtggttgaacaggtcgttagggtatcgtttattttattggttgcgggatggtctgttaagtcagttgtagatccttatcggatggggcgccttgcaatgttttccgctcccattgccggattatgtgctttgctggttgttctttggcatgttaaacaagtggggttgcctcattcaagccatcgaaaagtttatcgtcatttgttgattgaaacgttaacggtaggggggactctgtgcctggtatcggcagttatgttattgctgcagctggttgattcgttttcaattgtgtcagggcttcgtgaatatggctatcagttggtagctgcccaaaatattaagggcatttatgatcgttctcaaacactggtccaattgggaatggtaattggtacggcatctgttacggctgttttaccaggcctatcggttgcctacgcacatcgacaagccttaacgtttgagcacattgccaaaaccaacgtccggacaaatttagcgctatcattagcaatgagcattggattatttactttaatgcccgaaattaatcgtgttttatttgccactgcacaactcaatggtacgattggtgtttattgtctgagtattatttttgccacggtacttttaacgaacagtacgattttgcaaagccgaaatcaatatttaccaacaatgattgcgattatttgtgggtttgttactaaaattggaattaacaagtttctggtgataatttttggaatcatcggggccagcattgcaacaatgattagtttgattgtgatgattattgtgatacgtttattgagccaccaccagttagcgaagatgatttctttaaagcaaattattaagctagctggcgttttatcagtcatggcagttattgttcggtcaattgcaattctcttgcaaagttttcaactcattaaaagcgatcgaatcgaatcattgattgtgctggttgtttgtataccggtcgggattattatctttttaggcggatgccgattacttcaagtttttagtttgagagaatggttggcaattccaatggtgtcaaaatttatgaaatttaaagggatgaaatagatgagaattgacaagtttttgaaggtttcaagaattattaagcggcgatcagttgctaaagaaattgctgataaaggtcgtattttgattaatggtcgggtggccaagtcatcatccgatgttcgatcaaatgatgagattgtcattaagtttggtaataaaacacttacagttcaggttaaggagttgttggatacaactaaaaaagatgatgctcaacgaatgtatgaaattacgtcggaaaaatatgaacgtgattatcgaaatgagtgatgtttgacgttggaacaaatttgttagccaacatcattcccaaaaggatcagaacgaacttgatgcttcgttttctgatcttttttgatccagtaacggattaatcctttgaactaaaggaaacttaaatgaaccggccgtgccataactaattaggcttaggttagaactaaacgttaatagtcatacatcttcaataaacttattggagagacttggttgattacaaaatactttgccaatgtttcatcgaatagccaatcacgatgtcaaaataaaatgtttaagaacctgtgaatcatatagacaatttacatattgttggtataatttaccgtagaatgtgtgatttgatcgggggatttaacatgacacagcatggtgcaaagataagtaaacttgaaaatgattttactcgccgtcgcgagcaggaaatcaattattcaaaggcaactcattcacttagtagtcgaagaaagaaacgcgcaatggtcattgttggcgtgttcctattttttgcgatgatttttacgattcagatagttcgtgcgagggcgaattacgcggacgtgaatgttcaaattgcaaagcaacgggggaagtatcatcaccagcaagctgttcataagtcattaaatgccagagttagccaattaaatgataaaaattatgttgaaaaaataattcgcgatcgctactactatacgaaaccgggagagacggtttacagttttcccaataaggcacccaaggatgttaatgatgttgacgaatagtcatttttgaggtggctttcattgagcgtcaatttttaattgtgtatattgtggcagagcgggacaaaggggccgttaacttccagagtgtaaccggaagttaacggccctttgtcccgcattttttgcttggtaacaatcgtgtttatactaacggagaccagggaaaacgactattgtcccagctttttgcataatcacgattacgctggcacttaaccgccctttgttccactctcttagactgttgattacgattattttccggcgacatttagattaagaaatttttagctctttcttggtgtcattagtcttcagatgactttgagaatttaagtatctgagattttgggtgaataagattaattttagccccgtctgttttttagctatgcgggttttgaagtctaaactgtttaccttcaatactaaaaatatgctatactgaatacacttaattaatgtaggaggaacatttttttacatggcaattgaagttggggaaaaagttaacggtaaagtttccggaattacaaattttggtgcatttattgacttaggagatcaccgaacaggtttggtccacataagtgaggtttctgacggatttgttaaagatattcatgacgtccttaaagttggagacgaagtaacggttaaggttttgaaaattgaaggcaataacaagattagtctttcaattcgaaaagctaaagatgaagagtcacatgaagaatcaaatcatggcggcaattcgcgtcataactatcatgaaaataatcacgagagtaatcatgaaggtagtcgtgattatcatgaaaatcgcggtcaccattctcgcaataattctaatcacaacggccattcaagcaatcacaatgaaagtttcgatgatatgatgtctggctttcttaaagaaagtgaagatcgattggctacgcttagacgtaatactgaaggtaaacggggtggccgtggcggtcgtcgcagctaattcgttaagatattcaacaataactattttacaaatcagatacgcgtattaagtatctggttttttgtttgtggaggttggcacttggatttacaaactcaatttaataatttagttaaacgacatcattggtggtgctctgaggatacagtggtcgttgcagtttccacaggggttgattcgatgactttactatatatgctggaaaatttgcccgaaaatcgccctaatattgttgtcgcatatgttgatcatcaattacgtcaagccagtcaacaagaaacttgttttattcaaagatactgtcagcagaataacttggttttggcacaagcaacttggcctaagcagcagcacccggttaatggaattgaagctgctgcccgaaaatttcgttatgcattttttcggcgggtcttagtgcaatatcaatctgaaattctgctaactgcccaccatggcgatgaccttgctgagacaatgattatgaaattagtccgtggtgggcaactatcctcactgatcgggattaaacaaaaacggccatttgctagtgctacaatcattcgacctttactggaatttagtaagcatgagcttcacgattttgcggtaatgcagcatcttcaatggtttgaagacgaaaccaaccgtagcttaaaaattgaacgaaatcgaattcggcatcaggtcctgccacttctcaaacaagaaaatccgcaaatattgaaacacgtgtatgattattcatcacagatacagcgagtcatagcgactgtggatgatttggtgaaaccaattgttgatcgggtagcaacagttcaggccgaggcagcttcggttgatttatctcaactggttgactattctaatgatgtgagattgagtatatttgaatatttaattcagcaacaattgggtattcacaatgtttctcagcgtcaattgcgcgagctgagtcaattgtcagtggcttctgatcatcctcagggagaactttatttagaacatggctggcgggcacttcgcaggtacgatcaattaataattactaaaaatttaaaaaatcaccgactagaatctgaaatcccctcagaatttatggtagtattagaccggtggtattcagttggaaatggtgtccaatttggggtctttaagaagctggaatcgatccaaaatgaaaaagtgtcctgtctcgttttaagtaaagatgattttccacttatcgggcgatatggtcgatctgctgatcgaattcgcctgaaagatggcgggcatcaaaagctcagacgattattgatcaacgcaaaagtgccgaacgagttgcggcatcaaacgatagttttagcaactaatcaaggcgacattgtttctatgattggtttgaaaacagctgctattgaccctcttaaagttggtgagccatattttcttctggaaagggccaacaataatttatcagaaagaaaaggaattaattaatcatggataacgacatcttaaaagtcctctatagtcagaatgagattaaagaagcgtgtgagcggctgggaaaacaaattcaaaaagaatatgaaggaaagaccccagttgtgattggtgtgttgaagggtgctgttttctttatggctgacattgttcgggcagcggatacatacatgcaaatggattttattgatgtttcgagttatcatggtggcactaaatcttccggtgaggttgaattagtcaccgatattaccttggatgttgcggggcgagatgttttaattatcgaagatattgtcgacaccgggcagaccttgaaatttttgatggacacttttgctaatcggggtgcaaattcaattaaagtatgtacgttacttgataaaccggctggccggctggttgaagcaaattcggatttcattggatttgaggttccaaatgagtttgttgtggggtatggtcttgattatgatgaaaagtatcgaaacctaccgtatattggtgtattaaggccaaaaatttattcgcacaattaatggtcaaaaaaagtcaaatgtggtagtattttgactatcaacatgaaataatttttcttgaggaggacgttgatgaactcgaataaaaatgggctttttaaaaatagtctattttacattgtcatatttttgctgatcatgggtgtaatttacttctttaatggtagtagtacaaatacccagtcgcaagaaattcaatcaagccaatttgttaaaaacttgaaggatgacaaggtaaaaagcttttcaattcagccttcgggcggtgtctataaaatcacaggacaatataggcaaggtcaaaaggcaaaagtcgaaactggttttctaattggcggcaattcaagtcaatctaagaaagtcacgaagtttaccacaacggttctcgagaataactcctcaattgctgaaatcaccaaggcagcgcaatctaatgatattaagatgaatgcaaagcctgaagagtccagtggcttttgggtaaatcttttggtttatgtcttaccactgttactgtttgtttggttcttttacatgatgatgggccgtgctggtggacaaggcggtggaaatggcagagtgatgaactttggcaaatccaaagccaaaccagccgacagtaagcaaaataaggtccgattctcagacgttgccggtgaagaagaagagaaacaagaactggtcgaagttgttgaatttctaaaagatccaaggaaatttacaactttgggagctaccataccacatggtgtcttactcgaagggcctcctggtactggtaaaacattacttgctaaagccgttgctggtgaagctggtgtgccgttctattcaatctctggctctgatttcgttgaaatgttcgttggtgttggtgccagccgtgttcgtgatctttttgatcaagcgaaaaaggcagctccggcgatcatcttcattgatgaaatcgatgctgttgggcgccggcgtggtgccggaatgggtggcggtcacgatgaacgtgaacaaaccctaaaccaactattggttgaaatggatggttttagtggtaatgaaggtgtgattgtgattgccgctaccaaccgtgctgatgttttggatccagctttaactcgtcctggtcgttttgaccggaagattttagttggccgtcctgatattaatggacgtgaggcaattttgaaggttcattccaaaaataaaccgcttgcaagcgatgttgatttgcatgaaattgctaaacaaactccaggctttgttggtgctgatttggctaacctcttaaacgaggccgctttattggctgcccgacgtaacaagactgcgattgatgcgagtgatattgatgaagctgaggatcgtgttattgccggcccagccaagcgtaatcgggttatttccaaagaagaacgggatactgttgccttccatgaggctggtcatacggttgtcgggcttgtcttaaacgatgctcgagttgttcataaggtcacaattgttccgcgtggccgagctggtggttacgccatcatgttgccacgagaagaccaacaattaatgtctaaacgtgatgctatggaacaaattgctggtttaatgggtggtcgtgcggctgaagagattgtttttgattcacaatcatccggtgcctcgaatgactttgagcaagcaactaatattgctcgaacaatggtgactcagtatgggatgagcaaacgacttggcaatgttcagtgggaaaatccttcacaggatacctatggaccacgttattctcaagaaactgcggctgctgttgatgaagaggttcgccgaatcaccaatgaagcatacgaaacagctaaaaagattattgaggaacatcgtgacaagcataagttgattgctcaagcacttttgaagtatgaaacacttgatgaaaaacagattctgtcactttggaacactggtaaaatgccagaaaattctaagactagtgaatttccaagtgaacgagcggctacttttgaagaagccaaacgtgaattggaacgtaaagaagctgaacgtcaagctgatttggaaaaggatcatcaagaaggcaagaagccagatgatcagactcaatcagaccaaacaaatgatgataatcaagaaactggtcagtcaaatgattcttcaaataatcattccgatcagccgacggacgatcatcataaagatgataataattagttgaatatttaaaaaaatgagtttagagtgaaaccgtctctaaactcatttttattatgttgaggtgtaaatgttatgaaagattatttagtcaaagcaacgacaacggatgggatgtttcgggcatatgccgttactgcccaagaaatggttatgactgcgcagaaagaccatgatacatggtctgcgtcttcagctgccttggggcggaccttgattggaacggtcatgttggccgcatcagttgataagagtggcgaagcaattactgttaaaattgatggtaaagggccggttggtgaaattattgccgatagtgattccaaaggaaatgtaaaagggtatattcaaaagccacatgttcatttgccattaaatgtaaatcacaagattgacgttggcaaggcagttggtgtcaatggctttttggaagttacccgaacttctgatggtgaagatccatatacaagtagtgtgccactggcctctggggaaattggtgatgattttacttactaccttgcccagtctgaacaaattccatcagccgttggtgtttcggtttttgttaatgacgataattcaattggcgctgccggtggttacttaattcaagttttacccggtgccagcgatgaggcgatttcaaaggtaatcacgcgaattaagcaaattccgatgatttctgaattattgttggatcatcaaacgcctgaggaaattcttgaattgatttttggaaaaggcaagcttcactttttgtcaaccaaccccgtcgcattttattgcaattgttcaaagaccaaatttgcccgtgatcttgaaggaattccggttagtcaattggaggctatgctcaaagaggacgacggattgagtgtaacctgtaacttttgtcagaggcactatgattacgacgaagacgaacttgcaacgattatttctattgctaaatcaagagggaagaactaatccagcactatccatttaatagtaactgtgataatataacaatcgaattttaaagagataaaggctagcttgaggtgaattttatggaatggaaaattggcgatgttacaattccaaatcaggtggttgttgcaccgatggcaggagtgactaattctgcttttcggatcatttgtaaggaatatggtgctgggttagtggtttgtgaaatgatttctgaccgtggtattatgtataaaaacaaaaaaacattggatatgatgtttgttgatccacgggaacatccaatgagtattcaaatttttggtgggactaaagaaactttggttcaggcagcaaaatttgttgatcaaaatactgctgcggatattattgatatcaatatgggatgtccggtgaataaagtcgttaaaaccgatgctggagcacgctggttattggaccctaataaggtctatgagatggtgtcctacgtcacagacgctgttaaaaagccagtaacggttaaaatgcggaccggttgggacaaagatcatatttatgctgttgaaaatgcgttggctgctgaacgtgctggagcatctgccttggcaatgcatgggaggactcgtaagcagatgtatgaaggtcacgctgactggaatatcttaaaggaagttgccagccagcttcatattccgtttatgggtaatggggatgttagaactccccaagatgccaaacggatgttagaggatgttggtgctgatgcggttatgatgggtagagcagtcgaaggaaatccttggattttaaaacaaacgactcattatttacaaacgggtgagttattggctgaaccaactcctgaagagaagattgcaactgccaaggaacatctccatcggttatgtgaacttaagggagatcggacggggtcacatgagttccgtggtcaagcaacctattatttaaagggaatttcacattcggcaagaaccaaagtagcactttgtaatgcggatggtgaagctcaaatggatgagatttttgataaatttttagaaaaaaacgcacaaagaaaagcacgtcagcaacggattgctcaataaatccgtgcttttttgtgttatgataattaatagtttattatcacctaggaggtttgacattggccaaagataaagaaatgaatgatcaaatgatcgttcgtcgccagaagatgaatgaattacgcgaggaaggaatcgatccattcggacaccgcttcgtaaggtctcatcttgccgtccagttacatcaagaatttgacggttatgataaagacgatttgatgaaccttgataaaaaggttacaattgccggccgaatgatggcaaaacggggcaagggtaaggttggatttgctgatttaaaagatcgatctggtaaaattcaaatatatgttcgaaaggacattgttggtgaagacgtttaccatatctttaaacgttcggatattggggatcatttggggatctctgggcaaattattaaaactgatatgggagaactaacggtccgcgctgaatccattacttttctttcaaaagcattgcggccacttcctgataaatatcatggcttacaagataaagaacaaaaatatcgtcaacgctatttagacttaatttctaatcaagatagttttgatcggttccataagcgaagtcatattattactgctattcgaaaatatttggattctcatgattatcttgaagttgagactccggtattgcataatcaagccggtggtgctaatgcacgtccatttgtcactcatcataatgctttgaatattgacttgtatttacgaattgctttggaattgcatctgaagcgtttgattgtcggcggtatggaacgagtgtacgaaattgggcgtgtcttcagaaatgagggtatggatactcgacataatcctgaatttacaatgcttgaatcatatgttgcttactatgattttcatgatgtcatggacgaaaccgaggggatcttcaaagcagcagcttctgccgtgacagatgacaatattgtcacttatcaaggtcatacgattgacctcaacaaaccatttgcaaaaatgcacatggttgatgcaatcaagaagtatacaggaattgatttttggcagccgatgtcagacgatgccgctaaaaagttagctgatgagcatcatattcattatgaaaagtggtggaagactggtcatattattaatgctttctttgaggagttggtccaacctaaattggaacaaccaacgtttatttatggacatccggttgaaatttcaccattggctaaaaagaatgccaaggatcctcgtttcactgaccgatttgaattgtatattgtcgcaagcgaatttgctaatgctttcactgagttaaatgatccaattgatcagaagcaacgatttgaagcacaggttaaggaacgtcaagagggaaatgatgaagctgagggaatcgatgaagactatgttgaagcccttgagtatggtatgccgcccactggtgggttaggtattggaattgatcggcttgtcatgttaatgactgatgcaccgtcaattcgtgatgtgcttttatttccaacaatgcgtccggatgataattctcaaaatgaataattagaccaatttaagtcgagaccagtttcaatggttttcggctttttttgtaaccaagtttgaacagtgttaaagtctaaaacaatattaggatgctgattatcattttttatagttaaaagtaatttttcctgattataatcagatttttttacctttttaaaaagaaagaatgctgataaatcagcactcttgttagtgccacttatgttttgaatatttaattggtattttctcttgacgaacgacgagattttcggtatatttatttatgctgtttcagtgagtgagcgcaacaagcaaatttagttctttgaaatttcttgttgacaccgcttgatcagcatggtatattt

SEQ ID NO: 681 - DNA, 45279 bp, Unknown
  Metagenome-assembled genome
atcgaattgttgccgagaaatatcgctttggtaatgatgactaaaatgttgcatatgatcaccaacttttttgacagtagtttatcaaattattgggtcaaaatcaaagatactaaacagcttctaaagcatcagcgccagaagcaatctttttgctcataatcgaactagcgattaatggaatcgaatcaacggtgtcggtaacatcccggagagcataaatttttttatcagctggcgcaatattaccggttgcgccaataatcgcaagcttgtcttccttaacctgttcgataaagtcctgttcactaatttctacccgatacccaggaattgcttccaatttatctaaagtaccaccagtatgccccagtccacggccggaaatcattgggacaggaattcctaaagcggctaccactgcagccaacggaatactggttttatcaccaacaccacccgttgaatgcttgtctaccttaacaccaggaatctcactcaaatcgagatggtcaccagaggtcatcatcgtcattgtcaatgctgactgctctttttcagtcattccctggaagtaaattgccataagtaaggcgctgatttgataatcaggaatatcacctgagacaacgccatcgacaaaaaattgaatttcttgttcagtcaattctttaccagaacgcttattatgaatcacatctaccattcgcataagttattttcctcctttttgcaatcgcttacatttatcttttaaagaaaaaccggtcacaatttggacgttgcttccggcctctgcttttcaatttagctaatcataatcaattagtaattgtgccaagctttgatcaatcacaacactattcgcataacccgccttcagaactgcatgaacccccgctactttgcgattaccggtcgcaaccaaaatggcatgttccttgacttttaaatcatctaattgaatcccaatggttcgctcatcaatctgctgattaacaatctggccgttacgatcaatgaaacgggaaaagacatccccgattgctacctgttgcagctgttctttttcctgttcattgaaataacccagttgaaaaatcaacgcttctgatcgaacggtcccaacagtaaataatgccacattggctttcctgcccaaatctaagatatgcttaatgtgacggtcactttcgaccatctccttagtcaccttattgtcaaaaatcactggcaagggtaaatattcgggacgggttcggtaggccttcgccaactcatttgcagattcatatgcccaagttttttcagtggcataactcacgctacccttcaattggacaacttggacaccagatgcattttgttcttctatctgtttggttaccgaatgtacggttctcccccaaccaagtccaataatatcacctggctgtacaatcgttgttagaaagtcagcagcatatttgcccacactttcttgaaatgaagacagaccaccataattatgcggaacaacgtgaaaatcgacaccatacttgtcactcaactgagtggcaagtacttgggaatcaactaatggattgacaatctggattcgaaccagaccattatccttagcatattgcaataagcgcgaaacagttggccgagaaacaccaacccgtttggcaatttccagttggctataattattttgataatacatttcagccacctgtaaactctgttttaattttgcaacgtctctaatctcggccatctatttcacactccctttattctaaaccatattttcttttagctttctcaatcatgaaacatgtgactaaccagctgccccgggcatataagcagcgcgatcaaatattcggacccggacttgctacctggccgaaacgtgccccaaccagcagtccccggccatataagcagcgcgatcaaatattcaaaaccagaatattcggacccgtacttgctacctggccgaaacgtgcgacaaccagcagtcccggccatataagcagcgctatcaaatattcaaaaccagaatattcggacccgtacttgctacttggccgaaacgtgccccaaccagcaatccccggccatataagcagcgctatcaaatattcaaaaccagaatattcggacccgtacttgctacctggccgaaacgtgcgacaaccagcagtccccggccatataagcagcgctatcaaatattcaaaaccagaatattcgataccgctgcttatattctggggactaaccgctggttgtcgcactctttaattttgaatcgccgtctccaacgataacttggccatttcatcgaacgatgtttctctttcctgcgccgacagcttttcgcccgtcagtaggtgatcactaaccgttaaaatcgttaatgctcgaatatgatgtttggctgccaacaaatatagacccgatgtttccatttcagtcgccaaaacaccataatcaatcaattgatgaatatccaattcatcattatagaatcggtcggcggcaaatatattacccacctttgtattaattcccattttctctgctgtatgataagccgaatccagcaggccaaagtcagcaatcggcgaataatacattcccgggccaaaggtattggcaataattgatgaatcggtcgtaccagcttggccgagaataacgtctctaattttaacatccgggctcatgccaccacaactacctacccgataaatcgtcttaaccccatattctttgattaattcagttgtataaattgccagcgaagggatccccattccggaaccttgaattgacaatcgtttacctttgtacgttccggtataacccagcatattccgaacttgactgtaacaaactggattttctaaatacgtttcagcaatgtatttagctcgtcttggatcaccaggcattaaaaccgtctcagcaatttcaccaggctttgcgccaatatgtgtactcatttgatttcctccgtgttcttcaactcacttagaaaacttgttccaatttgattccctttaacattaaagttatccaaaaccgttgccccaaaatcggcaaatgtctgccgaatcccaagactgccaccatcactcatagacggtgaatataccaaaaccggaacttgttcgcgagtatgatcggttcccttaaatccaggatcattcccatggtctgccgtaatgattaataaatcatcagccttcaattgattcaagaccgtgcccaatcgcttatcaaagtccattaaggcttgaccaaatccaatcgggttacgacgatgaccatacattgcatcaaaatcaaccaggtttgtaaagcagaatccggtgaagtcttcagccataacatgatccacatgatccataccatccatattgctttcattatgatagccttcagcaattccgtgaccggaaaagatatcattaattttaccaattccaacggtatgaatacctgcagcttttaaatagtctaaatcagtttggccaattggctccaaagtaaaatcatgccgattggctgttcgagtaaaatgatccttatccggcccaacgtatggacgagcgatgattcgaccaaccgtatactccggcccattaaccaacgaacgcgcatactcacagatcctataaagttcctttagtggaatgacatcttcatgagcggcaatttgtaacaccgaatcaccagaagtataaacgattaaatcgccagtcttcatttgttgttccccaagttcagcaatgatttttgttccagattctggccggttaccaatcacctttcgtctggagaacgcttctaattttttaataatatcggctggaaacccgtttggaaaagtatttaacggctgcttgacgggcaggcccatcatttcccaatgaccatccatactatctttgccggcagaaatctcttgcattttcccgtaataaccgattggcctttcaactttattaaccccttcgattggtgtttttctaagatttgaaatccccaatctttgtagatttggaatttttaaattcccttggtaagcttcaccaacatgtcccaacgtatcggaaccaacatccccaaatttggcagcatccggtgctgcaccagttccaactgaatccatgacaataccaaaaatccgcttatatttctttgtactcataaatgtgcctcccctaacgaacagtatgctagttagctaaaattttagttgtcgcactaacgcccaatcgacttgcaccagccttaatcattgccagagcttcttgccttgaatgaataccaccagaggctttaactccaagtcggtcaccaactgtttttcgcattaacgcaacatcggcaactttggcacccgcagaactaaaccccgttgaggttttcacgtaatctgctcctgctgcttctgaatcttggcatcctgcaacaatttgatcatcattcaggtacgacgtctcaagaataactttcagtagtttacccttagcatgaaccgcagcggcaattgcttgaatatcattgattacaaaccgattatttccaccaattaactcaccaatgttaatcaccatatcaatctcttcggcaccctcatcaattgcggtaattgcttcataaacctttgtggccgtattagttgctcccaatggaaagcccacaaccgtaatcggtttaaccgctgttccctttaatgcctcggcaaccaagggaatccaatgagaattaacacaaacagatgccgtgttatatttcacagcttcctcacaagtttccttaatatctgcagccgttgcattcggctttaaattcgtatgatctaaatatttcgctaactgtgcagttgttaatgtcgtgtccatggcaatgtaacccctttcatttttacagacttatcatacaggattttagaacatatgtaaagaaatacgttgaaacaatgttcatcaatgtgaataaataaacttctccacgaaaaaagggggctgggacaaaagtaattttgtcccagtccctatttgtgtaatcacgattattaccgagtggaaacgtgagataaaaggcaacttccagagtacaaccaccttttgtctcactctgcttgtttgtaatcacaaaaattctctattaaaatcagcttctaaagagatgtgatttctgatattgtgcttgatcgattcatagatttattttgctaaatcactaattgaattaatgtttttcatatatttcggaacggccagtccaactttagcaccacttaaattagttcccagatcatcaaacttacctttgtaatctttatagtacattccttgagtcgttggaagccaagcacaaaccatcccatcagctgcattggttgcaatcgatgcccaaagcggctgaagttccattgcttgaatttcaactttataacctagtgaacgcaatacattagcaacgagattggttgaggcaatttcggaatcccaagcgacataagtcaacttgatggattttctatggacatgtttgattcctttcgtccatgaattaacctgttgcttatgttgagtcatccaattcttagttgcccgtcgtggatcttcaccgctattaacttttagcatcacagctgccatttcatcaggcgtccagtggaaccggtttaacatttggtaagcttcaggcttgtccttttttaatcccttacgaacaatcgtatgaatgtcctcggttttcccataaatattcttaggatcctttagaaacttcaaatgataacgatttaccatccaatgaggcgtccaagaagtcaccacaattggttgtttatttttaacatccttagcaagcgtactaatcatcgcggcggttgaactggtttgaagctgccaatttcctttattcaacccgtaagctttcatgactttttgagttgttgtcatctcaccagcaccagcttcaatccccgtaattgtgtaattgatctgcttaccaacagattccttgggattatatttggcaatcgtgctggaacaggccgaaaggagcaacacagaaaagaccatcgaaattaataataaaaatcgactaattgtttttttcatcgtaacccctttctatgacttaggaattctacttcggttaattgcttgagtaattcgatccaaaataatggctaaaataacaatcgccaaaccagcggcaaagccaccaccggcgtcatttcggccaacagcaaagtaaaccttatttccaagtcccatggcaccgatcattgacgcgatcacaaccatcgacagtgacagcatcatgctctgattcactccagccattaaagttgatttagctaatggcaattggaccttaaataacttctgccacccagttgaaccgtatgaatcagcagcttcaattaagtcagcaggaacttgtctaattcccaaattagtcatccgaactgtggggggcatggcgaaaataacagatgcaataacaccaggaaccatcccaattccgaagaacgcaacggcaggaatcaaataaacgaaagctggcattgtctgcatgaaatcaagaatcggtttattaatcgcttcaaaaatttttgactttgccatccagataccgagtggtaccccaatgatcaaagcaatcagactagatgttaagactagcgtcaaggtttgcgtcatatctcgccaaaagccctggttccagatatatagcagaccaataatctcaaaactaatcaatccccaatgtttggtctttcggttcaaccaatacgtgccaccaacaacgatgaccataaacagccaaatcggtaataggtcaaatacccattgaaatccgttgatgatcccaccaacaaaattagtgatcgcattaaaaaatccctcaaagccggcaagccaatcgacaaatttatcaatccagctggaaactggtaactgtggaaaattattcatcttcgctcacctcatttcctgaaatagcacccagaacggcacctcgaatgatgattcccaatagatgcttctgatcatccaccacggcatatggaatcggtgtttgagaaatttgttccataattgtcgtaatcggcgtatcgggaccagttgttgggacatttttttgaacaactgaatctaatttcgtgattttttgtttaatcaaatccattgcatgactggcatcaacaatgccaacaaattcacgtttattattaaccacgtaaaccgaagaaatttcattttccaacatccgacgcattgcaattcttggcccatctttatcaatattaacaatgtttggccgaatcataacatttgatgcggtcaggacctttgttcgatcaacatcttcaataaatcgttcaacgtattcattcgccggctgagtcaaaatctcttccggagtcccagtttggacaacttgaccatctcgcataatcataatccgatcgccaattcgcaatgcttcattcaaatcatgagaaataaagacaattgtcttatgcaaattttcttgaagatccaacaattcgttctgcatatcttttcggttaagtggatcaagagctgaaaatgcctcgtccatcaataaaatttgcgagtcatttgctaatgcacgggcaagtccaacccgctgttgcatcccaccagataattgagttggatactgatcatcataaccatcaaggccaaccagctctaaagcgtcgtgagctttgcttagtctggtatccctatcaacaccctgaatttctaatccataggcggtattatcaatgattgttcggtttggaaaaagggcaaaattttgaaaaaccatgctcattttcttgcgacggacttcgagtaattgttttttaccaagtgatgttaaatcttgaccatcaattaacacgtgtccggatgttggctcaattaatcggttaatcattcggatcattgttgacttaccactacctgataatcccatgatcacaaagatttcaccatcattgacctcaaagttggcatcagtaacaccaaccgttgcaccaactgattttaagatatcagctttcgacttaccagcctttaataattcttgggcctttggaattcttcttccaaaaattttggtaagatgttgcacttgtaatttcgctgtcatgctttcctcctatcaaaattcatagtgacataacaaaaaacaatttcagaatgacactcccggcatgcggaaatgaaatttgaataattgaataacaggaataactttaacaaaaaatagccaccgtttcaaatatttagttattttatgttatcagttcaattacaatttaatgtgtccaaaagcccatggcattaagaatccagacgtcattattaataatctatgcctaaacaggcatcatagcgactaatggtctatcttatgcggtttacccctaattattcaatttatttcgaatttaatctttttgacgctttaatttgaatcgaaactgaaaaatcagacaaatcatagtgattttctcaaactaattaaagtcaaattttacaattagaaatattcggctttcaagagataaaaaagcttccgatgatctttctgcttaatcggaaactttttttgctagtaaaaatataattaataatgtccacatatcacttgatcttacaaaatctttgaagcaggtttacgcttgttggcagtcaaaaaaatgatgacatcgattgcagctacgacacacatatcaattacgatgtgctggagaaccactttcatgtaaacaacatcatgtataaatgatgactagaaaagcggttaaaatcactattccttatcgtttacgactttattttgaggataattcagtatgatctaatttacttttgaaatctgggtcagccaacaactgatcacacatatccaaaaccatcggtccatatacaaacgtcggtccaccgctcatttccaatgtaacaccaagggcttctttaatctgatcacgagtggctccggccattagggcagatgcggtatgttgaaccatacaactttcgcagcgcatgttaacggccatacttaacgcaattaattctttttcagctggtgttaaggcaccaggttggctggcagtccagtgtaaaatatcaaatcctttaccgggaccagggacctctttcataaaagtctgattattatctaaatattgatttagctcatcaacgtaattagccattgcttttatctcctttatgattaaacgtgtcaaacgctttcaatgcccggacaccatactcaaataccggtccaccattcatcatcagtgcaattccaattgcttctttgacttgatctcgactggcaccacttacaatcgcccgtttgatagtgatgacaatcaacgcatcacttcgcaactgaatagcaattgcaaccgcacataagcgtttaacagcttgtgaaacacggcctttaccattgtttttctcgacaatctgttgaaatacctgacttaattcaggaaattctgacctagatatagaattccaattatctgatccgacagtccctattttctttgaatgtgatactgacaaattcaaaacctcctcgttaaaaattaacgtaaccgatttcattgtagatcttatcaaaaaaagaggctagggtaattgaaaattacctttagtctctttttgatcacaatcacgatataaaatattacatttcatctctttaagcccataaaataagatttcgagtaatttcttaatctcaagtagttaatctggatgtaatttatcaccagatcaatgaactatttctctaataccgtaattgattccacgtgcactgtctgaggaaattggtcaactggttgaactggctgattcacgtggtagccttgttcagtaaataatttaacatcacgggcaagtgttgcaggattgcaggaaacgtaaacaactcgcttgggttgcatctttaccacgctgtcaattagcgtattttccaaccctttgcgaggtgggtccacaacgacaacgtcaggttttaagccatcttcctgccattttgctaactgctcctcagccttaccgaccttaaatttaacgttggtgatattgttaatttttgcgttctttttggcatcttcaatcgcctcaggcacaatttcaacgccgtaaacctttttggcaactcgagccatcgaaagcgagatggttccaatcccacagtacgcatcaatcacaatgtcatcagctgataagtctgctttcttagttgccaggtcatatagcttttcggtttgaactggattgacttggtaaaatgaactggcagaaatttcaaattttaaacccattagggtatcttcaattgttcgattgccagctaatagcttattttctttacccattaagccgttagtctttttgggattaacattttgaacaatacttttaacttcaggaagtgccttggtaatttcggaaataatttctgtcttacttggcaacttctccgttcgtgtaatcaatacaatcatcatctgatgagagtagtggccgcggcgcaccataatattacgaatagttcccttattagtggtttcgttatatggctgaagtttatattttcgtaagatatcacgaacaactacgacagcttcatcaatcttagggtcctgaatataaaaatcttcaatcggtactaaatcatgtgaatgttttcgataaaagcccgtttctaattggccattaatcaaacgaacgggaatttgagctttatttcgatatttatacggccgatccatcccaattgttggatcaacttgaacatcgagtttcatcttgtcaaaatcaacttgaatttggtgttgtttaaaagcaagttgtgcatcatattttaaatgctgtaatggcgcaatgccagtttgagtgtaagctttatccactaagtcaacccggtcagcactcttttgattaattttaaccacccggccaaaggcaaaattctttttaaccttagtgaccttcatcgtgacatcttcagtgggtaatgcgttttcgataaagatggggaaatcatcgattttagcaacacccataccttgataagttaagtcggaaattttgacgtcatattcttgattcttatttactggagcttgtattttcatatattcacctttttttacttagaaacaaaaattgcgatacgaaatcatcgcaacgcaattttaacatactatataaaactattctttgtcagggagtttgtcaacgcctttgacgaagttcttttcaaccaagcgcatctcattggtttcatccgaataagctttgtctggaatttcgtcggtattggcaaaaaactcaatatgctgtttcaaatcaacaaacgtcatcggcgcatcaccaccatattcgccgtcaagattaattagcattcgatcattgacgggtcgcgcagtcactttgcgggtcttcttataaataatccgcggatcatcgacatgtcgcccaccatttagaaccttggaaaccaaatgtaaaatctcgaccaaattactggttttaacaataatcagtgtaaatttaccatcgtccagtgccgcatcggggacaatctgctcaaaaccaccaacagaatttgtaagcgcaaggaaaaacatggatgccttgcccttaaattcaccaccgtcataccttaagtccatttcaatcggcttaattctgggcaataactcagcacccttaaccaaataggcgaggtagccaaacaccgttttcagatcagacggcacatcataagttaattctgtcaacaatccccccgctgcaatattaatgaagtaattttcacctgctttaccaatatccatatgaattgtttgtttctttaaaaccatcttagcagcttcaacagggtcctcacgaggaatgtgcaatgcacgagcataatcgttagttgtaccggcgggaataatagccattttaggacgcttcttaagtggtgcaatcccatttacaacctcattaattgtaccatctccaccagccgcaacgattaactcaaatccttcttgtgctgatcgtcttgcctcatcttttgcagaatccttagctggagttgtcgcaaaagcgctggtttcatatcctgcatgctcaaacacattcaaaatatctaccattttttgttttaataattctcgtccggaagttggattataaattactctggcccgttttcgcataaccatcctgactttctatttactcattgattcttttaataacttgttaaccacttgaggattggctttaccatgagtctgcttcataatttgaccaactaggaaaccaattgcacgatcttttccattatggaaatcttcaaccgattgcggattagcagcgaccacatcgtcaatgatcggttgtagtttggcaggatcagataactgaaccatacccttttcctcaacaaacttcttcggctcttcaccattcgtaattgctttgaaaacttttttagccattttagatgaaattgtgccatctgtgatcaacttaatcatggttgccaaatgttctggggtaatcttagtgtcttgaagttcaacctgattatcgtttaagaattcattaacatttccttgtaaataattggcagctaatttaggatcagcaccatctttgatcatctgatcataaaaatcagacatttccttggtttgcgtcaaaaccatggcatcataatcagtaattccaagttcatcaacatatctttgtcgacgtttagcaggtggttctggcaattcctgtttgatcgaatcaatccaattctgagaaatatttagaactggcaaatctggttctgggaagtaacgataatcatcagaaccttccttggtccgcattaaaatggtttgtccacttacttcatcaaaacggcgagtttcctgtgcaattttaccaccagacattaacacgcgttggtgtcgttgttcctcaaaagccagccctttgcgaacataattaaaggagttgaggttttttaattcagtcttagttccaaattctttctgaccaaccggccggaccgaaatattaacatcaacccgcatagaaccttcttccatcttaacgtcagaaataccagtaaattgaatgacttggcgcaattgttccaaataagcataagcttcatcaggtgatgagatatcaggttttgaaacaatttcaattaagggcgtcccttgtcggtttaaatcaacatacgaataacgggttgcatgggagttcttcccggcatcctcttcaatatgcatctcggcaataccaatttttttctttttaccatcgacttcaatttcaacccaaccatcgtgagcaattggcgtctcagcctgggtaatctggtaagcttttggattatctggataaaaataattttttcgatcaaaatgtggatgtttctgaatttgcgcgtgaagtgctaatccagccatgattccatcatgaacaacgcccttattagttgtcggtaagacaccagggtaaccccaatcaataacgttggtattgctgttgggttgatcaccaaattcgacgggagaaggactaaaaatcttcgaatgagtctttaattcaacgtgcacttccagcccaattgttgtctcaaaattcattagttatttcctcccatctttggtgtttgcttgttaaaatcagtgtcctgttcaaaagcactaccagcttgatacactgttaactcatcataaggtcggccaatgagttgaacaccaaccggtaatccttttgaaaaaccggccggaattgacattccaggtagtccagccaggttaactggtaacgttagaacatcattcatatacattgtcatcggatcggaaatgtcttcaccaattccataagcaggagttggtgctgttggtgcaagaatgagatcaaagtctttaaaaatcttagtaaagtcgttaatcatcaatgttcgtacttgagctgcctttttaaaataggcgtcatagaatccggctgatagagagaacgttccaagcataattcgacgtttaacttcatcgccaaatccttcagaacgggatttaacatagacatcttcaagactcttagcatcttttgcccgatatccataccgaataccatcaaatcgctgcaagttagatgaagcttcagaggatgaaataatatagtaagcagcaacgccatactgagtatgtggcagtgatacctcttcaaccgttgcacccaattttttaaacgtttcagcggtatctaaaacaacttgtttaacgtcatcatcaagtccttgcgccatgaattctgaaggaattccaatttttaatcctttaacacctttgtttaaagtgctggtaaaatcaggaattaccttatctgatgatgttaaatcatggtcatcatgcccagcaatcgcatttagcaccgttgcgttatcaaaaacgttgcgagtaattggtccaatttgatccaaactagaaccaaatgcaattaaaccccaacgtgaaactcgtccatatgtgggcttcatcccaacaacgccattaaatgaggctggttggcgaattgagccaccagtatctgaaccaagtgcagctaacacctcaccagcggcgaccgcggctgcagagccaccagacgacccaccaggcaccttggtttcatcccaagggttatgtgttgtctggaaggcagagttttcagtagaaccacccatggcaaactcatccatatttgttttaccaacgttaatagatcctaagtcatttaattttttgacagcagttgcatcataaattggtttgaaattttcaagaatttttgaagcggcagttgttttaagtcccttggtaaccatgttatctttgattgcaattggcattccagataataaattatttgaatcaatacctttttcatcaatttgttttgcttttttcaaagcaccatcttcatcaaccgtaatgaaggcattaattttagaatcaacatttttaatattatccagcgtctgcttaaccaaatcagtcgcagaaattgccttactggcaagtttctcatgaacactgctcagagattgatcaaaataattcattagttgttatcctcactttcgtcaataatgacaggaactcggatatagccatcttgcgtatcaggtgcattatccagcagtgcttgacgctgattccaattatccgcgatatcttcacgcatgacattaatttgatcagtcacactacttgttggttcaacaccatcagtatcaactttacttaaggtttcaaataaaccaataatctgatcaagttgcgtcgtaaaatacggtaattgatccgcattgattttcaacttggccagttcagcaacgtgttttacttgatcttcggagatcttttcagtcattgatatccttctctcttctgaaaataattaatttaacaacaattgtcattttaccatataaataatgttattttttcaaaaatcagtaactattaaagatatgcgctgaaaatttcttttcatttgctttacgacttaagaagctctgaatcccttccgtagattgaacggtaatgtcaatcggcgcattggcaggtaagtatttttgagcagcagtttgaatatattgagtaaaactaatgatttcggtctggctataaaactgggtcgtaatattgatattcataccgcttagcgacccgtttgtatactgagcctgtgccgttacaccacttaagttagggaagaaactctgtgtctcagacttaaagttagcgaaggcatcctcatcattttgacttggccccttttggctggactgaagtgggaaaacataatttttttgtttaattgccgtccatttattaatctttgaggatccctgtttgttaacggaataagtaaagaaatttccaccaactaaactgtcatcagaagcttgcttatacaaggcaatgacgattggaatatttttgagcgcttttttacttcgtaatcgttgaagaacctgattagcaatctctttaccatgctggctgacttccatgttggagatgtcggtctcaaatgttggcccatactgcgtcttcttgtaataatcgacagaattaatggctaatccaactgtcatcccagataatttaagcgatttaccggttcgcgtcatgtaatcctgctcattaatctgagatagataaaccggtgtccgggtctttggattagttgacttggatttcttggggttcaaaccagtcggattggattttgactttcgacccagccatgcctcaacttgcttagttgaaaggtattgcccctcttgaaagatatattctttggttgaaaattgatttttggaaatgttcaacaagccattttcaaaccctttaatgttaaattgattagactcctgttggacactaacaccacgagatttactcgtttggtatcgaccgttcttaatgactccttgataataaccactattggtttgaccagttagttgcgtcttggactttgatccactggaactgtttgtatcactggacagattatcaacactgccacacgctgccagcataacaccggtcaggataattgaaatcccaaggattatttttttcaacattgattcctccattactactcttcatcattcatggtttcgcgaaaacggttttcattccaaacttcaacgcccagacgtttagctttatcatacttacttcccggatcttcaccaacaaccacgacatcggtcttctttgaaacagaactgctaacgctagctccatgatcttctaaccactgagtagcttctggccgtgtaatggcttgcagcttgcctgtcaaaacaaacttcttcccattaaacacagaatcactttgttcaagttgcgcatcagtaacacccttgtaagtcatattaaccccgacttgtttaagctgtgcaatcaattcttgtgactccggcgtcgaaaaataagtgacaacactatccgcgataatcattcccattgtatcaatttcagcaatctcttgggcggttgctgctataaccttatcaatatttttaaaacgttgtgcaattaatcgtgctgctttaataccaacgtgtctaattcctagaccatataacagtcgctcacaagaattgcttcgactgttatcaattgccgagagtagattattcgccgatttctcaccaaatttgtccaaagtaatcagctgatcaaatgttaagtcatatagtccagcaacatcattcaacatatgttttttaaataactgagcaataattttgggaccgagtccgtcaatatccattgcatcacgagaagcaaaatgagttaatccttcttggagttgggccggacatttagggttaatacaacgtaatgcaacttcctcatccaaatgaaccagctcagaactgcaggagggacactgtgttggaatagcgtatggttgactggtcattaaccgtttggatttaatataagttgaaatttcaggaataatatcaccagctttgtggagtttaaccgtatccccaatccggatatccttctcctgcaaataatcaggattatgaagcgacgcgcgactaactgtcgtcccagccaaagtgacttcatccattactgcagtgggtgtcacaacccctgttcgaccaactgtccaaacaatatctctaacaactgtctctgcttcttcaggtggaaatttatatgcaatagcccaccttggcacttttacagttgcaccaagtgatcgctgaagctgcaatgaattaaccttgataacaatcccatcaatcccgtatggtaacccatcacgacgttgcgtatatttatccacgtaatcattaatctcggccattgaatgggcaacaaaataatcaggatttatttcaaatcccaatgctttcagttccgctaacatgccactttgggtgtttgactgcaaatcatcaatatcagcaacattgtacataaaagtgctgagtttccgatgtgcggttactttgggattcaattggcgcaaactcccagcagctgcatttcgcggattagcaaatggttcctggccattattttgccgctgctcatttagtgaaacaaatgaagacttaggcatatagcattcgccacgaacttcaatgttgattggccgggttaatttttgtggaattgacttaactgtcttcaagttacgggtaatatcttcaccaatctgcccatttccacgagtagacccttgcactaggcgaccattttcgtaccgaagagaaatcgctaaaccatcaatttttaattcacaattatactcaaatgttatggaatctgtttcagcaagacgatcaacaaattcggccaattcatttgttgaaaagacatcccctaatgacagcatcggaatttcatgctgcacctttgaaaatcccggtaatgtatgatcccctactttctgagttggcgagtcttgcgtaatcaattgagggtatttggtttccagttcgacaagttgttggtatgttgcatcataaacagaatcctcaacacttggtgaatcataagtgtagtactcatctgcccacttatttagtttctcacgcagttcagaaacggtcttgaccgcttgctgctcagtcatattttccgccacaaaaagcaccttctgttaatatttttatcaaactaaaatgatcattttagttacttattaattggttcaagatgtttaacaatccgtgcaggtgtccctaaagcaacagaatcattagcaatatcgtgagtcacaacgcttccggcaccaatgacaacgttactcccaatggaaacaccaggcaaaattgaaacgttaccgccaatccaaacatcatcaccaatattaattgacttgctaaattgtgcaccatgacgccgatcacggccattaaggggatgtcctgttaccgatatcatcacgtttggcccaaacatcacatggttgccaatttcaacactcacatcatcgacaatggttaagttaaagttggcataaaagtcgtcgccaatcgtggtatggtttccataacttgtataaactggcccttcaataaaagaatgcttaccaaagtatttaaatagttggtgtaaaatcgattgccgctgatcttcatcatctggatctgtttgattatatttgaaagataaccgcttgcttctcaagcgctcgtgagccaattgctcggcataggcaatatccaccggatcactaaaacccgattcttcatatatatcaccatgattcattgcttctttcagactcattaaaactcccccattaactatccaggcttattgttgtgcacatttcataatttaatattagttaattgtgcctggttaaacttgaacttttttaattggtgcaaacgctgctaataatcttttaattccctgtgattgaaacgcaatatccaattccatgtcttcaccagttccagaaactttaacaactgttcccgtcccccaagccttatgggaaactttatcaccaacttcccaagccttcttatcagcaccggttcccttgggtttttcaacaatttgggatggtcgatgatatgtggttgctgttgcacgacgtgtccgacgatcaaatggtgttgagatcgggctttcagtctgcttaggattatcataatgcagtaattccggtttaatttcatttacaaaccgcgattccggatttgtctgtcgtcgaccatatagcattcgggaataggcatttgtaatgtatagtttctccttggcccgcgtaattccaacataggctaatcgtctctcttcctgaagttctgattcatcttgggcagcccgagaaagagggaacaaaccttcttccatccccataataaatacaaccgggaactctaggccttttgccgcatgaagtgtcatcaatgtcacttgggcattatcgtcttcgaggtcatcttgatcagaaaccaatgccaaatcacttaaaaaattaaccaagttttgctgacccgtttcaccctgattttctgaatcgtacttttgggtaactgagataaattcttctaaattttctaacctggactgcgactcaagtgatttagaagcttttaacgtactcaaatacccactttggtcaagaatctcttgggcaatttccgtaattgacattgtatctaattttgcagcaattaaactcaccatttgctcgaatccaccaattgaatttttggcacgagttgaaatttcattagctaaatcgatgttcttagctgcctcaagtaaagaccagccatgatcattggcaaaagccctgaggcgttcaatacttgcctgaccaacaccacgttttggttcattaataactcgttcaaaactcatcgaatcatccggatttcctagtaatgttagataagaaagggcatcccgaatttccttacggtcgtaaaatttatgcccaccaaccatcgtatacggaatattggattttagcagcgtctcttcaataactcgtgattgcgcattggttcggtaaaggatcgcaaaactaccataatctcgtttagcttttgccatttcttcttgaatcttagcaacaacatagcgagcctcatcgttttctgtttgcccacgataatatgagatctgctcgccctgttcattttctgtccataagtttttatctgctcgattatcgttatgtgcaataactgaattagcagcagccaaaacagtttttgtcgaacgatagttttgttccaaaagcgtcacatgggcatctgcataatccttcttgaagtccaaaatattttgcatattggcacctcgccaaccataaatactctggtcggcatcaccaaccacacaaatgtttcgattcttctgtgcaagtgtgtttaccagacggtattgtgcctcattggtatcctgatactcatcaacgtggatataatgaaatttatcttgataatacgccagcacatccggatgtgaatcgaagagttcaatcgtcaccataatcagatcatcaaaatctaacgattgattctgctttaactctgactgataacggtcatagacatccgcaacaattttatcaaaagcactaactgctttttgacgaaatgcttttggcgtcaataaatcatttttggcattggaaattgagccaagaattgaacgcgggtcaaacttctttggatcaatattcaactcccgaagaacacgttttactaatgttcgctgttcgctggtgtcggcaatcgtaaatgcacgattataccctaaaacatcaatatatcttcttaaaatgcgcacacacaacgcatgaaaggttgagacccaaacatcattgccaccttcaccaagcaattttgatacccgttcacgcatttctctggcagccttattcgtaaatgtaattgccaaaatgttccaaggcatcacatgattatgttcaataatataagcaactcgatgtgtcagaacacgagttttaccactccccgctccagccataattagaacaggaccctccgtatgaataacagcatctttttggtctttgttcaaaccttctaataaactttcttctgccaatgaattttccatcctctcgcaattatccaatcaattataccaaaaaatataacgactcgctttatatgaaaaatggtaagttggccgtcaaaaaaatttctaatcatttcaatattgatatataaaaacaaaatggccggtgacaaaataaaatttgtcccagccatataggcacctattgttgcttctcatactttgttttaaagtcaatatcattccaaattccagttgcttcaacttgcattaacgtgcttgataatgactttgtcggaataaggacatggccaactgacacttcatcatttttaggattgtttccataaaatgtaaaatgccaattatccttaatgacccattgcgtttgcacacgttgatactccttttgtcggatagtttgaaaaatagttggaatgccggaaatcgtttttgtcaaaggtaacccggcaatcgctctaagatgttgttcgaattcatttgcattagtcgcgtaatcaaatacaaagccagcaggactaaggactggcgctacacggttaacatagattgaaccattcttagctaaaaataatgacacttcaaaagttccaacgtaatctacattattggcaatttctgaggtgattcgtttcatctctttgtcaacatctggatctaacttagctggtgtaaaagccgtcatgatttgttcaccgtgataaataacttccacagttggaaaaataacccgtgagccgtcttcttttcgagtaacaattattgaataatcaatgtcatgaacaacataggattcaagtatgtaagttccagcatccaacaaccccgaggcagcaacaatgtccgcttgattcttgatcagtaattctttgccacccagcaggccgcgttggataggtttaagaattgcgggataaccgatcgaattgattgcctgatacacatcttctagcgtcacaattgtcgcgtaaggtgccatattaatatttaacgtttcaaaaaagcttctttcaattagccgatcttgaatgatgtccagtaaactatctttttgtggaacagaagtaaatttagaaatatagcgaataatttcagagtcaatagaatcattattgtacatcacaacatcacaacgttcagcaaacatttttaatgcctgtttatcattgaggggtccaatatacttatagtcagctagctgcatggccttgctattttcgtttgaactatacataccaacattaaagcccatcttctttgcacggacaagaagttctggactactgatactatcaccaagaatgccgattgtttgacctggataaaggacatttgcatttgccaattaattcactactttcatattgtcattacttaacaagctgattcttatcatttcgataataacatctgctcattatactataaaccgattattcaacaaaagtaacgctttgatctttgagtgatgcgattctagcaagcgattcaagacggatcccagttttttcaatcatcgcatgtcccttttgaaagctcttctcgatgacaatgccaatcccagaaacagaaacgtccgctaatttagcaatttccagaagtccttgaactgcctgtccattcgccaaaaagtcgtcaataattaaaatatgatcgtcagcgtttaaaaatcgtttatcaatactaatattgttgctaactttttttgtgtatgaataaaccttagcggtatacaaatcatccgtcaatgtaacacttttatgtttacgtgcgaaaatcaatggaacacctaagtgaattgcagtcgtaagtgcaggagcgatccccgaggactcaacagtgactactttggttattttttcatccttgaataggcgggcaaactcctcaccaatttgatccatcagcttagcatcaacttgatgatttaaaaagttatcaacttttaaaacattccctggtaatacggtgccgtctttcttaattttctccttaagtaaatccattatataaattcctttctaatcatcatactgatataacttgtaatttcgaataattgaaaccaatttttctgtgtacgctggatcagttgcatagccatccttttgaagggcatcggctgcctgcagataattttgggccgcaagcacatcatgatattgttgcgggttccattgcgttccttgcgcaagtaaacgtgcatgatcagttagcgaatcatcccaactattataaacctggaaacgagctttaacggttatataacgaccatttacgaattcctgtgtgtcaaggtaaactgagttgtttgaaccgctacgggcttttacaccgaacaaattgtagtacttacttgcaagttgactgtctccccagtcagactctaaaattgcctgggctaacgtaatactcggcaatatgttatactctccttgcaatctctgtgcttgtggtgccaacgttcgaatgaattttcggtgttcaactgctaattgatccgttgcattttctacttttgtggcatccgaaacactttgagatagtacgcgaaatcctatcgtaatcattaatgcgagaccaatgagcacaatcatgacaactagatttgattttttggcgcgtaatttccgcctctttctgtatttaaccaatgtatcctcaaactttctgactttcaaaactaattttaactataaacgatactaaagacaattgctattttcaaatgataatcaatttaaccctttataattgacaaattaagtaatatcggttatgttatcacctgacacttaaaatctggagatgaaaaccaatggctaaaaacaccgaagtatcagaagcacaatcaaaatttcacgttggtgacgaggtttcatttaagatcgaaaagcaaacgttcaagggttatattgataaaagttataccaactcattcttaattacgtttgaatctgatgatcccgaaataattgacaaataccacaagaaagtggttatcaacaaccgtcatttgaaaatgatcaaagctgcgccacaacctgttgaagacgacagtgatgatgacgaagacgacaaagaatcaacgaaatccaacaataataagaagtaaattcttaaagaggctgttagcaatatcgtttgttttgctaacagtctcttttttgctacctaatctgtttgcttgctatgtcttcgaattagtaactaccttcctcgtcgatttaatatattcccaagaggcaccgcaattaatggtgtgacaacaccactgaaaattgcttcaggaatgccgttggttccaacgacccctaacaaataaggcaacaaatcctttaaattaatttgataaagctgtggtgcttttgccttgtaaaagacataaattaaacccaagacaaggattgtattggtaagggatcctaaaactgccgctactgaaacactaactgaccgcttggcaattcggttttttaaggccttatatgtcatgccggcaacaactgcaatcataattctaggaaatattgagacaattggattaacaaacacaatcgcagctaaagggcttgtgggatacgcaaaagcacgaatgaatgtaaccagtccccaaacaccacctatgatggcgccgtccaaagttcccatcaaaattgtcgcaatcacaactgtcacttgaataatcgtaatgtccagtgtcccaattggaatatatccgattaatggaattgaagtttgtaaaataataatggcaatgaacatcgcaagcaagttcaatctaagagtacttttcttatgttgcataacctgtgctcctttaatttgttgcatacattatacaataccagtccatattctagtacgaatatgaaacggatttactaattcaaactttttttaacataatcgcaagaaagtaatagtgaatataaaaaaacacctctccgaagagaagtgtaaattctgagaagaatataaattttaacgctttgaaaattgtgaagctttacgagcctttttaagtcctggcttcttacgttctttcatacgggaatcacgagttaataatccagcacgcttaagtgggccacggaaatcagggtcaacagaaagcaatgcacgggcaattccatgacgagttgcgccagcttgacctgagaagccaccaccgttaacgttaactaaagtatcgtagttaccaagagtttctgttacattaaatggttgcacaacaacttcacgcaaattagcaaatggaatataatcttcaattgctttatcattcataataatttttccagttccgggtactaagcgtacacgtgcaactgaatctttacgacggccagtgccgcgatattgtacttgagccaatgcgaattcctccttaaattaggttagtaatgtctaatacttccggcttttgagcttgatgttcatgatcaggacctgcatagacatgcaacttcaaaccgatcttatgacctaatgttccatgaggaagcattcctttaactgaagcttcgatcaatttttcaggattcttttcacgaaattctccagcagttttttgcttcaagccaccaataaagcgagaatgatggtaataaattttacgagtatctttatgacctgttaatttcactttacttgcattaacgacaatgacattatcccctgtatcaacgttaggggtaaaagtaggcttattttttccgcgcaaaattgatgcaacaactgatgagagacgtcctaaagcgacatctgtagcatcaacaatgtaccatttacgttctacttcgcctggttttgctatatatgttgtacgcacttaaatttcctccatgtttctgtgtttgttcgacaccaaataagattccggggcttatcgtggggcaaacaataccaaataccatgatacaaattatttattggaaagtcaattagtttcacaaattatcgggcacaaattatcgaaggggtttcgccagcttagttgggtgatcaggatcgtcaccttcataatagacttttttaagatataatccggaagcaggcattgtaagtcgtgcttgagttcgatccttggcagtgtatagacgcggaatatcatcaactggtcgtcttccagacccaatctcaacaacaacccccaccatgattctaaccatgttatagaggaaaccattgccgtagaattcgagttgcagttcgttaccatttttgtcgagtttcccttttgcttcataaatcgtgcgaatgtttgaacgagctgttgaccccgatgcaacaaagctggaaaagtcatgttctccaacaaaatcactcaatgctgcttgaaccttattcatatcgattgggaatcgccaatgccctgtataatgacgcttaaacggattttgaaattcgccaagatccaatcgatagaaataacgtttcccagaaacatcatatcgggcatggaattgatttgaaactttttcaactttcacgatttccatgtcaagtggtagcagactgtttaatccacgatacactgcttcaaccggcaaatcaaacggaaagtcaaaatgaacaacttgtgccaatgcgtgaacaccggcatctgttcttccagacccataaacaacaattgacggatgaggatttttagccattatattaactttttgtgtaataacaccttcgatagtccgctgttggggttggcgttcaaacccgctaaaaagtgtaccatcgtatgctaacgtaactttataccgaatcattttttcctaccatttcctaattcctaataccaatacaccgacagccaagaagaccagccaactaattgtatctttcatctgccaacgatatattcgatatttactacgatgttcactatcggtaaatccacgagcctccatagctgtcgacagattttcggcatggttaattgcaccagtaaataagggtactaataaaggaactgcagctttaactcgatgttttaaactgccagaaccaaaatctactcctcgagaacgctgggcattcaagattgtttccatttcatccattaatgttggcacaaaccgtaaggcaattgataacatcaacgccaatgtatcaactgggaaatgaaaccctttaagcggcttcaaaacagtctggaccccatctgcaattgcgagtggcgtcgttgtcaaagtcagaactgtcgaaatcataataattaataaaaatcggataaagataaaaccaccgttaattaaactttgatctgtaattgaaaatggtccaaagtgccacaacattttgccaccgctgctaaataaaatttgaagtaaaactgtgaaaatgattaaccaaatcagtggacgaattcccttaagaaagtaactaatcgagactcctgaaagaatgatgactcccataatcaatatcaacaaagcggcataagaagctatgttattggcaaaaaagatcactatcacaaaataaaaactcaataataactttgactgaggactcatctggtgaacccatgatttacctggtaaatatcttccgaagagaaaattactcatcctttttcccctccttaccagcaatttgcacaatttgatcggccagctcatcaattgtcagcggtaatgtttttaatttaataccagtatcgatcattttttgagcaaaaagtgcactactaggtaaatccagctgcatcttatatacccatttaggatcgctaaaaatctcttttggcggacccaccttaacaatttttccctgatccattaccactacattagaagcataatcaaccacatcatccatttgatgggtcaccaaaataatagtcatatgattgtgatcatgcaaatggcgggccaagtccataatttccttatgaccacgcggatccagtccggcagttggctcatctaaaattaaaatttccgggttcatcgccaaaacgccagcgatcgcaactcgccgcatttgaccaccagagaggtcaaatggcgaactatcactgaaattcgcatttaatcccactagcttcatcgcgtttacggctgattttctagcctcttcttctgttgcgccataatttaatggtccaaacataatatccttaataactgtctcttcaaataactgtttttcgggaaattggaataccatcccaactttttttcgaagttgttttaaatttttgttggttgttttcggcgtaataattcgatcaaaaacgctcacagtgccatcagtcggctttaacaacgcattaatatgttgaacaagtgttgattttccacttccggtatgaccaatgatagccgtaaatgagcctgattgaattgtaagtgaaacattttccagtgcattttgagaaaaaggtgtatcaacctgataagtgtgcgttactttttcgaaattaactgctttatccatgctattaactcctcatcattcaggtaacttcgttggggcttaatcccacgatgtttaagggcagccagtaactgggatgtgtaaggtgaatcaagcccaactgactgcaattggcctgtgttttgaaaaatattttctggtgtctcctcgtcaataatccggccttcatttaaaatgacaactcgatctgcattggcagcttcatcaatatcatgggtaatcgaaatgacagttagttgattgtcttttttgatttggtaaacgagatctaatatttcgtttcttccacgagggtcaagcatactcgtagcttcatcaagaataattattttgggacttaacgccacaattccggcaatcgcaacccgctgtttttgaccaccagataagtttgcaggaattcgattacgaaaatccagcatgctgacatccgttagactttttttgacaatctcatgcattttttcacgtttaacttgacgattctccagtccaaacgcaacatcatcttcaacggtagctccaacaaattgatcctctggattttgaaaaacgatgccaattttattgcgaatatcaaaaatattttgatcgttaaccgttaaaccatctacgataatctgccccttatcaaggacaattaatccgtcgatcaatcgtgcaagcgtacttttcccactgccattttgaccaataattgccaaccattcaccctcgtgaacatccaacgttaaattatcaaaaagcaatggcttatcaggataatggaatgaaatattttttacttgaataatattcttcattagtagatacccttcataatgagattacgttaccaatttatgtacaaaaaaatcactaacaggtattagtgcatgagatagataacatatctcacattcaaactagactaggaagtatgttccaccatcatagcgttctatactaaaaacccgagtgattctcgttgaaaatatgtgattgaacttaaatactaattagtcaactaattctaaaacaaccattggtgcaccgtcaccacggcgaggcattgtctttagaatccgtgtataaccgccatttcggtcagcatacttagtggcaagttcgccaaaagttttttgtaaagcggtagtaacagtaatatcgtcaccatcttctttaacatcagcaacaacgtcacgaatgaatgctgcagcttgacgacgagcatgtaagtcaccacgcttgccaagtgaaatcatcttgtcagcagtagaacgaacttccttagctctagcttctgtggtaatgatttgaccatgaatgattaattctgtggtcaaattccgaagtaatgaacgacgatgtgcgctggaacgttgtaatttccgataactcattttcagatattcctcctttttactttaattagtcttctttacgaagtgaaaggcctaatgcagccagcttttctttaacctcttcaagagacttacggccaagatttcgaactttcatcatgtcagcctcagtcttttcagtaagttcctgaacggtattaatgccagcacgtttaaggcaattgtatgaacgaacagataaatcaagttcttcaattgtcatttccagcattttttccttatgggtttcttctttttcaaccatgatttcagtattcttagcttcatcagtcaggtcaacgaacattttcaaatgttctgttaaaatcttagctgccaagctaactgcctcacttggagtaattgaaccatcagtccagacatccaaagtaagtttatcataatcatcacgttgaccaacccgtgtactttcaacttgatagttgacacgttcgattggggtataaatagaatcgacgggaagcacacctattggcatctccgaactacgtttcttattttcaacagctgaaacatagccgcgacccttgttggctgttaatcgcatatggaaagtagcgccctcagcaacagtagcaatgtgtaaatcaggattcaatacagtcacatcactgtcaccttgaatatctccagcggtaacatcagcaggaccaataacatcaatttctaaattttcttcttcgtcttctggtccatctaatttcaaagaaattttcttaacattcaaaatgatctgggtaacatcttctacaacacctttaatggttgagaattcatgcagaacatcatcaatttgaatgctggtaactgcagcaccgggaagtgatgatagtaaagtccgtcttaaggaattaccaagggtagttccatagcctctttcaagtggctcaacaacaacttcaccatagttcttagtttcttcaatcttatgaatgttaggcttttcaaattcaatcattcttatcattaacccctttcaaaacgcgtgagtctacatgcaaaatatcaatatgcccaaaccaaataaacttcactatattgaatgtcttaattaaactcgacgacgctttggaggacgagatccattgtgaggtaccggagtaacatcacgaatagcagtaacttccaaaccagtagcttgaagtgcacggattgcagcttcacgacctgaacctgggcccttaacagcaacttcgacagacttcatgccatgttccattgaagcctttgcagcagcttcagcagccatttgtgcagcaaatggtgttgattttcgacttccacggaagcctaatgcacctgcagatgaccaagaaacagcgtttccttgaacgtcagtaatcataactaaagtattgttaaaggttgaatggatatgagcaacacctgaagcaatgttctttttagcccgacgcttacgacttgtctttttgtttaccataaaaacagatgacctcctttataaattattttcttctacctgcgtttgcagtagccttacctttacgagtacgagcattgttcttggtattttgaccacgaactggcaggccacgacgatgacgcattccacggtatgaaccaatttcttgaagacgcttgatattcatacttacttcgcgtcgcaagtcaccttcaattttaagatcactaacgattgcacgaatcttatcctcttgatcgggtgttaagtcgcgtacacgaacatcttcagaaacaccagcttgtgctaagatcttttcagcagtgctagcgccgataccaaaaatatatgttagtccgatgacaattcgcttatcacggggtaaatcaattccggcaatacgagccatttagcatacacctcctgtttacgtttatttaccttgacgttgtttgtgctttgggtttgctgagcaaataatcattactcggccttttctcttaattactttacaatgttcacacattggtcgtactgatggtcgtactttcatttttaaacctcctcaaaaaatgatgaaaacgacaagttacttaaatcgataagtaatccgccccttactcagatcgtaaggtgacatttcaaccgtaaccttgtcacccggtaaaatccgaatataatgcatgcgaattttaccagagacatgggccaagatttcgtgtccgttttcaagttcgacacgaaacatcgcattaggcaatgtttcaacaacttttccttcaacttcaataacattatctttagccaatatataacacctccaatgttaaattagattgaatttatattaataaacttgacaaacctttgatagtctaacacattcactatatttcatcaatccaatagcctcaacactaaataagtgaggcgtttataaagaactcaagatattatcaacatttttccaaacatcatcaatgcctttgcttccgtcaacattgaagagaaggttacgatcttggtaatatgaaatcaatggtgtattcatcttaacattaactttcaaacgattcttgactgcttctggtttatcgtcttcacgttgataaaattcatgactaccacaaacatcacatgtacctggaactttcggcatatggtacaacttgtgataagttgcaccacatttcttacaaataaatcttccggatagccgctcagtaagtaatttaggatcaacatcaatattaataacagctgataatggtttgctcaattcatctgtcatatttgacaatgcatccgcttgatctaaagttcttggatatccatccaacaagaaacctggtttagtatcatctttatccagacgttctttaacaatgccattagtaacttcgtctggcaccaaatttccgttatcggtgaaacccttggctttaagcccaagaggtgttccattagaaattgcttctctgaacatatcgccagttgaaatatgtggaacatgatacttatctacaataaattgtgcttgagttcctttacctgcaccgggtaaacctagcagaatcaaattcaatgacatttaaatgcctcctcgttgtttggcaattttctaattaatcttcagtaggtcgtgatcctttgataaatccaacgtactcacgtttcatcatcaatccacgaatctgacgaatagtttcaattgcaaccccaacaacgatcaaaagactcgttccaccaagtccaattgattcatcaagattccataagttctgtgcaattaacggaattaaagccacaattcctaggaacaacgaaccaacagtactcaatttcataagcaaatttgatacataggtctgcgtctcatgaccaggccacacacctgggatataactaccctgcttttgcaaattctctgacaacttttcaggattgacttggacaaaagcatagaagaatgtgaacataatgatcagaatcgtataaaaagctgctccagtaggtgtctgcatattgaaaacattattcaatacttggaaccatgttgcagttgaatagttgttttgaaatgccattaaaatagtttggggggtcgcaataaatgaacttgcaaaaattacgggaataacaccagccacattaacttttaatggtaagtaactactatccggtgatccagcaacccttcgcgtatactgaattggaactcttcgctcagcttgttgaacccacgttacaaacgttataatgaccaatacaatgatcagaagtgcaactgcgaacaaaataggttgccataaatcagaaccagtcacaccaacaaaatattgttgccacaatgattgcagcccaacaggaattcgcgcgacaatcccggcaaagataatcatagagataccattaccaattccacgctcagtaatcatgtcacccatccaagttgtcaacatcgttccaccagttaaaattaaaccgataacaacaaatgttttaatacttgggttggtaacaagattcaaactactcaattggttgaaaccagctgtgattccaactgattgaaagaacgcaaggataacagttaaataacgtgtatgttgatttaatttacgtcgaccaacttctccttgcttcccccattcaacatatcttggcacaatatccatttgtaatagttgaataataatttgagcggtgatataaggtgaaactcccattgcaaatatagaatagttggtaagcccaccaccgctaaaggtatttaaaatactaaccaagcctgaagatgcaacagactgaagtgctttcgcgttaataccgggaaccgttatgtaagctcccaaacggaaaatcactaaaacaaaaagtgtaaaaagaattttatttcggatttcctttactttgaacgcacctgctaaagtcgagagcattaaaccacctcgattttaccgcccgcgttttcaataacggattgtgcagacttggaaaatttattagccttaacggttaacttcttactcaattcgccattgccaagaaccttaattcctgattttgcatttttaacaattccagattcctggagcaattctggtgttacttctgtaccatcatcaaacgcattaagattcgtgacatttacaacagcatattcttttcgattaatgttattgaatccacgttttggagttcgacggtacaatggcatttggccaccttcaaaaccgatacgggtcttgccacgagccttttgacccttttgaccacgtccagcagttttacccttaccagctgatcggccgcgacccttacgagtacgtaatgaacgagaaccttcagcagctttcaattcatttaatttcatgaaattggcacctccttacaaatttttagtctttaacttgttcaacttcaattaagtgagcgatttggaatagagccccacgaatagactcgttatcaggtttgacaacagtgctatttactcgacctaagccaagtgccttcacaattttacgttgctttgggaggcggtgagtcacgctacgttttaaagtaatttttaattgagccatttaaaacaccctccttattcagccagatgttgagttgaaacaccacgtaaagctgaaatttcttcagcactcttcaattcaaccaagccagcaaaagttgctcggattacattgataggagtattcgaacccaatcgtttactagtaacatcgtcaacaccggccaattccatcacagaacgaacagcgccaccggctgcaactccagaaccttcttcagcgggcttcaacataattcgaccaccaccaaaagtaccgacaacctcatgaggaattgttgtgccaacaatcggaacctcaatcaagtttttacgagcagcttcgacagctttacggatagcttctggaacttcttgagctttaccggttccaaaaccaacatgtccgtgcttatctccaacaactactaaagcagcaaatcgaagacgacgtccaccctttacaactttagtgatccggttgattgaaacaacgttgtcttcaagctcaagtttatctggatcaataaatttcttcatgtgcggttattcctcctttattaaaattctagtccgttttcacgagcagcatctgcaagagcttgaacacgaccatggtacaagtaaccaccacgatcaaaaacaacctttttgattttcttttcattagcacgttgagctactaatttaccaacactagctgcttgttcagtcttgtttgaactactgattgcagaatcaagtgttgaggcactaacaagcgttacaccctctacgtcatcaatgatttgagcgtagatgtttttattagaacgaaaaacgttcaagcgtgggcactcggcagtaccagaaattttgttacggacacggttatgacgacgtttccgacttttattcttatctggtttagaaatcacaatagtcacctcaaaattttattaagctggtattttatttaccagtcttaccttccttacggataatatgttcattttcataacgaattcctttacctttatatggttcaggagaacgaacagcacgaacagatgctgcaaaatcaccaacaaattgtttgctgataccactaatatgaattgttgtattatcaggtacttcaaccgttaagtaatcaggtaccttaatttcaacagggtttgaataaccaacgttcaaagttaaagtcttacctttaagttgtgcacgataaccaacaccaacgagttttagtgtcttcttgaatccgtttgtaacaccttcaaccatattgttgaagttagcacgagttgttccgtgaagtgctcgaaccttatcattgtaatctgcaattggttcaaaattaacttcattgtccttgacgttcatcttaatgacagatgaaatttctcgagtcaatgaaccctttgccccttttacagttactttgtttccatcagcttttacctcaacacctttgggtaaaacaactgtcttataaccaattcgactcatcagttacacctccaattcaatgaatttttaccatacataagctagtacttcaccgccgattttttgggcccgagcttgcttatcagttataacaccattagatgttgaaataatagcaataccaagaccgtttaaaaccttaggaacagcatcagcttttacatatgaacgcaggcctggttttgaaattcgcttcaaaccagtgataacacgttgtttatcttttccatatttcaggaaaacacgaataacgccttgcttgtcatcttcgatatattcaacatcgcgtacaaaaccctcacgcttgagaatttcagcaatgtcgcgtttgattttagatgcagggacttcaactgtttcatggtataccatgttcgcattacggatacgagttaaaaagtctgcaattggatcagtcatagacatcagcgcacaacctccttttttatattaccaactagctttcttcatgcctggaatttgacccttgtgggcaagttcacggatgcaaagacggcataaatggaatttcttgtatactgaacgaggtcgtccacaacgctcacaacgagtatagttttgtgtcgaaaacttcgctggacgttcactttttacaattaatgattttttagccaatgtgaaacctcctcattatctggcaaatggcataccgaattgagccaacaattcatgtgattcttcatcggtgtttgcagtagttacaattacaatatccaaaccgcgaacacggttaacattatcataatcaatttcaggaaagatcagttgctcccgaacacccaacgtataattaccacggccatcaaaagcccgagcacttacaccgtgaaaatcacgaacacggggtagagaaacattgattaacttatctaagaaatcatacattctatcaccgcggagtgtaactttagcaccgattgacataccttcacgtaatctaaaaccggcaattgatttttttgccttagtgactaatggtttttgaccagaaatgagagctaattcagagacagcctcatcgaggtttttagcatttgtaactgcgtcaccaacacccatatttaaaacaattttatcaattttaggagcttgcataactgatttatagctaaacttgtccatcatgtgtggagtaatttcgctagtgaatttttctcgtaaacgacttgacatttaaaaggtatcctcctttcctatcttaatcaatcgctttttgcgacttctttgagtaacgaacttttttaccatcttcaactttaattccaacacgagttggttcattagttgatggatcaataagcataacattggaaacgtggatcggtgcttcagcatcaacaatcccaccttggggattagttgaagaagctttagtgtgcttctttaccttgttaacaccttcaacaatcacacgatctttagaagaaatagttttcgtaacagttccttccttacctttgtccttaccactaataacacgaactttgtcaccagttttaacgaacatttatggcacctccttatatcctggttgtgattaaagtacttctggggctagtgaaacgatcttcatgaagttgctatcacgtaattcacgagcaaccgggccaaagatacgagtgccttggggactcttgtcatcacggatcaaaactgcggcattttcatcaaatcggatgtatgaaccgtctgtacgacgagtaacagccttagtacgcacaataacggcctttacaacatcaccctttttgacaacgccacctggtgttgcttgtttaaccgtagcaacaattgtatcaccgataccggcgtaccttcttgttgaaccacctaaaaccttaatagttaacaattcccgtgcacctgagttgtcggcaacttttaatcgactttcttgttgaatcacaggtatatcctcccttcatcgctaaatcaaaatacgataataataattaattaaagttaaataataaccgctttttcaacaatctcgataagacggaaacgctttgtctttgacaatggacgagtttccataatacgtaccgtatcgccaaccttagcttcattattttcatcgtgtgcagtaaacttctttgaatatctcacacgcttaccatatcgcggatgcgtcttaattgttgatactaatacagtgattgtcttatcacctttatcagagacaacgcgtccttgatagactttacgctggttacgttcttcagccattaattatacctcccttatcgtaattatttgtttagttctttttgacgaagtgcagtcttaatacgtgcaatgttcttgcgaacctgttttaatcgcgcagtattttccaattgacctgtggctaattggaaacgaagattgaacaattcatctttataatctttttctttatcaatcatttgagcagtggttaattcattaatatctttagccttcatctgattcgccacctacttcctcacgttttataactttagtacgaacgggaagtttcattgatgcaaggcgtaaagcttcgttagcaacttcttcactaacgccaccaacttcaaataatacctttccgcgcttaactggtgaaacccagccagcaggtgtacctttaccattacccattcgaactccgacacctttttcagtgtatgacttgtgagggaagatcttaatccaaactcttccgccacgcttcatataacgagtcattgcaacacgggctgcttcgatctgacggtttgtaatccaatgtgaatcaagggattgtaaaccataatcaccgaaggtaaccgtcttaccacccttagcagagccacgaagcttgccacgatgttcacgacgatgttttacacgttttggtactaacatgtttatttccctcctttgtcagcgttactgctctttggcttctcagggagaatttcaccacgatagatccaagtttttacaccaattgatccataagttgtaaaagcttcaacccatgagtagtcaatatctgctcttaaagtatgcaatggaacagttccatctgaatatgattcaacacgagccatatcggcaccattaagacgaccagcaacctgggttttaattcccttagcaccagcacgcattgttcgttgcattgcttgacgcattgcacgacggaatgccacacggccttccaattgacgagcaatgttttccccaaccaacttggcgtccaaatcaggcttcttaatttcaataatgttaatgtgtacacgtttaccagtgaggttattgagctctttacgaagactttcaacctctgatccacctttaccaataaccatacctggtttggcagtgtgaattgaaacgttaacgcgatttgcggcacgttcaatttcaacagtagatactgatgcattggcaagacgcttctctatatatttacgaatttgtaaatcttcacgcaaatatgctgcataatctttaccagcataccactttgcttcccaatcgcgaatgatgccaactcgtaaaccattaggatttatcttattacccacgcgttatccctcctctttttcagatacaacaaccgtaatatgacttgtccgcttattaattggtgacgcagatcccttagcacgaggacggaaccgcttaagagttggtccttcattaacgaatgcttcactaacaaataagttttcactatctaaatcaaaattattttctgcgtttgcaacggcagatttaagtacttttgaaacaactggagaagcaccgcgtggtgtaaagtccaagattgcggctgcttcagcaacgctcttgcctctgataagatcgactacaagacggaccttacgtgcggcaatacgaacagttttagcagttgcttttgctgatgtaacttgttcagccatttgttatcctccttgttattaaacagtcttcttatcgtcggtaccatgaccatggaatgtacgtgttggaacaaattctccaagcttatggcctaccatatcttcctgaatataaacgggaacatgcttccgtccatcataaacagcaaatgtatatccaatgaaacttgggaaaatcgttgatcgtcgtgaccaggtcttaataactgcctttttatcttgatccttttgagcatctacttttttaagcaaatattcatcggcgaatggtcccttttttaaactacgactcattttgcaacctcctctgtacaaatgttattccagaagaataacaaatgtgttctattacatcttcgatcctttacgacgacgaacaatgaacttgttcgaacgtgctttcttagaacgagttttcttaccaactgtcttcttaccccatggtgataatggtgatggaagaccaactggtgctttaccttcaccaccaccatgaggatgatcgttagggttcataacagatccacgaacatgtggacgctgacccttatagcgagttcgtccagccttaccaacgttgataagctcatgttcttcattaccaactgatccgattgtggcacgattaactgaaagaatcatccgaacttcaccagatgaaaggcgaaccaaagcgtatttcccatcgcgaccaagaagttgagcagatgcaccagcagaacgagcgagctgtccaccttttccaggtttgatttcaatattatgaataattgatccaacagggatatttacaagtggtaatgtgttacctgctttgatatcagcatcaggaccagattcaaccttatctccaacttttaatccttttggtgcaatgatgtatgatttgattccatcagcataaacaactaaagcaatattagcagtccgattaggatcatattcgattgatttaacagttgctgggacgttatctttagtacgtttgaaatcaataactcgatattggttcttgttaccaccgccacggtgacgtacagtcattcgaccgttattattacgaccggctgttttactctttgactcaagtaatgacttttctggcttgcttttcgtaatgccactatagtcaagacttgtcatattacgtcgaccgttactggttggcttatatgtttttatggccacaacgtttccctcctaaaatttaagattaattaattatttttcactaaatagttcaatttcttttgagtcgtcagataaactaacaattgctttacggcgcttcttggtatatccagtatatcttccttgacgcttaagcttcccgcgaacgttcatgatgtttactcgaactactcgaacatcaaaaatatcttcaacggcttttttaacttgcgtcttagttgcccgtaaatcaacatcaaacgtgtatgttttgtcgtccatcttactggttgtttcctcagtaataaccgggcgcaaaataatatctcgtgattccattatgcgagcacctcctctacttgagaaagagcagctttcgtaatgacaactttatcatgatccgcaacgtctaatgtgttgattccttgtgcagaaacaactttaacgttttcaaggttacgtgctgaaagcaatgctttctcattgtcatcttccaaaactactaatgtcttagttgatacgtttagcttttcgagtaaggctgcaaattctttagtttttggagtttcaaaggctaaagaatcaacaacaacaaacttatcatcagaaactttttctgataatactgacttcaatgctaaacgtgaaactttgcgtggcaaacgatatgcgtatgaacgtggagtaggtccgaagacgattccaccgccgcgccattgtggtgaacgaattgatccttgacgagctctaccagttcccttttgacgccatggcttcttaccaccaccgcgaacagcggaacggttctttacagaatgagttccttgacgtaaagaagcacgctgcatcacaatcgcatcaaaaataacattgttattaggttcaattccaaaaacactatcgttcaatgaaactgagccatttttacttccgtcttgtttatataatgctacatcagtcatttatggttgcctcctttctacttttttgagctgcgaacagctgatcgaattgttacaaacgatttgttagcaccagggacattacccttaatcaaaatgacattattgtctaagtcagtgcttacaacttccaaattctgaatagtaaccgtcttattacccatacgtcctggtaatttcatacctggaacaactcggttgataataacaccaagtgaacctggacgacgatgatatcgagaaccatgagtttctggtccacgtgattgaccatctttatggatgttaccttggtatccatgaccttttgtggttccagttacatcaacgctgtcgcctggcttaaagatatctgcttttacttcatcagctaccttataatctcccagctcaacatcattgatttctttaatgaagcgcttaggagtagtatttgctttctttgcatgaccttgttctggcttattggtaagcacagcacgcttgtctgagtatcctaactgtacagcatcgtaaccatcattttcgacagtcttaacttgcataataacgttaggagtcacttcaacaacagttactggaactaattcgccgttatcagtgaagacttgcgtcattccaactttttttcctaagattccttttctggtcatgagtacacctccgatatattgtatttattaaagtttaatttcaatgtccacgccacttggcaagtcgagtttcattaatgaatcgactgtctttggtgttggatttaaaatatcgattagtcgtttatgagtcaaaatttcaaattgctcacgcgcatctttaaatttatgtggtgaagcaagaacagtatagattgttcgctcagttggcaatggaattgggccagaaatagtagcaccagttctttgcgcagttgcaacaatcttgtctgctgattgatctaggatacgatgttcgtatgccttcaaacgaatccgaattttttgttttgccattgtgttccctccttcgtctattttgaaaataggactaactccgtgaaaattaccgccaaacccatggcaaagcatccgggtgtgtcgcaacctttcacatcaaagctaatacataattgtttttgggcaaactaatccccaaaaacaagtactcaaatagtgtactaaaaattggcgcataaaacaagtatcagcggtaataaatttattttgtaacattcttgtcacgaatcacaaagccttcgttatatctctttccttttaaataagaaaattttctaatcaatctttgaggtcgctacatcttaaatgtctgttgatttgttattaagtcttccctcggttcgaaacttatttacctaatcagccatgagactatacgtcctcacttttatctccctctgtcacgaactgaataacttaattcaaaatacgaacagtgaaaatttgaaggtcgtcattcacattcgtaacttgtcgttttagattctccacactcacccaacattgttgtaaatttatccgtatatctgctacttatatcagcgtagctaaaaaactgtaagtatcagtttaaaacacctatcatcaattcgaattactagtcgctgataatcaaaaaacaattgcaaaagttaatcagcgcactccacggataaacatcattagccgtttgcaatatttctgcagataaagtccaatcgatatattgcaacttccttaaatttatatggccgtgcaagttacctttcagctcattcttaaaaaggccgtaaagaacctggagtgtctccaaagccctttcacacttacaaaagcatctaatatcgtaaagtaaaatcgacatctcacttgctaatcatttataacaggaactgatcgaaaaaagatcattgtttggactcagttttagcaaatcaaaaactattctcgttcttaactcacttgatcaatcatggcaaatacaattctcaagaataatatagttgtcaatcagaacaatgtgcaaacaaaaaaggttgaacaaaatttcttttgtccaacctcaaagagaatcatattattctgggtctaaaatttttggggttgataccgtaaggtatcaatctttttttgcatataaatagggcatcgccctactattgaattagccaataattcagatagaaagaagtaaaaacgatgtccc

SEQ ID NO: 682 - DNA, 18195 bp, Unknown
  Metagenome-assembled genome
atcagttcttcacatttttgccgaaacggttagtttcgctgttaacagcaagctaaatggttaaattaattaaaatatgccctgtgataccaagggatcagtctgtcttcatactttcaagtttcagacagtttcataaaggcgtttgtcatgttttgcttagtgttggacttgattacttttgcaattgcgctaatttgaagattttgttttgcgaccgtctttttgacaagttttgcaattttggtgtgaatcaaggctttttgtttttttggcatcattttagcatttggaattttggcaatggcttgttgataattggattgaatgagttggctggtctttttaggcgtgatgccctgagcactatttgaatcagttgtcttaccattgtctgagatggcttttttgacgttagctgcgacatcagtttttgctttggtagatagctgagtggtctcaatttgggtgttggcttgagtgatggattgacttcttgcagtagccaagttcgcggttagagcagaaacaaagatggcgactgcaagtaacgtgccaacttggcgaaatacgccaaggacgctttgggaggcggaaaggagttttccagtaaaatttgaagcgcccaaaacaacgaggggaccggcgataatgccaaaaccaccaccaattaacactagactaattattgtttgaccatagtttgccggattgataactgaaaggacaatgtagccgatgattatttgaagaaagcctaccgaaactagtagccgaggcccaattttatcgtttaataaaccgccaattggtgaaaaaataaaaatcatgagtgatgttggcgtaatcataaaggcagcaataagctctgatttattaagaatattcgtgaaaaaagtgggcatgatgaccaagaccgcgactaagaaaatttctgttaaaacggtgacaagggaagcgccggtgaattgacggcttttgaatagcgttaatgggaccatcggatctttggtaaaatgttcagcgacaataaaaccaatcagagaaataacagccgctataaataatccaacgataatatggctggaccatccccagtcattacctttaactaaggccaaagttaagctgaataatgtgcccattgaaaataacattccccagagatcgatcttggccttaaatcggtgttcgttttttaacggtagtaggacaacacatagaattagaacgattaaaatgagtggcaggttgatcaggaagacgtagcgccaacccaggtattgagtgacaacaccaccaatggtcgggccaaaggctgaggcgaatccttgggttacacccagtgcggctagaatgcctgttcgatgtttcacgtcggctgttgaaataccgatagtcatgcttgcgggaaaaataattgcagcgcctagactttggatacctcgaccggtgattaagaattcggcacgattagctgatccggatagtagagatcccagtgcgaaaagaattaaaccaaatacgtacatcttatttcgtcccacaatgtcggcaattcgaccaaatggaatagtaaaaaccgcaaatgtgattgtgtagatatttaaagcccatgataagttccccaagtttacattgaggtcgctctgaatggctggcaacgcaatattcataacagttgtatccagcatacataagaagatgccgatcatcatggaaaagataatgagtttttgttttttgtgcataagattttctccctgtaaagtaagtatggttaagcggggaatggcgttatctgtctttcatcctcgcttgctttcatacattaacatgctgtatccttatcagaaataaataggttacaaaagggagggaattgtaaacgatgtctccacacgaagttaaagagcaaaaactaacagcgacatttaaggcattaataaagttactaaaatcaaagcggtttgaggacatttcaatcacggaattgactcgagcggctggtgtatcgcggacctattactatcgtaattttaaaacattggatgatgtgatatcagcttatgaaatgctgaggattattcagtatcttcggcagttaccaaataatcccgcaaaattaactttcgagacgatgatgacccactattttcaattggttgccgatgatgcagatgatcagcttacgttaattgccgctggtaaggaacaagtgattattaaggcgtttaatacgtcttatcattatttgcaaaaagataatgttgagcaaattgatgaatatgactatgatttcctgtccggagcggtcgttaatgtttcaattcactggttgaaaaatggcatggttgaatcggccgaattaatggggaaaaagattcggcagttcctgtaattgctaattctcttattaaaaatagaagggttaaccgttacttatcagctgtcgttgacctgatttttgagtataataaattgtgctaaacgttttcggcatatttagagtgactattagcaattattttgacagatcaaccgaggggagtttgattgttaccatgaccttttatacctataattacttgcacgcaacccagcatacttggcagtacgcgcgagtaattgtgatcagtattttagtagttgtctttattctattcatgcttcattatctacgaaacaaaatggatattaaatataaagacctaagtgtgattatcgcaacgttgcttttattgatcttggggatgcagtatgacgattacagcaacatcaagtcatcgtcgcagcagaccggccaaatgacaactttagttaaggaagttgccaaacggttagaggtccagacagatgaagtaagcgtgaatgccacgtctcaaaatcaaaacttgttggtaaaaacgccaaaggggtactatcgagttgattttaatactgatggcagccagtttgttcttgaaaaggtggatttacaccaggcaaataatattcaagtggaggataaataatgtttacatattcagatgttacaatgaaattaattgttggatttgcatttatcaccgtcctgattaacttgaccggaaagggaaatctggcgccaacttcggcaatggaccagctgcaaaactatgtccttggtggcattatcggtggtgtactctataacccggcaattacaatggcccaatttgtggttgttttgctgctttggtcattgttgattttggtgactcgctatttaaaaactcatattcactggtttggcaagtttgttgaaggtgagccgattacaattgttcgaaacggcgaactgttggttgaaaattgtttaagagctaacttatcagccaaggatgttgattttaaattgcgaacggctggtgtttatgacttttcagaggttaaacgggcaattgtggaacaaaacggttcgctaacagttttgcgtcatggtgacggtagtattcgctacccggtcattgtcgacggtcagattgatcccgatgtccttgatattatggaaaaggacgaagactggttgatgaggatgttgaagcaacagggaatcgataatgttaaggatgtctatatggcaacataccgggataataagatgacaattgtgagttataaataaagattcgtttggataaacattcccacttaagccatcttaagtggtcatcgacaatagataaaaaatcagatcctcaatttaggatcctgaagtttactaagctgactttctgttacatttctttaaagttccacatgaaacattgcttgaatcagtgattcttcaatggattagcttatttttccaaactaacaggctgatccctttttgcttgaccggcttgttataaaatctaacactacgaaaatttgaagttgaagtgagacctaagaaaaactgtatgaataaacaatgaaagcgatagaaatgattgagtattgacgtgaagatgtcataaacgtatttttatgcaaattttcttggttgaacacattgacttctcatcattttgttatatgattaagtttaacttttagcaagatcgttggaagtcaattcggtgttgatttatcaacaaactaaactctcggaggtagtaaaatggaattagatgaaattaatccaaacgtgttaaatgtcaaaccatctgccatgcgaaaatttgatcatgatattagttcagatcctcaaatcgttaagttaacgctgggcgaaccaaactttaatgttccagagcatattaaaaaagcagctcatgaggccattgataaaaacgaatctcattatgcgtactattggggtgttgaagagcttcgcgaagcagcgtctaattactaccgagataaatttggctaccattacacgaaggatcaaattgtggttacggttggcgcaactgaagctttatcgtcaacggttaagactttgtttaaacctggcgatgctgttattttaccaacgccggcttacccactctataacgcgctattaacattaaacgatttaaagacgatcttaattgatacgagtgattctggatttgtattaaccccggaaaaagtgcaacaggcgatttctgattatcccgattacaatattaaagggttgattttgactgatcccaacaatccaaccggtgtggcttacacgcaagagcagattgaaaatttggcacctgtcttaaaagacaatggtatctgggtgattagtgatgaaatttatggtgaactgacttatggtcaagcacactattcgatttcgaagctattgccggatcaaaccattgtgattaatggtttatccaagtcacacgcaatgaccggctggcggattggttttgtttttggcccaactgggtttattgatcaaattgccaaggtgcaccaatttacggtcacgacaccaacttcaattgttcaatatgcatcgattgaggcactgacaaatggtcaaaacgatgcggcagcgatgagaaaagaatatctgaagcggcgggactttgtcgcaaaagagatgaaagaagccggttttgatgttgtccatcccggcggggcgttctacgtctttgccaagattccggctggattgcatatggatagttgggattttgtgaagacattagccaaggaatatcatatcggtttaatgcctggggatgcttttggcgataatgcgtatatccgaattagttatgccgctagtgatgaagcattaagcaccgcaatgaaagccattaaacagatggtaaaagataagacaaaggaaaaagtataggattccagtcattataaaatcaacttacctttagaaaaaaagaccgttgcagtgagtgtcacaaactgacaccaactgctacggtcttttaaaatattaaaaattaatggtgggcggttacatgggactgttgataaggtacacgtgatgaaacaggatttagagatacattaattggaaaaatgtactgggatgggactcattttgatcaaacgcctattctcaataatgattggactcagtcgtttacagaaattgagaatttacaaatcttcggtgatgaattgtatattacggtgactcagcatcaaagccccaacgaaagttacgtatatcgagtagacaaatctgatttttaattattacttttagcttttaatccaaagaagccagaaatggactgtttatccattcctggtttctttgttttgtaataaaaatcgattttgtcacaaataaatacattttacatcaagataaaactaataatggcgattagttctttggtggcattaatattaatgcgccagaaccatagtagctgcttgagtatggataggcatagatccccattcgccaattttgtagatcattaattgactttcccagtttggtttgtaaagcattttcgattgcggctttcacgtaagtaccatagctttgtgggttttgaaggagaggattgactgattgatcatcaaagataaccagcttatgttgtggtcctaatacacggtctagcatgttagaatattcgtcgaaatcatcgcccgttatattttcaccataggcattggctagtgattgaagctgttgatcggattctaatccagggagttgattaataagttgttgctctaattcagcggaattatttaggttgcgagcagggttccatcccttggttaagtagcctcgataaatatagccgttaacattaccgatactagatacacgatagaatattttacgttttgtgccttgtcttagttcaacactcttttcaagccaaaaactagttcgagggtaattttttaaattatgaagtcgcttggtatgatgcaggttccacatgtatacattaccctttttattgacataatatggcgtggataaagctgatcgtgaatgagtgtaatccttggttttaatcacctgccaggcagccgcatcagcaggctgctggttggcgataaatcctaagcaacttgttaaaccgcctaatgttaaagcgattaagaatgttttcttcattttcttaccttctctttcgcatatatttgtttaatataaaacaatagtaataattagttctttggtggcattaatattaatgcaccagagccgtaatagctgctcgagtatggataagcatagatccccattcgccaattttgtagatcattaattgactttcccagtttagtttgcaaagcatttgtgattgcaactttcacataaggaccatagttttgtgggttttgaaggagaggattgactgactggtcatcaaagataaccagtttatgttgtggtcctaatacgcgatctagcatgttagaatattcgtcgaaatcatcgcccgttatattctcaccataggcattggccagtgattgaagctgttgatcggattctaatccagggagttgattaataagttgttgctctaattcagcggaattatttaggctgcgagcagggttccatcccttggttaagtagccccgatatacgtatccgtttgctttcccagaactaattactcgataaaacattgaatatttacttccgtgtttcaatacaacactttgacggagtataaaattagttcggggatagttctttaaattatgaagtcgcttggtatgatgcagattccacatgtatacattaccctttttattgacataatatggcgtggatagagctgatcgtgaatgagtgtaatccttggttttaatcacctgccaggcagccgcatcagcaggctgctggttggcgataaatcctaagcaacttgttaaaccgcttaatgttaaagcgattaagaatgttttttccatttctatcatctcagctttcacatccattatatcgctaattaaggtggctattcattttggttagcaaaaaccgcttctcgtttaaacgagaagcggttttgggatttgatattaacgacggcgattatttatcttattttagacgataataattgtgagaacgtgtttaaggctacttatatcagttctagtcaagttctcaatcacctctaaatgatgaaaaatatcttattttacttatcttttttctggtcctgaatttttttctggtgatgataatttacaagaaaatgtttaaggttgatgatgtcaattctagttaagtgcccggtcacctttaagtcggttagattttgctcgtcgattgtaaaaatttttccagtatcgatataagatggcatcgttaaaccagcgatcttattccaatccagaataggacaatattgtttttgaatcctagatgatttgtttttgaactggtgagtaattgcataaaatgctaattgtccgctatagtcactaagaatcacaattggtcgtcttttgccaccatttccctgtacaaaggcaacatacaaccatgcaacatcgaatggtttaataatcatactttgaatcgttaaaccaatcttctatttttttgttggtatttaaatgttctacaggggtgttttttgaaagttgttggatttcataagcatctttatcatcttggttcagtgttaagtcaaatggaatcccaccggtgctaataacttttcgataaaaagcgttgatcgctgcggtgggagttaaaccgactttattaaagatatcttccgcttgattggcaacagtttgattaatacgaacttgaatacgcttatcgggttcttgatcttttgtctttggggccattacaaacattcctttcatatttattctaagtctattatacattattggtagtaaaatatactactggattactgctagtatattccttttgactactagtctaagacgacctcttctaaaaatgactcataaaagactaaacgaccatcactaaaagtaatattagaaaacagatttcaataaaggccactgaaaggataccaccgtcgtcgtaaaacttgctgaagataatgccacttatcgttttgaaaatgctgtataggaagatgatgatataaagcccaagaatcactttactaatactttcgttgacatcaaacgcggaaaggatgctaaatgacaagatacaaaaaaagtctagcagtccccaaagataaatgttttttgaagttggacgaatgattttattcatagtgatctcctccagactattcggttacttttccttcagaatatactcattgtgaaatatgttcaaataaatacttctataaattgtctatctatttgaagaggggtactgagtgattaacgttattgatccgtcgggagttattgattaactttgtcacaatttaaagatttgataaccttttttacatgggggttaacgtgaaatatgatttacgttgtcaagttaactcatacttggcaacccctacgaaaaggaatcacagaattctaaagcagatatccgctaattgaagcacctttattttcttaaaaaacgctcccggcaacaaagttagcagcctttcagatgcgaagggtggcgatttcaacgatgaatactttgcctgttcaattaacgataaacaaacagatttagtgatgaccaagaaaaatggttactggcatgtgacatcaattcaagtatccaggtaatgagagttggaaagcgatgaaatcaaatcaaaattagatccggccaaaaactgattaaacagtcttaaccggatctaattttagattatttttttacgtatgttctctaacagaaattatttgatgggattttcagcatagtacagtttgattgtatcgccgtacttggcattagcattggcttgcttagttttattagcatcgaatttccaacttggcgtaacgagttggccgttggcacttacttgattgccagttaaagcggctaatcttccagtcgtgaagatgccgttatcaaacaacgttggtgcaattgtggcttgggttgaactgctgaagagaccctgttcagttgtggttaattgtggatatgaattttcaaccagtgctgaatttggaatcggattaccagtgtttgaatcatagtatgtcagttgtgatgcatacttttgaaccgcttgatcaacataaaccgagtaggtgctgccaacggtaacattggtgtaaggatgacttggatcttgcgtcttgcttaccgtgtagccggtagggacgttcttattggcaacgtcttcaagttgagtggcattggttaagatatcagttaatttagcgccgttagtcaacttggcaccacttctcaagtcactgttttgaataatccagttgtatgtttgaccaacctgttgacctgaagcatttaaataattaatttgaacgctattatctttggtaggtgtcgtagttggtgtcgttggcgttgtcggtgttgtacttgttggcacagttaggccgccagcaaatacccaaccagtaaccgctgaattgttgtcatctgtgacttgataatataaccaaccttcacgggttttggttgcagcaccggtaatggtaaaggtatcgccggctttgtaaccgctcatatcagctgcctgagctttatactggctccactttggattgacccagagtgaattcttagcggcattcgtcaaagtatatcctttggtgatagctggtagaccggcttgagtcatcgtgtttgtggatgagataccaccgccaaaggtgtttgtacttttgccgccgtagatccagccacgaagattaccattgaaggagacgaccttgtaataaacagaaccgcggttggttgttgcgacccggtatgcccggaaatattgttgcgaactatttgagctgccatatgatgataaggtccccttaccagcaatgactcgggcaccacgtaaggtaccagctttagtatacaaagcgttggtgccgtttgtcgccacgttgcgggtggttgggtcagttgttaatgttgagttcgaattcacagttgcgtaagttttggcactagcgttggttgcggcaaaacccgttgcggtaaccatggagagtgcggccaagccaacgtaaagtgacttttttaaattagatttcatattctttatgcccccatatctgatttgcgcgatatttctatcacaactccaatgtaacaccaggtagaaacgaaggtctaattttaacactgagtttagccaaatggacattttcttgggataatcttaagaagtgtgacagataaaaatccgctggtcaacgaatttcataactcgtttagatcagcggatttttatctgattcattaagcgtggttttctttaatggttaatgacaggccaagtgccaaaattgcaaatactaatgggaaaattaaaccgacgtggacaccggttgtaaaagcaacctgatgactggcggtactagataattgttgaccaaatgccagtaaactagtcgcgatcgcggtggcaatcgcaccaacaatttgttgaaaggtattcataattgtgctgccgtcactggaagttcgttgatctaatgcaccgaggccaaacgtttgggccggtgacatcgatagtgggacaccgaccatcataatgatgtgtgccatgatgacgtaccaaaccggtgatgtcgaagtggcgaataataaggcgatgatcccaataatggtgatgccaaatcccaatgtggttagtaagcgtgggctgactgtatcagaagatcgaccggcgatcgcggaaacaattgcgtttacgatgccaccaggcagcatgacaattccagttaacgcaaccgggatggctaatccattttgccagaacattggtagaagatacattgatgataaaatgatcccgaagtccaacataaccagaatggcaccggtccggaactgtttgttggcaaaaactttgaagtttaatattggcgtggctgatttaacttggcgatgaatataccagccaagtaaaataaccgcaacaacaagggttcccagcacactgggggaagtccagccggagtcgctggccaggctgacgccagttaccaggccgccaaatcccagtgttgatagtaaaattgaaaagctgtcaatttttggtttcgtaatggttccgacgtttggcagatatttgaaagccaaaaaaaagccaattaataaaaatgggacgaacaaccaaaaaatccactgccatgaaaggattcctaagatcattccggccaaagtcgggccaatggctggggcaaacataatgaccaagccaatcattcccattgcggatcctaatttataaggtgggaaaattaaggtcgcaactgtgaacattaacggtaaaatcaagccggtcgcaattccttgaatcattcgaccaattagcagcatgccaaagctgggagccagtgcagaaatggcggctccaaccatgaagtcaattaaagcgaatagaataatttgacgagtcgagaaaattcggctgagtagacttgataatggcaaaacaattccaataatgagcatgtagccagtaaccaaccattggatagtcccaatattgacgtgcaactgagtcattaaggttggcagggcgatgttgagggatgtttcgctgagcattcccacaaagccaccaatcagcattcccagcatggccagaaacgggcgggtaaccggtttggcagcttgttttggctctgcagcttcatcggctgtatttaaagatttttccatttaagtaatgacgctccttttctgaaaacaattctgtaacgacaattgattacattaccatagttgggagtttttcgtaagtgttttctggtatagagtgtgacagcaagcggttaactcccagaatataagccccttaatcgaataatctgggtctgaatattggattaaggggcttatatggccgggatctgctttctgtcggctctttccatgcttcaacgagcaggtaaggatatttagaccacaaaaatcacgaaaacgctatggaatcctttttacattttgaaatcttatttgtaaaaccattaaataagaatgtcgctcaaccgtggaaagagcctttctgtcacacgtttcagccaagtaaacaggccaccgaacattcaaagtttgaatattgagttaagggcttatatgattgggagatagtcgtcctttgtcacccatttcagcgctgtaacttggggaacatggagatttcaaaattaaaagctttgccgattaagggctacacgtggcagtttcaattaatacaaaatttggttgcaaaaatgattacaccaaaaaatcctttttatcctgtcataattgccggctataatataggtaaatatccaactcagggagggatgcagatggctaaacaagcgacgaaatggaaactggctgaaacgttaaaaacaatgatgttaacgacgtccgttgaccatatcacgattgaaatgctgacaaaaaaggcgaagctgacccgaaatacgttttattatcattttgatgatatctattcattgctagagtggatttataagcaggaattattggcaaacattgaagcttatacaaagattgaggattggaaaattgcctatcgattgattcttgattacattgaagataaccaacaattttgtctggaaacatttcgttcggttgcccgtgatctgcttgaaaactttttgtattcagttgcccgtgatttagtgaaaaaagtgattgttcattctcagttgacggtttcacccaagcttcaaaagtcgattaccaatttctatggatgggcgttggtgatgcaagttgttcagtggttggccaatggtttgaaggagcctaagggggcagttgtcttacgggcagaaattatgctaaccggtggaatcgaaaacgcgattcaaaatggtcgtcaattccctgattttgggcaaagttaaccaattgcccatttattttcgattggaaacctttacaatgataggtagaacaaattagtaacatttaaaacgatgactgcaaggcgtcatgtttgaggaggctttccgatgaaacataaaaaattagttgttaccggtgttggagttatcatgctgggcgtttatttcttaaaatcaattggctggtttgaaaatgatgctcatttatacgatcagtttgaagattccgataatcgataaggaggagttcacatatgacaaaaagtaaagccattatgattggtgccggtctggcaaatatggctgccgctgtttacttaattcaagaaggtcattggcagggtaatcaaatcaccttttattcaattgatgatcatggttccaatgatggttcggctgccgatgaagctgctgacgaatattggaacaagaatcatcccttagataatacaaaagggtttattgctcgtggtggtcggatgcttaattaccggacatacgttgatttgatggatctgttggatcgggtaccatcagctactgaaccggcaatgacggccgctgaagatactcgtgattttgatgcccatcaccggacctttgataaagcccggttgatggaaggcggcaagggcattattgacggcggtaagttgggtctcaacaacaaggatcgttggtacctgacgaagttaattttgatgccggattctaaggaagaagaacttgataacgtcacgattgctgattatttcaaagaagatcaacatatcttccaaactaatttttggtatatgtgggaaacaacctttgcttttcgaactcagagttcagctcaagagttacgtcgatatatgcaccaaatgatctatgaatttactcaaattgagcatttggttggggttaaccgaacccgatataatcagtatgagagtatgatgctaccgctaattaactatttgaaagagcagggcgtcaatattgttttgaaccgacgagtaacggattttgaatttaaggacacgccaatgcaggatcaaattactgttactggcttaaaaatgacaaatactgaaacagatgaagtcgaacatgtcgatgttgatgatgacaccgccgttatcttcaccaatgggtcaattactgattctgcaacgttaggtgattataatacgcctgctgcggaaaatatggattatggggccgctgccagtttatggaagaaagcaaccgatcgtttctacaacttgggcaatcctgataagttcttcgcggatcgggatgccagcgaatgggttagtttcacattaaccaccaagaatcatacgttgttaaatgaaattacccgaatcacaacgcaggttcctgggaatgcgttaaattcgttcttatcaacatctccaattacgtcgttaggtaacaaggatgtcaatatgtcgattgtggttcatcatcaaccacattttacaacccaaaagccaaatgaatcggtgatctgggggtatttcttgtatccacgccggcggggcgaatttgttgaaaaaccgtatattgaaatgacgggtaaagaaatggccgaggagttaattggccaattatccaaggttgatccaggtccgggtaatattatggataaaaagcaggaaattttggatagtattatcaataatattccgtcatatatgccatatgcgtccgccctatttaataatcgggcaaaggcagatcgcccgttggtcattccggctcattcaacaaacctagccttcacgggtgaatttgcggaacagccatatcaaatggtcttcacggagcagagtgcggttcgatcgggtgaaattgccgcatatcactttgcgggcatcccaatgtcgaagttagtgaaaaatccaaggtacgataaggatccaaagacattagccaaagcaacgcggaagatgtttaggtaacagagtgtgacagaaagcggttagatcccagaatataaagcccctcaaccggatacccagaacttagggtatccggttgaggggctttatatggccgggatctgctttctgtcacacgtttcggctaggtaaaaagaaagataccccagaactcggggtatccaattgaggggctttatattctgggatctgctttctgtcacacgttttgactatgtaaaaaaagatatcccagaacttggggtatcgggccgaatggccttatatggccgggatctgcttgtggtcacacgtttcggctaggtaaaaagaaagatatcccagaactttggatgtccaactgagaggctttatatggtcgggatctgcttgtggtcacacgttttagctgggtaaaaaaggatatgcaaaactaggagcactcagccaagagttatcttccaaaacatgtccttattcagcaaaaattagtgcttaatttttaagactttccaatttagcctgaacaaatcgaaactaatcttctcctaaatcttcagtttcgtgttataaatgtgggtgaaaagaagggggagttcattatggctgagagtagagggaaaaatctttctgtgattggcgtgctggggatgttttcatttctaacagcactttcaggttcgagtacaagtttagcaattcccaaaattgcggttacgatggacgtatcgagtagtgctgctacctgggttgttcaaaccggattaattacaactgccattttattagttatgtttggtcatttaggtgatattttatccaaaaattgtgtctttttagccggtggttctatttttgttcttggtgctgcgataactgggcttgcaccaagttttgttattttgctatttggccgagtgatcgaagcgattggatcggcgatgattatggccaattcgatggggattgtgacgcaatactttccaaacgaccggcgtgctgaagcattggcaatgatctcaatgtttatttcggtgggatcaatatccggtccagggattggcggcttcattatgtcaatttcgagttggcgatggatttatctatttaacgtgccattcggtctgtttgtcttatggctgggatttaaatatttgcctattccaagagaaacttggtcaaatattctaaaagtaaccaagggagctaattggactggtcaaaatctgtttacaattggtattatcctatttttcttgagtggcacttttttccaaagtggccgatccgggctgctgatggggttaggattcttcgtggttggtggtgcaattacgatttactcgtttttccaagatgataaggcaaatttgccatggattgcccccgaagtgattcgaaactgggggtttatgacgtcaattttagcgttgatgctggtcatgctggtaaatgcaatttcaaatatcctattgccattttatttccaaagcttcaatgggatgacgccttttaccagtggtctgattattatgttgcaatccgttgcgatgctggttacgacgccttttaccggtttcctggccgatcgaattaatcgtgaactaatgaccgtcattgggctggcagtgttggtgatttctcaaatcggttacgcactgtttccggaagggttgaacatgtatcgtattattcccgcaattttattaaatgggattggcatgtcaattttcttatcacccaacaatgccttaacaatgggaatggttgataaaaaattagccggggttgctggctcatttaactcatttgcccggacactggggttgacgatcgggattagttttggctccgcaatcctgttcttccagcttccaggagttggtcgaattacgtcaactttaggtaatcggtttatgcaggctttcgccaatgtcttctgggttgcaacgacggtttccgcgattgcattggtcattgttttagtaagatatctgagttcgaaacgtcatcccgagaaagctgtcaaccagtagcaactgtatccaagttacagcgattattagttcgttgagaaaattattattaacgcttgattaacgtcagctttgcgagtaaattagtcgttaaaacattatttagattgatactatttttggacgattagaggttgaattaagcagtgacaatttatcagaaaattttcgcaatttgggtgattcttttggtaggtttgctttatgcaattgttcgaaaaaataaaacgcaaattgctttttgtgcagtggcgtgggttggctttacattatccacgtttgctggggttgtgttggtgttaaaatagttttccaaaaaggaaatcggcttctaaggatcattttgcaatgatttttagaggccgatttttagctaaaattctttattaggcgagtgtgatgtggaacaatcttgccatctttgatttgttgtatgtgacgtttaaattatcattctcaaacgaaaaggaactgttaccattttgagctggataaatttctgcaacgttcttgatagtaccgtactttgccaagctaatatggtgattaggatcggaattgattccccgccaaacggctagataaatctcatgatcgtttttgagcccgtagctaaaccatggatcgtccagttggctaagtccgtctggccaaattggtaagaagctgtttagtatctttgattttgaccaaataatttgataaactactgtcaaaaaagttggtgatcatatgcaacattttagtcatcattaccaaagcgatatttctcggcaacaattcga

SEQ ID NO: 683 - DNA, 188906 bp, Unknown
  Metagenome-assembled genome
tccagagattataaggcctttgacggaccattaacctgaggtaaccaatccacgaataacagaatggttaactgtcgattggacttatgttccttggtttatccatgcccctgatggaggatgagcatgatttaaatttgtgacttgacaatggtcacttcataacagtgtaattgaattatccgaatattccgggcttgaatgtttggataattcggttacgcggcaggaagttgtcttttggcgcacgttttccactcggtaataatcgtgattacacaaagcggggctgggacaaaattacttttgtcccagcccctggatttttttggaatctatagctgtaaaaagaactaatgtcccagcctctctttaaccaaaaatttggtttctgataaatcaggccaaatcagtcgttatttctgtggctcgtgcgcaaatgatatcgtaaatatgactattttgatgcaataggaatagccggattcatcttttgacatttgtaataatatataaaatgttatagtgatataatatttttaaggcagacaactcattttattttcaaagctcaatgattcagatagatcaatatagaagtgattgggaagatttgctgattataacgatcttttagcatggtcatgcaattggggtattactaaggggcgtgattctaatggaaggtaacaaaggccgagagcagttacacgaacgaaatctgcgattagtcctgcagcaaatattcaatcataaaatgatctcgagaattgaaatttcacgtcatctcaagttgtacaagtcaactgtttcaacattatataatgaactaagcgacaaagggtatgttgaagaacttggtcgtggtaaatcaaccagtgtccgtggtcgaaagccggttctggtagctttcaatgcccattatggttatacgcttaatttcgttttgggactggaaaagttgcacgttatggcgaattatcttaatggtgatgtgctttttaccagggaaattgaaatggtgaatcgtgacatttataaagttgtcaaaatcattgatgcggaagttgaatcatccctcaagcgtgaccaaaccgatcacggccttttaggcatcgggtttgcggttcacgggattgtttcggataaccgaattataagttcgccttttatgaacatggcaggtattgaattagtttcgaggtacgcggagaaatatggggtgccggttcatgtggaaaatgaggccaatttactagcgatttatcatcgcgattttaaccgctataatcagtcacgtaatttgttggctatcacggtagataaggggtttggcgcaggaattattttaaacaatcagctatatcagggatatggtggtgctgctggtgaaatcggccagaccattatttacaataattgtttaaataaaaatcaacggtttagagtcgatgatatttgctcggagcgggcggtaattgccggcattgagaatcagctccatgaaaatcagctggatgttgatcgcttggctgcgatgaggcaggcaggaaatcctattgtttgtgacgcgcttgggaagtttgccggttctgtggcaagtcttattttcaatgtcgcaagtgttatcgcaccggaaaaaatctatttaacatcgcctatcctcagtgcgagtccgtcattatttaagatcgtgactaaggatattcgtcaattaggtatgcaaacaccgattttgctcacaattcggacacgtgatgctatcacattgggatgctgttccgcaattacccaccaagtgttagggatggatggatatgaattgacgtttcgatcttcatcaaatcgtgcttcgaaattaaagtaaaacagcagctagcggctaatggcgatatctcgcctcttagccgttagctgctgtttatggatgtaatgaaatgtttaattgatctttaattactctttggaatggatttttgattgcgctcaaggcggacgacgactgctgttgtgatcaaaccaattaagccaaaaatacttaaaagtaagaagtcgttttgggcaccattggcagttgcgaggccggtttggcgagttgccatgtgcagctgactgaccgaaataattgcggataagattcctgtaccaattgacccagcatattgttggagggtgttaaatagggagttgaggtctgctttttcggccattccgacttggagactggcatccgacatgatattgccaaagccgaagttaaatccaaatcgtagaaatgtataaagaagtgtcacagttaataagctgagtgaatgagtaaaccaccaaaaaagcagtgatccgatgaccatggagccattagcaatgtagagtggtagttgtgcaccgtgcttgtcgtaaattgaccccgcgattggggcaaccagcgcaccaactaatgatcccggaagtaaaattaagccggagatcatggaatctgcacctaagtaattttgggcaaaaaccgggatcacaaacgaaatgccaatattaataaattgcaaaagaaagaaattaatggctctgaatgaaataatgggattagtgagaatccgaaaatttaggatttgatgtttgccgtggcgaatgtgataggctagtcccataaacaggaccaaagtgatgacaagtgcgacaacaaaattaaggctggcaaaaccataattacctgcttgatcaaaggcttcaatgagtccaaaaaagactaatgaaagcagaatcaacccggtaatatcaaaggcaccgctttttctcgaagcttttaagcgaatactgaattcaccaagaatcaaaatcagaataatcaatgggattgtcataatgaaaatcattcgccaatttaggtaataattaagaagcccgccatatgttggacctaatgctggcgcaaacgatgtgatcatactggcaatcccgacatagacaccaagccggcttcctgggaccagcgataaaataacgtgaaacataagtggtgtcgttaacccggttgcgactgcttgaagaactcggcccaacattaaaacagtgaacgttggcgcgatagcagctaagattgttccgattaatgttgataacacagcgactcgaaatagtgttcgcgtgttaaaccgtttaatcagaaaagctgtggtactcatgacgatggtcaccatcagtaagtatcccgacgttaaccactgaacagtactgagagaagttgaaaattgcttaatcattgttggaaacgtcacgtttagtgatgtttcgaccaaaatccccagaaaagatagcaaacccgttgcgagaatggctattttggtttgaaatgtaactttggtttcttccatttcccttgacccctttaattttttgatgtactttgtagtagcaaatatagtttccgtggaaactagacggctgtaatcatagcacggccgttcattgattacaaacttttgatcgtttgggaggcagtgccgttggtaaataaagaccaaattgttagtttgtatcatcatctgttgatgcttgataatgatacagacaaagaaaaacagtggattgaaactcggcaaccgtcagcattggggttatccacaattcattttcatattttatcttatttagaacggcacccgaattcccttgcaaaggaaatcgctgaagatttaggcattttaaggggaaccctatccaaacgattggccgttttggaacgccgaaaaatgttggttgcttatcaagacgcggcagatgccagaagcaaacattatcagttaacccgactcggtgaagacgttgccaagacccatgatcagctgttacagatgaaaaataagatgctaaaaagtcatttaaaccaattttcggagtctgaattagaaactattcggcagtttttgaagacgtttaataacgcggaacagcatgataagtactaagttagccggctaaaaagatcggttgtgatttaatcagctaacagtaattgcttgataagaggtaattgtttgaggttggtttttctaatgaactttctttttttggccgtttagcttatacttttatttgtcgcaaacgttttcattttgctttttgaattcaaatcataaagatgatccatgattgattgggttgatctataattgaatgtaatatactagatagacgtttaaaaaaatggattaacgacacaagttaatcatgattaaacaggaggataactttatggaaaacatcacagggagggagcatttgcatcagcaaaatctcaacatggttctgcagcagatctttaataatcagaccatttcacgaatcgagatttcccgccagctaaacttaaataagtcaacggtttcagccctatacaatgaactggatgaaaaagggtatttaaaagaagtcggttccggagaatcaaccagtgttggcggccgtaagccggtgttggtaaaaattaacgagcattatgggtacacgattagttttgatttaggttttcgtcatcttcatgtgatgggaaattatattaatggcaaagttttcttttatcaacgaattgagttaggcaatcgggatattcatgagattgttaaaatgattgatgagcagattgaaagatcgatccacaatgacgatacccgtcatggcttgctgggaatcggcttttcgattcacgggattgttctgaataaccatattaccaactcaccttttattgatatgaaagacattgatttagccgatcggtattcggctgtctaccatgtgccggtaattttagagaatgaggcaaacctttcggcgatttatgagcgggactttaattcagctcgtgataaaaataacattttagcggttagcattcataaaggaattggtgccgggatcattttgaataagcagctctatcgtggccgaaatggcgaagcgggcgaaattggccgctcgttaatgtttactaataatgttgatactaagcgatatagtaaagtagaagatttctgttcagaagatgcgattattgaacaggttgagcagcgaaccaatcgaaccaatttgaaccgggatgacctggttcaaatgaataccaaaggcaatcaaattgttcaagaggaacttgacaatttcagttcatcaattgccaaggtgatttataacgttgcaattagttttgctccggaagagatttatttgaactcacccttgattgaagcaattcccgatttattaaattcaattttacattataatgaattgctggggatgcagacaccagttagtctgacgcctcattcgggttatgcgacgctgctgggatgctgttcagagattacccatcaagtgttgaagatggaaaattatgatttatcgtttcaagttgctgaatcataattttaaaaaaagtataaaaggctgtttttggaatagagtggtaatgattaaccactgatattctaaagacagcctttttgtgatttcccaatagtgctaacctgaaatatagttctccttaatactcttttcatatcgagttgaggttgatgaacttcggtattgcgccggactgattttattcaactctttaaagtttcggttaaatgtccgtaaattagcgtaaccaacgccataggcaatttgagtgattgagttatccgtatctttgagcatttgacgggctttcgaaattctgaatcggttcaaatatttagtataaggaatccccattaccttttggaatagtttagataagtagacgtagtcatacccaattgcttcggcaatctcttttaatgtgcattcctttgtgtaatgattattaatatagtcaatgattgtatggacaatatttaaactggcggacgttttccggggaacaaacgatgcctgttcaacaaccttattacacatcccgtaaaggagacttttgataccgaagatattggacgtatggtcaaaatttaaggggtcgttatcaaaaataactggattttctgggattgagtcttggtattgctcattaaaagcaccaacgatttcaggtgaaaacaggacaatcgtaatggttgtattgggtgacatatcaaaaccatggatttgattaggaaaaacgattacgaattgccggttattgacgtgatacgtattatcttcgatttgaatttggagttggcccctgcgaacataaaggatttcaaaagctctgtgcagatggagtgggtaattaaaatcggtcagatcaaagtgtttaaaaatcggcattgtttcaaggccaaaatgctgaaataaaaccattgaacgagttcccccttcttaaaacaataaaacaaattgacaactaaaacttaattaactgattctcatttactacgacaattattgtccatttgaccacaaatagcaatctatcaaacttactgtaagcgctgtactatgtgggtacggtatttaagtaaagatatggatattggcatgcaagattatgaaagcgatttattgagtgatgccggtattatcaatttttgcttggttgattaattaacaaccaacttacacacaacaattcatttgaaaggagcgtgtgactaatgacggtctatatcgtttctaagcagggtgacgatcgtaatagtggtcagctcaaatcaccgtttttgacaatcaaccgagctgcccaagttgctcaagcaggagataaagtcgttattcatcagggaacataccgggaacgggttaatccgcaacatgctgggaaaagcccacagcaaatgattacctatcaggctgcaaaagatgaacgggtgatcattaagggttcggaagaagtaaccaactgggagtctgtcggcaatggcatttggaaacacgtcgttagtaactcggcttttggtagttttaatccgtttgattttaagttgaacggtgactggcttgaacagcctaatgggcgtcatgcaggggcggtttacttggatggccgcgcactgtttgaagcggcatcttatgatgagatggctaatggctatcccagaaatgattggtatgagtacgtgacgcaaaagaaagttaacgatgtcgatcacgagtggacaacgtatcggtggttcgctgaagtgaacgctgatgagacaattatttttgccaattttcatcaggttaatcctaatcagcggttaacagaaattaatgtccgaaaatattgtttttatcctgatcaaaccggaattaactatatttgtgttgaagggtttgaaatggctcaggcggccacaaattgggcaccgccaacggcagaacaggaaggcatgattggtgttaactggtcgaaaggctgggtcattagaaataatgacctgcatgattcaaagtgtagtgccatcagtcttggctcagtgccaatggccaaacaagatcaaaatcaatttgccagattacatgataaacctggttatcagtatcaaatcgaaactatgtttcatgccattcaaagtgggtgggacaaacagcacgttgggtcacatgtgattgatcataaccaaattcatgactgcggtcaggctggcatcattggctatctgggcggtatttttagccaaattgccaacaatcatatctatcggattggtacccgctatgaatttggtggctgggagattgccgccctgaaattgcatgctcccattgatacggtcatcgaacacaatttgattgaaaattgttctctggggatttggcttgattggcaggcccagggaacacgaatcaccaaaaatgttttagctgataatttgcgtgatttattatttgaagttaatcacggcccattcttagttgatgataacttattgctatccgatgaagcaattaatgaattttcccaaggcggggcgtttgttaataacttaatcgccggcaccagtgccattcaaagtgttttaaaccgaacaaccccctatcatgtaccacatagtacccaaatcaaaggatatgcttgtgtttacggtggagacgatcggtactttaacaatctttttattcgccaggtcaaaggagcgagtgttggtacccatatttataacggcagtttaacttctatgaaacagtttgtttcgcaagtggaacagcggctgccaggagatgtggaactctttgagacggttagacaaccggcctatattgatcacaatgcatattttggtggtgccacagcctttaatatggaagaaacaaatttgattgaagaaaagtggcagaccaagttagctctgaaacgggtcaaaaatcaggttattttaacgatcgacttgcctattgatttgatccagtttgaaacaccaattcaggaaacgagttcacttggagaagttcggctagcaggtgctaaatttgacaatcctgacgggacacctattcgattgaatcatgacttttttaataagaaaatcgatggtgatacgagattggtcggcccatttgcagaattgaaatccggtcataacgaacaggttgtctttgagttttagaaagtgagggatgatttaaatgcagataatttacacagcaggtgataattcgaaagattatccgcaggtaaataccactcagaaaaagatttgtcaggcatttattgatttatatgcgcgaacgcctttggaattaatcacgattcggcagctttgccagtcaattccgattgcccggacaaccttttaccgttattttgataatgtggctcaagttgaagagttattagttgatctgagcttatctcagatggggcagttggtgacactaattgctgaatctaagaatgacaacagtaatcaggtcgttcaacaaatgactaatttgttagatgcaaatcaaggaatctggaaactgttgctggttactaagcgttcttctgattacaccaggcaagttgaaagaattatcaaagcagctttggcgggccaaaagcaagcgagttatcttcatgcgcaattcttgtgttctgttacgatgggatttcttatcggaattctaacggatcagtttaagtttgacaaagaagcactagttgaattggagcgctcgttgagaaaattgagtgcttaatttagagacattgttttaatggacaagacaaatcccagttggatagggataaatttcatatcaagggacatgctacttatcaacctaacgtgactgggacttggttagtgagatattttgtttaattaaattaacagatgacggctattttgctggaacaccggcaataatcttaaatgcgtcagcaagggatgcgtttttttcagcaaactttttattaagaattaattgtctgaattgctcaactgagattttttcaatgtccttgtatgggctgggtgtcacagcagcgttggtctgattaaccccagttgtgaacgtgatggttaattggttgagatcgtctaggtgaacggtgtaaaactcataatacgaagaattctcgtaatgaccaatcagttctttatgactgttaaaatagttggtgataaagctgttaaatgcttccggtgagttcaatgatgatttccaatccataattgtttttgtcatattaattcgctcctttattgcgatcaaaatgtcaacaattgatgtcggtgagggaactcaaaataattaagtttgttctttcactggatcaactatcataataatcattttatgactgattacaagaggaaagattgatgtaaacgttgacaatatcacatttattgatgtaaccgttatcttggaagccataagtgtcacattatattgatggtcgtaaccttcatcgtttgctggataattgatcaatttttaactaaataatcaaaacgctacacaaaacagtgaatgggttcttttctaaaagatggaaagcgattacaatattgttgttggttgatatagggaaccaactatcatgatagttaacatattttgctaagttgtgttcggccgttcaaatagaattagctaataattgaaagtagttgaatgaattagcgatgtacttagtttcaacagaggagatggttactaggttcaacaaagcttttggaattaggccctagattgaatcatgaatcaacattgattgcgaattattgaatttcattttgtattatggattagctattgttttagttttcagcattgaaaaatgtaagcggattaattagctttgcttactaatttaaatagaaaaggtgaatataatgtcacaaaattcaggaaatacgcccgcttggcaagacactgttttagacagtcaacagccaaaggcaccgatcaaaatcgggattgctacaggaattggtgcactactttggttaggaccatatctaggtgttaatgccgttttacttcctgcgaaggttgaacaggttattccttcacagaaagcccaagttgttgctttactagcttcagctgcaatgatcgttgcaacacttgcaaacatcgttatcggtggtttttcagacttgactcgttccaaatggggtcgtcgaacaccttggattttaattggatcagttggtagtttaatcacactggcatggttcaatatgtcgggaaccgttccaatgatggttatatcgtggagctgctatcagatctttctaaacgccattgttgcaccgttgcttgccttcctgcaagaccaagttgcaccaaagcatcgtgggacaatttcttcaatttacgcgttcggttacgtgattggtcagtatggtggtcaagttgttggtgcccaattcttgggtaatgtcggaactggtatcttggtaatgggcttcttaacattactatcaggcccagttgctgcattaattgttcgtgagccttcaagtaagggaatgcctaagaagagctttacgttcaacatgttcttacaaaactttatttttccactgcacaacgccaaggacttctatcttgctctctttggtaagatgatgattaacactgctacgactgcaatcatgggttaccaattgtacattttgagtgattacatcaagttaaacactgccggtcaacaaaaatatgtttcaatcatttcaatgatcctgatggttacggcgatcgtgatgtcaatttccgcaggtcctgtttctgataagatgcatagtcgtaaagtaccagtatttatcgctgctttactggttgcagtaggagttatcttcccagcatttacaaacgcatcatggtcaatgcttgtttatggcttgttagctggtttaggaatgggaatcttcttcgctgttgaccaggcgcttaaccttgaagtattgcctaacccacagactgctgctaaagatttagggattttgaacttagcaaataccgggtcacaaattcttggaccgattgttgctgcttcaattgttactgcagctcatggtagttactttggaatcttcccggtttgtgccgcacttgcacttatcggtggtgttttaatcctctttgttaatgagcatcgggatgttaaagtgcaacaagaagaagcaaaataaatttcaaataggtactaaccgttcctgagggctgttattactttcactgccgcaggaattggaactaactaaaatgtgaaggcaaaaaataacgcagaggtgaaaatttaatgagtgcaaagcaaatcgagacaactcaagatcaaaaattacatgaagttgaattgtcgacaactactgaaaaggccttcaacagtcttgaggtaggaactgaaaagcgccaagaaatttggggctttggccaaacatttaatgagttgggcgcggtcgcattacaaaatctttcagaagaaaaacgaaacgaaatcttagatgatttatttacacctaagggtatgaattataatatctgccgaattccagtgggagccagtgactatgccttaaattggtacagtgcagatgaaacaactgatgattatgatttagcagatttctcaattgaaagagacaagaaatacttgttgccttatgtaaaagcagctcaaaaacgtaatcctgatattgtcttttcgatttctccttggagtcccccaacctggatgaagagtcatccggtttataactacggaatcttgaagcatgatccaaaggttcaacaagcatatgccgattactttgttaagttctgtgaagcatatgaaaaggaaggcgttcacattagctggatcttcccacaaaacgaaccacaacgtgatcagaaattcccatcatgttactggacgggtgaagaattacgtgatttcatcaagaactatctcggaccaacagttgaaaagtctggcttaaaggatactcagatctggcttggcacaatcaactcaccacttgaagatacagaaatgactaaagatgaaacgactgattatccagttattgctgaaacagttctttcagatccagatgcttacaagtatgtaaagggtgttacctatcaatgggctggtaagtcaatccttcaacggacggttcactcattcccagagttaggctaccttcaatctgagagtgaatgtggtaacggtgacaatacttggacttatgcagaatatgtctttaatttgttccgtcattatattgaaaatggtgtgaacggctatatgtactggaactctgtcttacaaggcggctcaagtacttggggctggttacaaaatagcatgatctctgttgatgctgataaaggaatcgcaactaagaacccagaatactatgtcatgcgccattatgctcactatattcaacatggtgctcatttagttgattacacaggtcatctgtatggtgaatcaactgcttatgaaaatccagatggtagcgttgttattgtcatgtcaaacagcatgaatcatggcagagacatcacagttactgccaagggtcaaacttacaaagctagtgttaaggctcattcattcaatacatttgtgtttgattaaccaagtaacaaaatgagactggtcattgtgtggcgataacgattaagtttccctcttgtagagataatacagcgacacaccaatcattattaggtttctgacacctacccccatttgattgactggttagtttcatttgtgaaaaagcagtagaatcatcatcccggttctactgctttttagaaaaattgatttaatggtgttttatcgtttattaactaaagtaatattgtacaaccaacttacggggaattggggaatttgactatttatgatagtctgtttcccttttcttttagggaaaatgaaagcgcaaacatataaaatcattgaaagggtcgtttataatgacacatagatttagaacgggttcgattttaaaaaatatcgttaagataacagtttcaatgtctgttttgatacttggaattttcgcattttcaagcaatatcagggcagatacattaaaggcatccccatccggaccgtctttggtatatcagtcaaatccggggactagcaaattctctaatggtcatggttatggtgcactgtctcctagagttgttcagttaaagcatcaagcaaatccagctgataacggaaaactattgttgacttttgaacaggtcattactgacgctgatgttgcagctggaaagcttccagtttttccgatctatgaaagtgacgataatggtgttacctggaagcacattactgatataaaagagacacaccaagctggttatggcaagatgaattgtcctcaattatatgaattgcctcaaacaattggcgatatgcccaaaggaacggtcgttttagcgggaaattccacaccaaacgacttaaatgggactcagttagaattagagaagagtactgatgctggtcaaaattggaattatgaaagcactataacaactgcaccagggcttaatagaacaggagccgatccagtttgggaaccatttttaatggtgtacgataatcagcttgtttgttattactcggatgaacgggataatacggttaaaggttctcaaacactcgttcatcaaacaacaaccgatggcaaaaattggagtgatgtcgttgttgacgcaaagtactataagaagggtgacaatcgtccggggatgccaactgttgctaagatgagtaatggtaaatgggcaatgacttatgaagaaaatgccggtgccacttcggcagtcaaaattagtgatgatccattaaattggggctctgtagacgaccgtggaacaacaattgcaccagaaggatcaccaattattaccacactaaatgacggtcgtttagcttttaataactatcaaaccaagcgtgatcaagggaaggtatttatttttaacgatcaggaggcattacttaaaggaacctttaatcctagtgccgcctacgaaactaagacaggggctgcctataatcgtgatattgttcccctagcaaatggcttgttgttagtagcaaatggtggcgcattcggcgctaataataaaatccaaacagaaaccatcgatgttggcgacacaacgcaacagggaaaagtaattgtccactacgttgatcaaaatggtaaacaacttgcaccagatgatacggtctccggcgttatcggaaccagctttgatgtgactggtaagacaaataaagcaattagtggttacacacttcaaggcgtcacggctgggcaaaacagcttaaccggaaacttcggcgcagaccccattgagattactgtcacgtacacgccagtgacaagtggcggtggctcgacggttactacaccgtcttcatcaagcagtagttcgagttcgtccagttcaacggtggtgagttcatcttcgtcatccacaacatcaagctcgacaaataccaatgaaagctcatccagtacaaccagcaccgaagcatcgacaagcaagaaagtcgcaccattcaaagttgtggctaaaaaagccttgtatcgatacagcagtccgcagttcaccaagactaatcggattaaaggatatgctcaaaagacccttacaaaggccccagtctttaaagtagttggtacaactaaatcaaccaatggcgctttaagataccaattaagtgatggcagctatatcacggctaaaaaaggttatacgattaaactgtatttgactaagaaagttaatatgctaaaagtcatcaatgccaagggaacttgggaatacaaatcaactaaggccattaagaagaacgcggttaaacatctgaaaaaaggaacagttgtaaccgttaaaaagattgttatagctggtaacgcgactaagtatcaattaactaatggtcattatgtaacaggtaatcgtcagtatgttaaagctcagttttagattgatataaaaatcaaaagcagcactcaaaggattctaaattaattagcagagtttggaatcctttctgtacatagaataacgattcgtggaagagaggagaagcaaaatgataattgatcaagtaaaggaacttattgaagttggtaaaattactgaagcgaataaacttctgggatacaattatcaaactaaggggcgattaattcgtgctcaaattcaaggattgtcgatcgtgattccttccgatgacttgcagcaagttcctactggcggtaattataaaggaatagtgaaaattgcagggcaagaaaagctgacaaagattgttgttaatgattcaactgaccaaagtgtgccaagaattatctttgttgatcttaaacatttcgaagaattaccacatgtgagttctttgcctgtttcgattagttgggttgggaaagaagaccgcttaaagtattaacataagaaaaaggaagggtatgggacgaaaagctgcggaaagttgcctttcgtcccacttttttctactcggtaataatcaaccttcctttttttatattcgataatgaacgtttgaaacaaatattgtccattagtagacagtaaatcatctatatttatgatgagacttttaataaaatggttattgtaagttggttgatatcattatttactcaaacttttgtaaacgcttaacacgcttatgaaaaacagaattactgaaattaaatttggaaggaataattatcatgacagaatatcatgtttctaaaacaggtaacgatcagaatgatggtagtaaaaatcgtccgtttttaacaattcaaaaagcagcagataccgctattgccggtgatacggtgacggttcatgaaggcacttaccgcgagtgggttaaaccgcttaatccgggacttagtgatcgtcgacggatcgtctatcaggcggcaccggatgaacgagtgattattaaaggttcagaagttgttaaacattggcagcaagttgacggtaatatttggaaagcaaccattgacaatcatatttttggggattttaatccattcgcaacagccgtgtggggtgattggttaacttcaattgatcatactagtcatttgggatccgtatatgttgatggcaaggctatgtttgaatcacagtcattagaggcattaaaaaatcccgagcaacgaaagacggttgaaaactttttcacgcacgaacaactaccggatttctattcagaggatacgaagttggtttggtacgcagaacctcaagcgcagcaaacaattatctctgctaattttcagggaattgatcccaataacgcattgattgaaattaatgtccgaccgtgttgtttctttcctgaacgaaccgggattgattatattactgttcgggattttgagatggctcaaacggcaacgcaatgggcaccgcctactggtaaccaacagggactaatcggaccacattggagtaagggatggattattgaagataatttgattcatgattcaaaatgtagtggcatcagtctgggtaaggagctttcaaccggtgacagttattattatcgccgctatgataaaccgggctatacgtatcaaattgaaacggtttttgctggtgaacataacggctgggataaagatcgtatcggcagtcacattattcgccgcaaccatatttacaattgtgggcaaactggaattgtcggtcacatgggctgtgcatttagtcagatctatgacaacgagattcatgatatcgcgacccgccatgaatttgaaggctgggaaattgctgggattaaattgcatgctgccattgatacccaaattcgacacaaccgaatttatcgctgttcattagggacctggcttgattggcaagctcaaggaacacgggttcatcagaatatttactatcaaaatgggatggatttctttgtcgaagtctcacacggcccgttcttgattgaaaacaatatttttgcttctaaatatgcattaagacatctttccgatggtggtgcatatgttaataatattattgctggcgacatgttggttgatgatgtgcgaaaccgctcgacaccttatcacttgccacatagtacaaccgttaaagggatgacggcggtctatggtggtgatgatcgttactttaataatattttcattagccgaaaaacagttaaaaattgtggaactgatatgtatgatgggcatccgcaatcgttacaagcttatattgatgatgttcaaacgcaggcaccaactgatcttgaaggatacgaggctaagaaaacgccagtctatattgataacaatgcgtactttaatggtgccaagaactttgcggatgaaaaaaattatttatcagaagcgtcatttgatacaaagtttgccgttgaagaacgaggggaatcgctttatttaaaaatgatactaccagaaacgtttgacggctttaaaaatccgattaaaacaacggctactttgccccacgtgcgaattgtggatgctgattttgaacagccggatggttctaaattaacggtgaatactgatttgctgaatcagaccagtaatgacgatattgttgctggaccgattcagtcattaaagggcggtcaaaatcaaatcaagatttggtagttgtcaaatgaatttgatagttagataaaccccatactaagataatttttcccttgcaaaaaaggatggttactgctagaatacttttaagtttaattattaaacgtcaatgccatcacactgcgggagtgtgatggcaggcagagtcatgtatctaactgaagatgaattcattaataataggggaacggggaatcgactatttttagtctggtttcccgtttcttttaggatctaatgaaagcgctttattgaagagggtgattcaatcaatcatacaattgaaattaaaaagaatctcgttttgatgaattgaggggtaattacgcgattttttggcacaaagattcaaggattttgaatttctgtcacgccattaaaattaaattaatgaaaagaggaatcataatatgattattgatcaggtaagggaattagttggtgttggtaaaattacggaagcaaatgaactattaggttacaagtatcagacaaagggacggttaattcgagcacagattcagggactgtccattgtgattccgaccgatagtatggaagcaattccgtgcggaggcaattatatcggcctcgtagaaattgcggggcaggagaacctgacaaaaattgttgtgaacgagtcacaggaacaaacatcctcggcggttatttttgttgatcttcgtgattttaacgaattaccacacgttagttcacttccagtgtcgattagatggattgaacaagagtaaagtggtaggcgtaatctttggtttagagaattacatacgctaataattcgttcaaataaccgaaaatggcattttagattatgttcttgagaaaaaatagtcatggaagtgaaacttatttttaccagttccaattactcataaaggggagtgtttccgtcaacattgattaatgctgattcagaaacagtcccctttaattatgtagcaaaaaattcaattaaaagtaagctgtgacaaataaataacccgccagtccaaacgctgccaaagaaatcaaggcgcgcaataaatggatattaacgtgacgaacaataattgggccggtataaccacccaacagcaagccaaatccgagtggtaccacgtatagccagtcaatgtgggatttaaagataaagataattgttgcaatcaaatttccagcaaaggcaatcacgtttttcatcgcgttaacaacggtaaatttatcatcggtaatgactgaaagaatcgctaggaagatgacgccacccgcagcaccaaagtagccggtgtaggcgcccaccaacacaatcccggttaaactgattaacgagacccaccatctgtgttgaggggttgcgtgggctgacttaagctttgtcgtatggacatccttttttcgaccggataagaataggagaattccggcagctaagataaagaatggcacaaccttttcaaatgaagaggccggggcgaccagcaataaaatgctaccgccgacacttcctacaagtgagagggccacaaaaaccagtaattttttccagtgccctcgaagttcctttaatgaagaagctgttgcaccaattccggaaaagattagtgccgtcgtgttggtcacatttgcgataactggcgggacaccaattgctaaaagggctgggtaggagaccagagatgctaagccagcgatcgaagccaataagccagcggcaaatccggcaatcattagaaaaataaatatcaaaaccatatatttgccaccctttcaaaaattaagatacttctaatatactacaactggagttgttcaaaaagcggcttatgagcaaaatacaagcagctgaaccgaatattcccactaaagggaattaggcacagctgctcatggaagtcgaaattgctattttaaatgttggtaatttggtgatgaattattttatgccgaaatatgggttgctggttcagtttgatgacgtttgatcgctttattgaggagatacaggaatgctaatgaaatcattgcgtaaacagctgaaccgatactaatcttatcaaggcccacaattccgaccattacggaggcggttgccgagccgagtgaaatcccaaaattaaagaagatggagcttagggatgaagccaagaccagtgactgtgggtaatcagattcggcaatgttaagaaaatgaagctggatcggcgagtttaggaccgtgacaattagcgttagaatcagtagaatcgccataccggaaattttgttggttaatcccaaaggcatcatcaataacaagataatatcggcaacatagaattttggcatcgcatttaaaccgttaggacgttcggcgatcgcacccgataatcggttacttaaaatactcatgataccaatgacaaacagcagccaattcagactagtggtgctaaagcccattgtcgtggttagcagtggtcggatataagtgtagtaagcatacatggttgcggccgtgaacaagacaaggacaatgccataataaattcgtgggtcaagcaataaagtaagttgatttttaattgaactctgagtttgtttcacctttttagggagtagaaatactaatagaataaatgtcacgatgctgatgaccgaaatgccaaagaacgtgtagcgccaattataactggtactgattgcaaccccgatcggcaccccaaacacagatgcaatactgaaaccggcaaagatccaagagaccaggctggcacgtttatcccttggcgcaattgtgctggcaaatgtcatgacaagcgaaatgatggagccggcggttgtggctgtgataattcgagaaatgaccataaaaatgtagttggtcgctaacccactgagggtgttaccgattaaaaagaccaacattaatgataataatgttttgtaacggttgtaacggctggtaagaaccgttacaaatggggtacttaccgcgtagactgtcgcaaaaatggtaaccaggtagcccattatcgagattggaacctgaaattgtttagataaatctgacaggatcccgacaacaataaattcattgcagcccagcataaaagcaacaagaataaaaatgagcgattgtaatttgaacttgctcacgtgattttccccctcgttatttaatcgttggtctaaagcggaccttttacagattatcacaaaagcattaagaatagaaagataaatttgagatagctgaaaaaagctcacggattacatctgctgccagcaggctgattcgtgagctttttatttcattatatatattggaaaatcaagtgaaccattctttattatgatggataccgttctgaaaccatactgcgttgatgcagataagttagaccgccgaagataacagtccaagcaatagcgccaaccgcaccaataatatcttggggaataaagaagagagtgacgaagataatcgcaaagaaagcaattgtcaacggactggtgaaatgataccaaggcattttaaatccgtctggtagaaaatcgctggattcccgatacttacggtgagcaatcatgacaagtgcataaacgatgatgtacatatcatttgatgagccggcaacaattgtaaagacggcaccagttgcgttggtcaaactcatgagtggcgtaatgaggagcagcagcgctgagatcttaatggcagcagctggaaccccactcttggaaatcttggcgaaatgttggtgcatccaagcgtcttcgggcaattcatccgctaattgatagaaatgacgacctgccgaaaagataaaactgttcagtgacgatgaagcagaagttaacacaacaaaattgatgaatgcagcggcagccggtaatccggcaagcttgaatacttgaacaaatgggctgcttgttggtgttaaatgagtccaaggaatgatgcccataatgacgatcatggcaccgaaatagaagaccaaaatcttaagtaaggtttcgttaacggctttcttaatgattcgatggggtgtcttggcctcaccaatggtaatgctgacaaattcgattccctgaaaggcgaagaaagccattggaaatgcagaaataaaactcaacccaccgtgtgggaacatgctgaagttgtggaacagattttgaacggaagcgtgaccaagtggggttactgagtggctggtcatcataaaaataccagttacaattaatgccacgattgcgacaattttgattaacgcgaaccaaaattcagcttcaccaaacatcttagcggcaatcaagttaatcgacgccaaaattcctaaaaagacgacttgaatcagccaagccggcacatttggcagccagaactgaacataagttgaaattgccgagagttccgccatgccacagaaggttaatcccagccaataggtccaacccgtaaaatgaccaaccgtggggcctaaatagcgcgtgataaatgaaacaaaggtatgttgcgatgggtccgaatatagcatttcaccaattgcccgcatcatcaagaagaaaaagattcctaatactaaataaaccaatagaatagaaggaccggttttactaattgttgttcccgatcccaggaacagccccgttccgatggttccaccaatcgcaatcatttgaacatttcggttgcttagagagcgcatcgtcccatctgcattttcagttacttttgtcttttgcatccaaactcctcctcgttagtattaatgatttatggaaaaattagaggccctctaattaattgacattatcctaacatgatggtgtttaaaatcaggtatttggagcagatgtttttacatgattttgcattttagaactatttttaatgaaaataaggcaaaagttgtgatcagcctatgaaaacaaaatagttgtttcaaaaaggtgtttttataaaattggcacgagtttggtgctaaaaggtagatgaagtgactattatttggtggctttagcaggttggcattggtaaatttgtgggggcgcgactatgtgctgtgtttgttggcgaccaatgagtagcttttcttaaattgaaatgcgcgagaggaaagtagtttctggttatataagtggcttaacccaatgtttcaggtttggggttcggaatgggtttgttatttagccgaaacgtggtccaaccagcagctcccggccatataaacagcttcacccaatagccccaagttcagggatattgggtgaagctgcttatattctgggagctaaccactggctggcccactctgctatttttccggcaatctcaacggtcttgggccaatatttgttgtgaaggccacgttggtatgggtattgccaaagtcctttagtgacgcgttaaattcgtttaactcagtcatcgttttataaaagaccttgagctgtaccgccgcatctcccgtaatatagttgcattccactacgttaggtacttttgcaatgaattttacaaatttaggcatttccttgtagcttacgtcaagtcggacaaacgctttgattagataacctaatttttcgtaattaacattcgcggtgtaactattaataaagccatgattttctaaattctgtaggcggactgaagccgatggcgctgaaataaaacatttttcagcaatctttttaatggaaattcggccgtcctgttgaataatgttaaggatttttcgatcaagtttatccattaggtatcgcttctttctaattatgaatcgttaatcttcattatactatgatctcaacaattttttaaaaccggacgaatgacgcattaaatcagcaacataaccattatcgagttggctcagccttttttgacaactttatttaaataaatcactgaaagggcttgcatttttgatgatctctttttataataggtcttgtaagttggttgtgtgaacgaactaatctaaaaacaaaattggaggctctttttatgagttactgggacgtagataaaatcaagtacgttggtacagggaacaaaaagtctggcttgggatttcaatactacaatgccgatgaaatgatcggtggcaagaaaatgcgtgattggttgcgatttgctgttgcatactggcacacatttgatcaacgactagttgacccatttggtgatgggactgctattcggccttatgataaatatactgacccaatggatcaagccttagccaaggttgatgcagcatttgaattttatgacaaattaggcgttgacttcctttgcttccacgatcgtgaccttgctcctgaaggtgacacattacgtgaaaccaacaagaacttagacaaagtcgttgataagattgttgaaaatcaaaagacttctggcatgaaggttctctggaatacgtcgaacttattcactaatcctcgttttgttgccggtgccggcacatctccatatgctgatatttttgcttactcagcagctcaattaaagcacagcttggaaattggtaagcgggttggttctgaaaactatgtcttctggggcggccgtgaaggttacgaatcactctggaatactgacatgaagcgtgaacaagaacatgctgccaagttattccatatggctaaagattacgctaatgaaattggttttgatgctcaaatgcttcttgaaccaaagccaaaggaaccaaccactcatcaatacgatttcgatgctgcaacaaccattgcctttatgaaggaatatggtttggacaaggacttcaagcttaacttggaaggtaaccacgctaacttagctggtcatacttaccaacatgaaatccgagttgctcgtgaagccggtttacttggttcacttgatgccaaccaaggtgataagttaattggttgggatattgatgaatatccatcaaacctttacgagacaactgctgctatgactgaagttgttgaaaatggaagtatcggtcctcgcggtggtttgaactttgatgcgaaaccacgtcgttcttcatttgaaccagatgacttgttctatggccatattgttggtatggacagtttcgccgctggtttgcgagttgccgttgctatgaagcaagacggtgtgcttgacaaccttgttaaggaccgttacagctcatacgattcaggtattggtgctgaaatcgaagctggtaaagcaaccatgaaagaacttgaagattactcattggataagactcagaaggaattgcgtgatgcaactcattcagatcatcttgaggaaatcaaggacacaatcaaccattatattattcagactttgaaataaagaatgaagtaaacggatgatagatgattaaacgaggtcagggcaaatgaacatcttgtcttggcctcgtttgctaattacaatgtttattaagttaaacttgtgacgaaagggaggtacctcgatgactgaatgtgtattaggcgttgacctggggaccagttctgtaaaagtttccgcagtgacgcgatctggtgaaattatcgcccaggaggggatggactttccactccgccaaccccaacccggttacgctgagcaggatcccaacgattgggtgaatgcaaccacggtcgcaattgttcgcttgattttgaaggataagttaaagccggaacaaattaagggagtcagctattccggtcaaatgcatggattggttttgcttgataaggataataatattttacgaccggcaatgctttggaatgacacccgttcaacgaagcagcgggaagaaattatggccaaaatgggtcatcaatttattgagattacccataataaaccgcttgaaggatttacattacctaaattactttgggttaaagagaatcagccggatatttttgctaaagcaacgaccatgctgttacctaaagattatttacgttttagaatgactggtaaattggcgatggattattctgatgcgaccggaacggtcatgttggatgttgagaaacaacagtggagcaaggaaatcttggatgcctttgatattccggaaacaatttgtccaccgttggttcgctctattgataacacgggtcatattacgaagtggtattctgaatattctggcttatcaactgacacggtcacttttggtggcggggctgataatgcctgtggtgctgtgggagccgggattgatagtccaaccaaggtgctttcaagtattgggacttcgggcgttattttgaagtatgagccacagaaggaaaccaactatgaaggtgtcctccaatatgaagatcacgcgattccagatgcgttttactcaatgggggtcacattagcagccggcttttcattgagctggtttaaacgaacgtttgcggctgatgaagattttacggaagtggtcgaaagcgcggctgaatcgacagttggtgccaatggcttattgtttgccccatatatcgttggtgaacgggcaccgtatgcggatgctgatatccggggaagcttcattggaattgatggtattcataagcgccatgactttgtccgagcggttttggaaggtatcattttctctttccgcgatatcatggataaatacgaagaaaagggcagtcaatttgatacggtggtctcaattggtggcggcgcaaaaagcccactgtggcaacaaattcaagccaacatttttaatgttaaggtcgtttcattaaagaatgaacagggtccaggattaggagcagcaatgttagcggctgttgggatgggctggtataaagatatttcagaatgtacaaaagtgtttgttcaatttaaggatgtctttttgccggaaccggaaaatgtgtcgaagtatcaaaagctgcatgatatttatcagaagatttatccaagtacaaaggaaattacccatgatctggtggggtatcgacgcaaggagcagagtgcaaaaagccgcggttagcctccagaatataagacacttaaccccatattcctgattttggaatatggggttaagtgtcttatatggccggaggttgcggctcttttgcacgtttaatctagatagtagtgattcgcagatattgatatgcaaatcgcaacacaaacatagatgggggtgacagcctttctcggaagtgcgcaaattgacgaaaaatacattcattctgatcttggaaaaaagctagtttgtaaccattctcaatcatcaaaaaaattattgatgaatttatttgcgatagtcactaaataaaatagcttgaaaacaactcttttcggccttctttgacgtcacttgacataacgcctataataatttttgtatctattcgactctttaaaaattagtaaggatgttaacatgacaaaatcaaagacaccacaatggcaaaaaaacttgcgggcgttgtggtttggcaattttgccactggcgccggcgcaagtatgtcattaccttttttaccattatttatttctgaaatgggaaatttcccaaaatggcaattaacgctttattcaggactggcatttgccagcgtatttcttagccaggccatcgtttcacctttatgggggagcttagcagatcgaaccggtcgaaagccaatgttactacgagctgcgattgggatgacgattagtgcgacgttaactggtcttgcacccaatgtttggatgttgattgcaattcgatttattcaagggactttttccggttatattaataatgcttatgctttagttgccagtgaagtaccttcaaatcaaagtggtcgggcaatgggaactttgacaaccggaaatgtgggtggtcaattaattggcccaatcattggtggctatctgtccggactatttgggttccggttaccattttatatttttggcttcatgatgtttttagcttctttatcaacctggttctttgtcaaggaagactttaagccgatcaaaagggcagctaagacaggtattaaagatgcattttctggaattaagcataagcgggttgtaactgcgatgattatttcatcaatgttgataatggcagcaactatgtcgattaatccgattatcagcttgtttgttagggaactgatgcataatcacggcaacattgcgtttgtcagtggggtgattgcggcgctgcccggaattgcaactttaatgactgcgccgcgactcggacgattgggggatcatattggtccggagaagattttattagctggtctaattgcgtctgctttagtgtattttccaatgtttttctcaacgaccgttttattactgggcattctgcggttcctaattgggattgccaacgcggcgttactgccgattactcaaacagtcatgaccttggaggcgccggctcgatcagttagccggatctttagttataatcagtcatttcaggcaatcggcgccgtgattggaccaatgttggcctcattagttgccggggcactggattatcggtatgttttcttaatgaccactattttggtgcttatcaatttagtcgtggttgtgattgcttatcgaaaagatggtgttaagctaaaaggaagttagcgtcatctaatatgattgtggaaatgttaactgaaattcaacgattagaaaatcgacttcttgtttgattaaggttacttatctatgcataggaaggtagctaaaattttaggtgttacaaaaataatagttgttgtgtttgttgatgttgaggattatcactaaagggtggtgtagtttatggataatgttgattttgatgatgcagtagaaatggagataacaccaactacctcggcagctgatgtgttaaaagaaacaatgaccttccatcatattactcaggttgagtttgcggaacacattggcatatcacagaaacaactctcatttattctaaaccgacatgcttatatgagtattcaagtagcacgacaaattgaacaggctaccggattgagtgctaagtggttattacaacttgattttaattatcgttttgcaaatcataaattagatcaacatgatggcgttaaaaggtttgattgggcaatggcttagcaagattagcggatcaggtggccgggacgtaagtagataaaacaatttttaaagaagagagtgggacgaaaggcggttaacttccagagcgtaatcggattatccgaatattccgggcttgaatgtttggataattcggttatgcggcaggaagttgccttttggcgcacgtttccactcggtaataattgtgattatacaaaacgggactgggacgaaattacttttgtcccagccccatttttatttcggaactaagacgttataatataagcttttgactattgtgccagccgctgcttttttgttaatgtgttttcccgttacgtttccctacgttttaaaaaaatcgtcggtagttgtaagcatcgttactaatctcagataaattttccggcaaattatttgtaataggcaaggaaatataatagaatttgttcaaatcagagaataaaaaatgttaaccgctagaaaaggaagtgtagattagagggggcgacaaggatgctgctattgttcagggtatttgatatcatgttacttatttttggagctgccgtttggtgtacagatcggggctatacaaaacggtttggttctgaatcggcctatttggccaagattctgcagaaagacggttccggcttaaagaaagctttaagtccggatctctcaattacagaagagactcggcaaatggtcctcaagcgattgaaggcgattcagcgctggtactggttagcgcaaaagaaagccactttagtgtggatgctgttattgcaagagtgcttagttatttttgcgaaacagaatgccggcttaattattgttgaggcgtctttattggttgtggttacgctgatcatgattgccagctggcgaacggataaagcccgggttgaaattgaagttgagttaaaaaagtatgaggaccggttgtggtttgaatacacaaaggcctaatgtgtgaaaccattaatgatttgaaatatggttagaattgattatactagtggtataaaatctttttagattttattggaccttgagtccgtagtatgtttaatcatacttttggttagcttggaccatcgaacaagacaacaaggtatcttgttcatacaagcaagaatggcgaccttactcgttttaacgagtgggtcgccttttttgttgtaaataatgttgaatttaaaatacatagattaaaagggaactgcggcaattttggcaaacaattcgaatgtttttaaaattcaaaaatatgcgaatcatgcgtaaaactttaattataattgattcctcctttaggttacgcgtctaattaacgccattatttttcggtttaagttatttgtttcaggcgctttataaatgataacgttaccaatttataatgaaaacctttactttagataacctacttgaaatatgtttgatgacgcaatagaatctgatgtaaagaagaaaaggattagttgttgatgctgacattggtttgaaaaaaggatgatgattgttatgttttttactggatttaaaatttttgatgttgtcctgttaatctttggtgcggctgtttggtgcacggatcgatcatatcttaaccagtttggccgtaagtcagtttacctggccaaaattttgcagaaggatggttccggcttaaaaaaggcattgaatcctcaaatacatatttctcccgcgaacattacatatattcataaacggtttagagctattcaacggtggtactggttgtctcaaaaaaaggcatcgttagtttggctattgctgattcaagaatgtctggttatttttgcaaaacaagatttgggattaattattgttgaggcgggcattctaatggtggcaactttggtcatgattgcgggatggcgaactgataaggcacgggtggaagccgagagcgcactaataagatatgaagaccggctgtggtttgaatatcgacaagcataaaacaaattaagtgaatcgtaaagattgttttcgataggttcgtttaattaaaaagagtggttttaatcattgaatggcttaatttacaaaagttagcgttatcatctcataatgaaaccctttactttatataacccccttgaaatagttggcgaggcgttataaaatcaattgttaaaagagaaagaaagttgattggaggcattcacgtatgaaagcatttctgcaaataacggactgcttgatgcagtttttcatgattggtatttggttcgtcgactggatgttaatccgatatcagggacgaaagtcatcacccgttgcggcgctacttcagcgaaatgcttctggtctgcggattgcgttaaagggcaagtgtaatgttcctcgtcagtatcatcaagatattgaccgtttgtccagaaaaattgatcgctggtattggttatcgcataaaaaactaaccttggtcgttgtcctggcagttcaggaatggctgatttttactgccaaacaagggtgggggttagttgccgttgagttgtcaatgctgacagcctgcatgttaatcttgattgctgattataaagctaattcagcccgattagacttggaaaacatgttgagtccttaccaagaccgactttggtttgagtattcgttgcgtaaaaactaaatcattaaaaagatcccgctattcacttataatgagagaaaacaatgaattgtattctgacattttagttgaatagggggatcttttgcatgtgtggacgctattattttgatgtgttgcggtcaaaacggcttgaaaaactgcatcaagaattgggtgatttgggaattgatgtcaaaacgggtgaagttttccccagtgatatgacggctgttgtcaggaaaaaccaacatcaaatcgcgattgacggcattaaatggggatttgaaggctttaagccaaaccaactaattattaatgcccggtctgagtcagttattaataagcaactgttcaagctgccatttttgactaatcggtgcgtctttccaatgtcgggattttatgaatggcgtcgtgataaagcaaagtatttgtttacctatccagatgatcaactcatttttgtgggtggttttatccggcagtactcagacggcccgcgatcgatcattatgacaacggcacccaatgaagcaattcgccaagttcataatcgaatgccggtattagttgacgaacggtatattcgaaattggctttttgatgacgactatgcgactaatttgttatcggaacagatgccaaatctggtcggacagcaggtaaaaagtaaataaaagccatatcctcgccttttcttgggctggacggctataatgtaagtacgcacaaaaacaagggaggcattgcgatgtcaattttaactgatacgtatacgctgaataacggattagcaatcccaaaagtcggatttgggacctggcagattcccggtggtcaacagacctatgatgctgttagttcggcattgaaggctgggtaccgtcacatcgatactgctaaggcttatcgaaatgagcacagtgttggcgaggcaattttagattcgtcagttgatcgtgaaaatgtgtttgtaacatcaaaattaccagcagaaactaaaacttatgatggggccatttctgattttcgttcaacaatgaaagccttggatttatcgtatttggatctttatttaattcatgccccgtggccatggggtgatcgtggcagtaatcatgatgaggaaaacgtggaagtctggaaagcaatgcaggatatttatgccagcggccaagtgaaggccattggagtttccaactttaatgttcatgatttacaaaacattattgaccatgcggatgtgaagccaatggttgatcaaattcgttattttgtgggctatacagaaccacagatcactaagtttgcccaagataatggcctattggtagaagcctattcgccattggcaacaggggcaattttagaaaatgaagacattaagcgaattgccgctcgctataatgtgagtgttgcccaactcgccattaaatttgttcttcaaaatggggttctgccattaccaaaggcgactcatgaaactcacattaagaataataccaagcttgattttgaaattaacgatcatgatatgcgggttttaaatcaactgactgagacggatatgggataggattagtgtgttttataatagaggggcccgtgattaaaacaagcaattttgttttaatcacgggcctcttttgtagaatttgttaaggatagccaattaaaaacaggattctaatcatcgctaccaatttgagtataatatgttttgccactcaaatgatataaactatcgtaggagccgggaatatcgttatcgggatccccaggggtaaattgaggttgatggagattggtcagctgatatcgatactggtatgagcccttcgaattaacttttgttgcttttagcccatttacttttttagacgtgtaaaagtaacgggtgttacctttcatcagcgttttattgattttggcatcaccgttgggcttttgtagaaattgaaggctaaattcaacttttgaatttcttttatagtattcaagatagccatccggcgtaattcgcagattgatgttggggcgctttttactttcgagaaaggcagcatcgccctggtacaaattaccatcactatatgctggcatataggtcggtcgttttaccctggtgaatgatttgacattggcactgagcggatttgagtacttggaatcaggatagggatcaagcgtatagcccggtaagataccggttcttttggtgtgataacttagctgtcgctcatcgatcaacaactcccttgattttgagccgccattgtgctggccttcaacaattgtgccctttttgatcgtcatgtttctgatgattgattttccaattttgtagctgggggtgtatgccgtttttagagtgatatttttgttagcacgatagtaggtatagtaagtaactaaatttgccatatttagtttgcttgggggaactgcttttgcatgagccggggcacttggttgaagtaggcaaacaccaatgattattagtaggctttttaagaaggcaagacttatttttttcaagattaacgctcccttgagtaatgactaagtttaaaccgaatgtgagttccagcaataaggtttagttgtactgtaaccattttagaacaatccaaggcaaaattcagttaatcattcaaaaggcaagcttttcctgttatttctacaactaaattatgcttagccgattctttcgacagtgcttcgaactcattttagttccaaccaaatttttgacatgacgttgctgccattgctaaccgtgtagtaaactgaatggttgatcttagttcggagatagtcgagggtcatccctaatttcgctggtttaaggtaattaattgaaatctgtttgaggtgatcaactgtttcatctacaaagtctaagtagcgggcattattcatgtggccatagttatcaatgtctcgtggcagaattcgaaaatccgttctggtctggtttttactgacagggatgtcgattctgtcacggtgaaagcctaaatgttttgtcgaatcaaccattgaagcaatcgggtagtcaactggtaatttggcgatccgtcccgattcattattaacgacaaaggcatcctcaagctggctggcaatgagttgttctgcttgatcgcgaatttcaactaaccgggtgatcttgtgccggtttgcatctgtgataaatgattgaatggtgattggatcaccaagcgataatgtggcgcgaatccggacgctttgagaaactacaaaatatagtaatttagagtctaacggtggtagttgggttcgaatttgctgaaaatgcaaccaaccagcattttgaaatttatcgattaggtttccaagacggatcttagaatcctgaccaacatctgataaatgaacaacacttttaagttcaaacaataaagtcaccttcaatataaatagtcattatgtgatttaatccatccgtggacaatatacatctatggatatagaatgtccataggtagatcaatgaaaatgaaaggacttatttttcatgaagctaaaggggagttttgaacaagccgtttgcattctactcatgttggctctcagtaaagatcgggcgccaattcgcagtatcgtcattagtaaacggttgggtgtatcagattcatacttaaaaaaggttcttcatcagctggtgttaggtggtttgattagttcggaagccggtaagggtggtggcttcttgcttgctaagcaaattaaccaggtgacactactggatgtttatgatgccattgaaggaccagaaccaatcattaaatcaactggaattgccaagcagattttctttgacggccaattcgttgagaaccaggagaaactaatttttgatcaggtttaccgagctgaggatcaatttaaagcgggtttaaaagccgaagttcttggcgacctgctagttaatcccgatggttctcaccgccagccaattgattggaaccaggtgaccagctgatgtttcagaattcaaaggatagaatgattgcgatttcggatggtgtctttgccgtggtgctaaccattatggtgctggatatcaaggctcctaatggcgatatctcagcgtttgaagttcaccgattactgacgcagctatttgcttatctcattagctttggcgtggttgcgcaatactggattcttcaccaagaactatttgcgacattaaaaacgccaaccattaaaattatggttggtaacatttactttctatgtccaatttgcctggtaccgttcgcgacaacttggttaaataatagtttcatctctccggaaagtgccgttagttttgcgttcttaatgtttatcgtggataccgcgcagtggttttgtttccatattgttgtggttcagaatttaaaagacggccaaaaattagcggcacatgatattgaagaactacggtcagttaaggtaatggtcgcgattagtctggtttatattgtctgcagtttgattattcctaaatacctgttggtggtcattggaatcggcattctttcgagggtcatgataacgcgaggcattcgattatatttaaattggcgaaattaaaactgattaagcttgattagcggacttgaggtcgtgtgacttatggtaagcggtgatccgtcgcgttcgcaaaagcaggccattgatgccatcatccaaataatgacgaagatttgcaacttcttgatgcagtgataggttgctcccatcttctaaaaaccgctttaactctaagagtagtgtccgacttaacagtccctgcagaaaatgacaatactcattatcgatgggaagctgctctttttggctgagatcgataaaaatgttaccaaccatttgttggatgtgaacggcaatcacgtgctctggagcgttttgaacatcaatttcaatcacttttcggtaaaatgcccggtttttttcaaaatacgtcatcattttaagcaaagtttgcggccaatatttgtaggtgttgcagtattttaccgcttcattaatttcggtggtgtaaatccagtctaggacgtcatatttatcacgaaaatagtcgtaaaatgtttgtcgacgtaatttagcttgcgtcatgatggtcgtcacggaaatcttgttgaatggttgaaagacaaccaattgtttagtagcgtttgcgattctcaattttgtggttgcggtcaatacgatccccccttaagtagttggtagacgattaatagaactattcccagtataacgctaatgagttcgaccaaaatatcgtggcggacaactgattgattttgtccgttacatgtgaggaggatagttcctataattaggtttagataaatgaaagggagatcttatttatggcaaatgtcttaattctgggtgctaatggaaaaattgcgcatctggcagagaaacaattattagctgaaaccaaccatcacttaactttgtttttacgaaatgcgagtcgattgacagttagtgatccaagtcgggaaacggtggttgaaggggatgccaccgatcaaccgactctggtgagcgcgctaaagggcatcgatattgtgtacgctaatcttggtaacaaggagatcgaaaatcaggccaagacggttgttgccgccttagatcaggccggcattaagcggttaatctggatttcgtcgttgggtgtctacgatgaagttccgggagcctttggtaaatggaaccacaaaatgttggatggcggctatcttgaaacctacgctgcggcagctaaggtaattgaaagctctgatttggattacacaattatccggccagcttggttatccaacaaggatatcgtcagctacgaaaccacgcaaaagggtgaaccatttaaaggcacggaggtttcccggaagagtattgctgactttattgttaagctgattaatgatcctagtcaggagattcggcattcagttggcgttaaccaaccaaatacggatggcgccaaaccatcgttttattaaacagagtggaccagcaagcgtttaggccccagaatataagccccctaaccttgatattcccgattttggaatattaaggttagggggcttatatggccggggcctgcttgctggtccacgttttagccaagtaagaagttcaacaagatattccgaattttggaatattaagtcagggggcttatatggccggggcctgcttgctggcccacgtttcggctaaataaaaagttcagcaagatattcctgattttagaatattaaagttagggggcttatatggccggggtctgcttgctggtccacgttttagccaagtaagaagttcaacaagatattcccgattttggaatattaaggttagggggcttatatggccggggcctgcttgctggtccacgtttcaactaaataaaaagttcaacgagatatttcgggttcgaatagttggataattcggtgacactgcggaaagttgccttttatcccgcgttttcactcggaataatcatgtttacactaatggagactgagcaaaacaattattgtcccagtctcaaattgggtctaaaaatagcttccagctttataaggggaggctatttttagactcattttttatatgtgtgaaaaatagtggtgaaaagtttgcgaatttctaaagaaaaatgcacttttggggttgaagtttccgatttaagcttgagttaagccaatcaagttaatctatagacacttaataaaaaggagatgagaaaggggccatcgataataaatcgactacaaaataaatgatcaactaaaaatcgcaacttaagtaactttaatatggtaagcaattgtggttaagtgccgtcagtgaacggccaccacgttaaatttatttcatgatactctcctccaagaatatcttcgacaaagaatgtttcaagattgcttgctgatggaaaagaaaggaagcttgattcaatgataacaaaacgagttctttatacgtcaggtttaacggcaacgattctcgcggtatttgtcgccaggcatttcgcccatcgatcacatctgattgttgcccagtagattcattaacttgatggcctatttaagctttaattaagcgttgcctgatagaatgtagccaattgataagaaacagccgaccaagataacgtcgggctgaacagggttagtcagcaactctcagaacgcaacgtcaatatgaaaggaagaagccggttatgacaatgaaaaccaagttaaaaccttactttaaatacgataaaaaaatagctgccaagcatattcggatcgcggtgtggagctgctactaaaaatgatttgagttaatccagtcagtgagctgaaactctgattctaatttgaaagaagggatgccatgggaaataatcacgacagataacgaatcaaacaataaaataactcactctttaaataaaacccaacgatttcttaactaacttcatgaatacccctcaatatttatgaacccctcaataaaaattccctcaaaaaacagtcatgtgtgatgagcatggctgtttttgattgggcaaaatagttgatgttatgtgaaaatacttaggcttcagtacgagatgagcctattaattgatttcgtaaaagaaacctctttgtctgacgggggttgaaaataccatgagtgtattggttttgccaaaccgctgtaatttattaattaggtcgtccaattcttcgggcacttggaaagctactttgagtaacattgaatagggaccggtcacaacgttacattctaatacgttggaaatgggtttaacaaactcgtagaaccgggacttcttatcagggctgacatctacctggacaaacgcccgaacgcttaaatctaatttgttaagatcaatatcagctcgatagccgcggataatgccctcgtcttttaaattagcgagccgttgcgaaattgctggaccacttaaagataatgcctgaccgattcgtttgacggagagccggccgtcagtttggatcaggtttaaaattttttcatcgtttttatccaccatgggaattcctcttttctaaaattaataagcaaattgcttacatatttttaaaaataagtatatatcaagaaagctattaagttaagtgctaattctttgaggatgattttatcaaaaacagtcataaagcgtaactcatcattttaataatttgaatcctgataaaaagatttccaccttaagtttggtttaaggtaagcggggtattctatagacaatcaaatatcaaagaactcgatgaagagtcaacgcaccgccaacaaaccgataactgctccaagtcgatttcatgatattagaagggaaggatgtcgagagtgattaagattgtcccttgttttgaatatcagattatgaaagctgatcggcattacccgaatcaactttgatagtgaattctaaaacaatcgtaatgagttaattcggattgtttatgttccgaaactccctacaagctttgaaagaagtgatgccgtgagaatacaattgagagatgaacactaacgatactcacaatcctaatgattattacaatactaataatcttaatgatcaaaccctcaaatgatcactaagaaaacccaacgatttcttaacttaactttgtaaaattaaccctcaataattttatgaatcctcaataaaagaattttccctgtgaacagccacgtgtgatgagcgtggctgtttttatattggtggagagggctggtggagaattacatcgcgttaattcggattcggtgaaatcctgattcatatttgttggcgaaaatgtcaggaagtacaagagataagtttaaggggactgtcaaccggaaaaagattggtcggattatttcagaaaatatcatttcgggttcaaaagtcattgacccttaagcttgatttaagctcaatcagttattctataaacaatcaatcagcaagggagatgaattaatcgtcggactactgaagcatgaaccattttaaataacaatcaaacaggtgccaagacaagatatgaaaggaaggttcgtaaatgacagtccaatcaaaaattaagccgcaccatctaatatcgttgaatttcttaccccttaatcgcattaatggctcaaagccaatgataaaaacaaacgttaacctaaattgaaagctggaactctaagaccattgaaagaagtgatggcataaaccgtttaagaactgaggattagtgatccttacaaccccaataacaagcataatccggatttgatgattaacccctcaaacaatcattaaacctccaacgatttcttaactaacttcacaaaatacccctcaatattttatgaaacccctcaataaaaagaattttccctgaaaacagtcatgtgtgatgagcatggctgttttttattattaattcaggaaagagaacgttggagaagaatcatccaagtcaagtttttctgagttgaattggtcgtcaaaatataaattgtgtacaatctatatcatgagaactaattttagagtacgataaagttgattaacaatttcgataaaggcgatgatgggatgaaaagcacgatgaaatgggtaacacggtggcctgaacgaattagttacggtttgagtgatgccgccgataatttggtctttcaaatgatgacgacctatttgctattcttttacacggatgtttatggactgacaccaagcgcggtggcgattttatttgtcatggcgcgggtagctgacgttgttgaaagttttgtcatcgggatcatgattgatcacacgcattcacggtttggcaagagccgaccgttcttcctctggtattcgttaccttacgttatttttgcggttctcacctttgtgacgcctaacttttcgtatcatggtaaattaatctgggcatatgtgacatatttaggccttggatttctgtatacggcagttaatctgccaatcacgtcaatcttaccaacgatgtcgcagaatactcgtgagttgacgttgttgggtgtcattcgccaattctttggcagttcgattcaaattgtggtggcggtattcacattacccctggttgcgttcttcggccacggtaatcagcaaaaagggttcttgggcacaatcatcgtgtttggcctgatttcatttcttttgattatcaacacgtttgtccacgttcgcgaacggttcgcgaatcctgaaattgcccatcaaccgttatcaactgtcctaaaaatgttgaaacataatcagccatggatcgtcatgtcgatcgtgattctcatgtactggctggtgacggcgattaaaaaccagacaaccatttactattttaaatatacggtgggaaatgaaaacctggtgccactagctaatagctttaccctggcaaccctaattggcgtgttgctgatcattcggattaccgaggttcgcagtaagaagcaaacgatgcttcacggtattttaatggcgctggttggtcaagccgtgattgcggttggggtttataccaaattactgtggctcctgtttggcggtgtcttgattaactcagttggtaatggcattatcatcggcctcgtctcgatcatgattgctgatacaatccgttatggtgccagcatggggatccaagccgagggaattctggcttcaacggatgactttggcgttaacgttggccttggcattggcggcttgattacagctggtttgtttcacttttcgggttacgttgccaatcgaacccagaacgccgcgacccttaccatgattgatttgaattatgtttggattccactggttatttatgtggggatgtattttgtactgcggctttatgatgagggtaggattgaacgagcaattgctagccaaagttaatcttgatgcacaaggatggaattaaataaagggataggtaaattaggagtagtgtgcgtagattaatagatacgaaaagtgggcctctttttgttggaaagtaagtatatgtttgattgtttatgataaaattaagctaacttacgctgtaatggagcgacattgaggggtattaatattatgacagttgagactcatgagttagcttttgaaaatgagctgattcattttctagcaaggattggtggtaccaagcaatgggagtatctaccaaatatcaagacaacagaacaattatgggctaattttaggcatatcttggagatcaataacccagataaattagataaaccactttcaaaaactgaatttgctcaggtaaagagagaaattaataaattagagacaccttatcaggccggtcaatttttatatggtctaaacggcaagtctgaaattgaattagatttagatgatggccggcatgtttatttaacggtttttgatcaggatcaaattggtgcaggaaatacagtgtaccaagttgttaaccaaattgaacgggatccggttttggctgggagaaagagtcgacgatttgatacgacactgctaatcaatggcttacccattattcaaattgaagaaaaagctgatggtaaagatgccaagcaagcattgaatcaaatgaaacaatacatatccgaacagcaatatacggggatctttgcaacactacaaattttagttgggattacacctcatgatattcgctatatgtcgaatacgaccgaaaagcaatttaataccgattttgcttttcagtggcagcgagaaaaggataatgtaccggtacatgattggcaggaatttacaaatgcggttttatcaattccaatggcacatcaaatggcgactaactacataatcttggatgggacaccacataagcagatgattaaggtaatgcgaccttatcaagtgtacgcaaccagaagaatcatggataaattgcggattcatcagtttggtttagacaaaaaggagatcggttatgtgtggcacacaaccggatcgggtaagactatcagttccttcaaagcagcttggttggcttcacgactcccaaacgttgacaaagtcgtttttctggttgatcgaattgcacttactaatcaaacctatgatgaatatagcgcttatgacccaagcaccaatgttggaagcgaaaagggcggcattgtagaagataccgccaataaacaggctttgttggccaaactgagaaaaaagggtaatggcattattgtgacatcaattcaaaaaatggatggattggttcaaaaacaccagggcccttataaagcatttgaacgacgcgttgttttcattgtagatgaagcgcatcgttcaacatccggtgatatgttgcaacggattaaaaaagcatttaaaaagtctgcatggattggatatacaggaactcccaggtttgatgagaatgagggcccaacaacccgtcaaatatttggaaacttaattcatgcttatacgattcgtgatgctattgcggataaaaacgttttaggatttaaagtcgattttgaaacaactttggcggaagaaacgctcaaaaaacaatatttaccacgctattttaaatttcgataccctaactggacttctgaacaaattcaacaccgaattgataacatcacacctgaggatatggatgatgcgattgttccgagtgtttatgatatgaatgagaagcatgtgcaactggtggttagagacgtcttatctaagtggtctaggcggtcttcaagttatcggtataatgcgctatttacaactcatgttggtggtggcaaagcttcaacgccgatggcaatgatgtattatcgtgaatttcttaagcaaaataagaagcaggaaaagcctttaaaaattgcggtaacgtttagtcaatctacgaataatggtgatagccaactgcagaccaacaaaaatctgagagaagcagttgataattacaatcaaatgtttggaacaaagtttgatgatacggaaattggcgagtatacgcaggatgtcgttgaccgtttaagtcgaacagtagatgatggtaagtacttagacttggtaattgtaattaatcaattattaacgggatttaatgcgcctgaactcaatacgttgtatgttgatcggactttgcaaggggcgagccttattcaagcttattcgagaaccaatcgggttgttgatatgcaaaacaagccgtggggtcgaattgtaaattaccgctggccgaagcaaactgaaaaattaatgaaggaggcattggctgtatatgctaatccagattcagcgaatgtgcaaacagaattaaatatgccaaatgatggtactatcttggcaaaagattttgatgatttaaaggatgatctttcaaagacagtttcaactatcagcgatttaacaaataaatttgattccgttccaaaaagtgaaaactcccaagatgaattgtatagtcaattgcagacgtataaccggacaatggctaagttaaagcaggatgataactatgatgagaagcatcctgaaaagttgttaaaagcagttggtatgactcctgatcatgaagtattgttaacgactacttttgcaaatgaactgaaagaaaaaattgcgaagaaacagcatttaaacgttagtgatttggatcttcggatggagcacgttaaggatattaaaattaattatgactatttggaagaattaattgccgaacttgctaaccaagttcatgaaaaccagatggaaaaagcagccaagacgagagaagctgctgaccagattgcagataagattccagatgagcgatatcgtcaacaagtgaaacattttagtcgagatttatatgaaggaaaaactgacgtcgcaaactatccggttcaaacagaagatgttaaacaattaattcttgatcatgctgataatcgtaaacgaatgcagatcttggtatttaaaaaacgttggggattagtggacattccatcgaccaagcaaattaatagtttgttgttacaccatacaattggtgctgatgatttaaaccagatgggtgagttaaataacattatccatgaggcacaggggtattacgtaactgatgcagaggatccgaaaatcagggcattgcacaagcttaagtatcggaatcatttacggcaagcttttaccgagtttgccgatcaattaaaacaaaatttttaaggagcgtatcataaatggctgaatcgcagaatagtgcaagaagtatcactaatcaactttgggcaatggctaatgaattgcgggggaacatggatgccagtgagtttcgaaattacattctgggatttttgttctaccgttacctttccgaaaatcaggaaacatacctaaagacacaggatttactagaccttaaaggtgatgaatcagttaatgaggcctatttaagagaagcaaccggtgatgatctaaatgattatcttcaagacattgcggaatctttagggtatgcaatgccacctgaaagtacgtgggcaactattgtcagtaaagtggagcaggatgaaattcgaacttctgattttcaggatatgtttgataattttgaaaaaaatgcgttactaaatcctaattcaatggctgattttcggggaatctttgctgatatcaatttgggtaacagccggctgggaaactcaacagccgctcgtggaaaagctttgagtaacattgtaacaatggttaacacgtttgattacaacgataaaaatggtcatgatattttgggggatgtctacgagtatttaattgcccaatttgccggcaattctggaaaaaaagccggagaattctatacgccacatgaggtctcacaagttttggcaaagttggtaactctaaacttgcaagaagagggtgaccagttcacagtatttgatcctgcaatgggatcaggttctttattattgacagttggctctgaagtgccggggggatacaaatcaggtcgtgtccattttcatggtcaggaattgaacacgacgacttataacttggctaggatgaacttaatgatgcatggtgtttcttatcaaaatatgacgttaaggaatgcagattctttggaaatggattggcccgatggggttgatgcacagggaattgatcacccacgaagtttcgacgcagtagtcgaaaacccgccttattccgcgcactgggataaccaagacagtaagatgaaggacgttcggttcaaagagtatgcgttggcgcctaaatcaaaagctgattttgctttcttattggacggtctttatcatcttaataatagtggaaccatggcgattgttttgcctcatggagttctctttcggggtgccaaagaaggaaaaatcaggcaggcactgctcgacaagcgtcaaatagatgcgatcatcgggatgccagctgggttgttctattcaaccagtattccaaccattatcatggtcttgaaaaagcaacgtcaaaatgacgatgttttctttattgatgccagtcggaattttgaaaagggcaagaaccaaaataaattacgtgctgaagatatcgataaaatcatttcaacatataaaaagcgacaggatattgataagtacgcgcatgttgccaacatggatgaaattaaagagaatgagtacaatctcaatattccgcgctatgtcgatacttttgagccagagccaccagttgatgttgataaattggtgcatgatattcagagcacggacgaacaaattggcaagttagaatctgaattttcgggaatgctgaatgatctagatggcaagaaccctgacgctcaacagcagcttacgaagatcaaggagttgtttaagaatgaatgatgaaaaacaaccgaaaatcagatttaagggatttgaggatccttgggaacagcgtaagttcctgagtatgacaaaaacatactcaggattgacatactccccagacgatatttcggatgatgggacactcgtgttgcgatcttcaaacgtacagaatggatctatcgtacatgcagatgatgtgtatgttaataataaggtagctaattcaaagaatgttgaaattagagacgtaattgttgtagttcgaaatggaagcagaaatctaatagggaaacacgccttaataaataagaaaatgaaaaacacagttattggagctttcatgactgggttaagaggccaaaatgggaaatttataaatgtacttctggacactaatgaatttaaacgagaaatccaaaaaagcttgggagctaccataaatcaaattacaggtaaggattttaaaatgatgagatttgatgttcctaaaaatactgaggaagaaaaaattggagaagtttttgataggatcaataaagttatcgctgccaatcagtgtcagcaaaaaagacgcaatttgctgaattcacgcgtcttttttaaaatgctatataaggctagctagatgtttcatcactttatcgttatcctgattctccaattcctgtataatatgcaaatacgtctgctgagtcgtattcatgttcgaatgtcccaaacggcgggccacagaagcaatgcttacacccgcatacaacaaaagtgatgcgtgggtgtgccgaagcccatgcactgagataacaggaatacatgcccgcttgcacaatcgctccaaataatggttaaccgtatcattgtatatcttcgactgtataaaaaatggtttgtcatcagcaagcccttttgtaagttgagaaaactgaattaccgtttgccagtccaattggatctttctcattgacgataaatttttagttggcgcaaaaccagcctcttgtgatttataatcccaggtcttattgatgtttaaagtttgccttgcaaaatcaaagtctacaggagtcaatgccagcgcttcggaaaatcgtaacccggttttggtgattaacaaaataaaatagtcccagttaacgccctcatccaaggatagatgatcaagtagcagttgaacttcgtgttgatttaaaaattttgtcttgtgcttaccaggttttttgcctttaataattgcttttcgagttggatcacgttcaatgatgccttcttccaacgcgtcgattagcgaacttttaatgtgtcggtggaaatccattactgtttgccgttcatgagtttccgcataatcatttaggagcttttgatacgttaatctcgataaatcacccatctttaaatctggagctaataatattatctgtcgatgggtcatttcatacttacgataggttacttctctaacagcatctttcttgtacaggttcatccagtcgtcaaaatatcggtgcaacttaacctcgctcatcaggtgatacctcccgtaaaaaattaaagaggcccctccattgctggaagctcccctctgattttattaaacaggcaaaacaccttaaaaagcgaatttgatgcctagcaatttcaaagattacttttagtggcccaagacttcttgataagactcaaaatatactctaggttcgaatcatctttgataataaactcatagtcgccattgccccagtgacctgtatggctaacatcacgcgacaaccctaaagagtcatttagttgtcctttagaaagattaatccacaatttcaattgtttcttttgtacttgaatatccacaaaattatgcttctgaagccgaaatccgatataaagctttgtaggctttacttcaattgaactatcccaagataaaacagtatctttaatctcttgatataagtcctgaatgtcttgagtcccattactcagctcatcttcttcagtatagagtgcaatcgaagaaacatcttgaacatcctttgactttttctgtttaactactgcacgcgaatgagccgtttgagctaaatggctcttttcaattttatttaccgttatatactcattgacaaatttcacaatttcgtacaactcaattggcagaacaggattattaaccgcatccttttgatactgggtaaattctttggcaacaaagatgatctttgtctgcgaccaatcaaaatgttcttcagattcattcactttgtggacatgattatagagcaagataaagtccgctttatgattcaagagtgtattcaaatacgaatatccttggtcaataacactggatttgatcatattcttgtattccagaattacaaaagcctttaattcctcatcaaaggcgacggtatccaatcgataatttcccactgtgaactcggatgcaagaaacgtgtcgccaaaaagctgatcaacattggcttcaacgatattctgcatctcacgttcaagtttaaatccaattggtttgatgatttgtaactgtttactgggtgttactttgtaaagttccaatttttaccaactctttcaagaacaattatgcataattataaatcacctacaggtagaaatcatttttgctcgaaaacaagccaaaattcgagcttgcactgattggcagcgaaagtatccactctgcaaaactaaattacacgaacatattttgcattaaatattttttgagcgctttgagctgatcaaggcgtcgttgattggcagcgataagatcatcgaaaattttaaacaattgcccaatggttttttgttctgaaattaatggaatttcaataatcatttttttgaaatctggcaaattaactgattgaactgttgtgccagattttacaattgatctaagaataaatggttccaaatactgtaattgtgaaaacataaaatctagaactattttcttttcatcgaaaattaaggctttaatatcttggttaattgcaacatactctgtggaaatgctaataggaaatcttcgagctaatataccgcttcgaacaacgatgagcagtctgcctgggctaatcagtctagctgaactgttatccagaccttctttcgttatatagtatgtagaactaccaatatatttactcttaatttcctgagaagataaccaagaaatatcaccattccagtacttaaaattatttttggcgggtgttccacctccgaccaagactataacttcaccaaacttacgctgttcccaaggatcagtgaagcccttgaaccgccattgttgactaaagatcttttccatcaacagttttttaagttccttaaattgatccaacttactctgattggcagcgataaggttatcaatattatccaaaagctcagtaactgcaatttgttccttatatgaaggcttcaaaacaactaatttttttataatgcttcctgataaatttccctgtcctccctgaagatatttaccgactatcttatctttttgtaaatccaaccaatgtgataagaagccattgctactactggagttggctctaatacaaagtatagcttggtttatggctccatctattctagatattccaactgcaccacttgtagcgccataaagtgcataaagtatatctcctcttttaaccaatttggcagaggaattatgaatgccctcttttgaaagaaacagctctgtcactgctttatgaatttctgctgatctaataaatggaatgtttccattataaaattccttattgtttacattaggtgttcctccagaataagaggttgtaaattcacccaacttacgctgttcccaagcacaagaaattatgggcactgagggggtagtctttgcccaaattaacaatattttcaattttattaagaatataaatctttggtatattttgagcgttaatccacctcaaaatgatgatgactactagaatggttctataatcaattaagctaatctattgggcttaatattcgaggtggatgaatgatgacaaaacgaaacaaaaagttaataaccctcggcgcgattattggtgcggtagttgtgatactggtggccggcagtctttttcggtcagctcatcattctcaccggataagccagcagcaatcaaccctggcagtgagtcactcgacaacaccggttctatttgttcatggttggggagctggtttacgttcccaaatgccattagccagaaaggcaattagaaaagggtttgcgcaaaaggggctcgtcgtctttgtcgggccatccggccaaattcagatgtatggccatttacctgctcatccacgaaagtcgcctgaaattttggttaagtttccgaatgcctacatcggtgaatttaaagaagcagctgctctgcataagattttgatattattgaaacgaaattatcacgttacccaatataatgcgatcggacattcgatgggtgcgtatgcactaacgcttcaaagtgaacgggatggcaactcacgtttgattcctcgacttaacaagctggtattaatcgctggcccattcgatggtatcttgaaccggcacaaatgggatcaacctatcagtggtgccttgagtcggctatgggatgatcatccgggacaaaatcggctgcttgccaatggtcagcctaagattaaacatcccgaatatcggttactaatgaaaaatcgccgaaactttcctcagcaggctaaaattctcaacatttttggcagagtcaataatggatcggattctgacgggacagtgagcgtcccatctgcattgtcactgggttcgatcttgaaaaatcaggttgccagctatcaggttcgtggcttctcaggacgtcttgcaaaacatccctatcttgaaactaaaaatacgcgtgttcaggaagcaatcatgaaatttctttgggaataatgccgaagaagaatcatagttgccaaaacatatggatccaactcaccgagtgaacataaacatggtaaaatctctgactccatgttttgattccaaattagatgtgaagtctgacctttatcgcttaaccaaaaacacgctatcacagtgatagcgtgtttttgtagccagttacatggtaaaatattttattgtcgagttagttgggcggaaacattcttccaaagaagggagcgatgcgtatgaaacgtgtcaatcaaattctgggaagggtgttaatctttgctgtcttgggcagttcttctggttggcggagctgcattaatcagggcgattgccaagtacaaccagttaatcgcggagttaatccgtgcattggcagagttaatgcaggcaataaaaaagaaccgtcattaactttggcgagttccacggttctttcttagacctgtaggagcgttgccgctctactaaactactatcatttgtggctgcattatagcacaagtgatagtagttttttgtttataccttcgcggtgtatctctggttatttcatcgtatacccgccatcagcgacaatctcctgtccagtaataaaactcgcatcatctgaagccaaaaaattaaccacattggcaatttcttccggtttaccgagacgcttcattgggacattctgcgcaattcttgctttattttctggcggaatattttccagaattggtgtttcaaccattcccggatgaacagaatttacccggatatgatcatcgaccaaatcaagtgccgcatccttggtcatgccacggattgcaaacttactggcaccgtaagcaatggtattcgggatagcgactaagccgccaattgaggagatgttgacgatcgatcccttgccagcgcgtttcatcgatgccacgatactctttatgccgtaaaaaactgaatactgattaacatgaatgactttatcgtaatctgctggtgtcatgtcggtaatcggtttcataatatcaatgccggcattattaaccaagacgttaaacggcccaaaagttgcttctcctatctcaatgacatgttgccaatcatcaattgacgtcacatcgtgtttaagaaacaggctatggttacccaattcagcttgcagtttttgaccggcagtgacattaacgtcagtaaaaacgacattggccccattttgaatgaaattcttggtaaaagccttacccatgccaccagtggcaccggtaattagtgcggttacatttgataaatcagccatgaagactcatcctttctttagtggactaaaacaagatctaattaatcattatcataaggggggcatttagtaagagtgcccaacatttttataaccttttgtctttagcttacacattcggcttgtgattaccacaatttgattgtggcaggacttggaattttgaccgaataataaaatagcagtgagatgaaagacggttaatctttgagtgtcatcagattattcgaatatgttgcgagcaaatagttggaacagtgctaccaacagaaacaggtgaattttattttgtccgggtagcttaacggctggagtgaagccaattggacatgctatactagatataattattaataacgagaccatttttatcgtcactgaaaatggatatctgtggtcatgactatcaatggttcgcatttttcaaaagtagtatttaactagaatttcaatagttatcaagaaggggattatcacacatgaagattcagaccattttgacatctcagtggattgattggggcaaacaacgctctgccgaagatccacgtttggaagggtttgtcgctggcgagggtggcctaaatccaaaaattcttttattgggcgaggcgcctggcgataaagagattaagctgggtcatccgtttatgggacctgccggaaaagagcttgaccgttggctggcatcactgggattgactcgcgaggatatttacatcacaggagttgtcagcgcacgaccattttcaattggtaaaacggggcgtaaaagtgatcggcgtcccaacaacactgaggtgaagacttgggcgccaatgtttgattacgaattggctcagtttccgggacgtttgctggtaccaatgggaaatgccagcctgcagcgattgttaggcaataaagccaagattggtgagttgcacggtcagttgttggaacgtccaattcaacagtttgataaagcaacgaatacgtttaaattaactcaagcggcgcggcaaatcttcccactgtatcacccgtcttattcaaaacgattcaaaaatatgaaagcagtggtggatgctgattcgaaaagactagagaaattacttcatgatcagtcggttttaaagtagaatgaacttaacgaagcataagttatgttgggatccggttgattgagaggagctgtcacgatggctaatgtaaagtttgaagataaccaaatgattgtcggtatcagcggcttggataaggtttggggttttaagggagattttaaaattccgattgatcatgtgtctgatctcacggtggaaagccgtgaccaaatgcagaaggatggtaaatggggattggtaaatttacgggcgccaggattgggcttgcctaccaagaaagtggggaccttttacggctcattttatggtgaggccagtcagatgaaccaatcaaagaagtctaaaaaatcataccttgacgtttccagtaaggataatattttatttgtcactttaaataacgaaaaatacgactatttatttttaactgtggctaatccggctgaattgatgagccaatttcagcggttgaaggggaatcaataataaaaacacaccctaagctcagaataatggaatctcttttttgaacaattttaacaataaatcttagaagccccgtcagaccaagcaattatgctgattggtctggcggggcttttatgagttgataaaaacagaattctgtcaattgtccttaataaccgtcatattaacaaccatcctccgaaccttattttccgcatgatccgcgttaattcgccgaataattgtgttcgcagtggtggtgtgggtttgcacctcaccgaatgagtggacgaccaaactgtggtaaacaatttgattctgatgcttaatctcaaaccagttgggttcaagttgcttttcggtttctttaatatctttgttgggccaaaccaagtaatggttccctttggaggttcgatgaatttcaacctgccagccaagactgaagtcggacacttcctgccagcgttgaatattgacgtgttttatcgcaaaataaatgacgctgccgaatgccaacttagggtgatggttaaattctgtcatcgtcagtggcttggactttttatgggaactggttttagccgtgggatgcgaatgatgtgattgtgttgagcggtgctgtgtcatgctgaaagcgagccccaggatgcagagaatgaggattcccagcatgccgcctttaattacttttttcattatttgaatccaatcttgaaacaattttcagtcgaaatagtcttagctcgagaacataagcccatcttattggaaataacgggaatcttcaaataaaaccataccataaaataaaaaatcagttcaaactgaattctttgaactgacattgagatgaaaattcatctcggttaattttcaaatccgaatgaaattgcttctctattaataactaagggccatccgatccttcattgaccagctgctgacgaagtctcccttatcgagagcagccttttcatttgtccagcaatcattgtagtaaacgctgctgtcatcgacgccggtaacgaccaatgcatgggtgtgaaagccgtcgaactggccgacccagacgacgattggatggccggttttgctcaagtgatcagccaagtcgtcgattaatttgccgcttaggttaatggcattgccagcatactttttaaccaacttcattaaagcgggtggatagatactgttgccgtcctccgtgaaaggattgccaacaaaccccttgttgcaatcgtcatcgtcatacggcatttctttggctaaatcgactttattaacatcggcaccggcatatcgaagcatcatggtaaccgaggtaatttcacagccggttggtaattctggtcgttgtggaatcagtggaacctgtaatttagttgattgcatatctctctttctcccctagaaaaatctattttctttaatcatattctgaaattggattcggcgcaatcgtcacatcttgatggcagtgtgacgatagacggttgtcggagttctcagtgatgttgatggtgaaattgttagaaaactgggatttgtttggttccaaaaaaagagaaatccaccaacgcactcatcaagcacattggtggatcaaaaggttatctaatgaatggtaacggacggattatctaacatccagcggttgcttgctggttggttttggaaaggccacgtccagctggtccaactcatcttgggacaggtcgatgctggcggctttgatattatcgactgcgtgcttaggatcaccggattgggggatggctaaggtgttgccgtcgcgaatgtcccacgccagtatgatttgccatggggtggcgttatgagcaacagcaatttgtttaaccgtcttgttggtcatcatgttaccgcgctcatcaccggcaccgactggcgtataggcaataaatgggatttgttgttgacgctgccatggcaataagctgtattcgacgccgcggctgcttagattatagaggtcttcgttggctgcaacttgatcgccacccggcagggcaagtaattcctgcatatctggtaaatcaaaattggagacgccccaatgtttgattttaccggcttgttgaaacttctggagtgtttcgacagtttcacttaatggaactgctccacgccaatggtataagtacaggtcaacataatcggttcccaataactttaagctggtttccagactgtggcccatgtgtttagctgaagcgttggacggcaaaaccttatcgattatgaataggtcgtcacgattaaggtcgcggattgcttcgccaaccaacgcctcgctgcggccattaccatacatttcagcggtatcgataacgcgggcaccggcggcaacgcctgcctgcaaagccttgatttcttgagcccaggttgattggtcgtcacccatatgccaggttcctaatccaatagcaggtacttgacggtcgcctagaagtaattttttcaaatgacttgcctcctatgattttgatgattcatgttcaacaatttgaaaattccgaggaacaaggatggttggcttccagagcattaacggattatccggggaacttgactttaactattcggataatgatccatgcagttggtcgccgtcggttattccacgtctttatttggtgataattatgattgcgaaacgaggttggggaaatggctgctacctcaatctgggttccttggcagatcacacttactaatttcattttaacgctagtaatgaaaatgatgaaacaactattttcgaattttcaaccaattgaaaatttcttgagcggctgacaatggtaaatatctgagttcaacttcttcattgctgttgccgtggcggacatttacccgaacatgtgccaagttggtgcgagtcatccagattgattgatgaatgccaaatgattggacgttttttcttgggataacgaattgtgagcgggtgaaccaatgaccgttttgcataatcaattggtcaccgctgattttccaaccggtgttgctggcagaataccagccttgaaaaaaggcaatgataaagattggcaggcttagcaatccccaagctttaaaaaagtaaagacaaatcgctactggaacaaggccaaataacagggcgttacgaataaagtaccagaagtcgcgttttggcagggttgttaattgtgagaaatcggcgggtgcccagctgataaacggcgcgagacttgagaaggccttagccgttttaatcaccggaatgatcatcagatcgttactcttttccttatcgccggctgatgatgccgatagtgcctggatcgtggaaagcttgcaccattggcggatgatattttgcttgatccgaatagcctgaattcggttaacgggaatcgttacagaattgcgttgaaaaaggccctgataagtcttcagctgcccagattcatttgtcagggtaaatttatagtagcgttgaacgattgttaaaaaggtgccgataatactgatgataataattaataaggcgatgattacaatcattaggattgattgctgaacgatttcactggtaatcgagttaataattcgctgcggaatcacgtcctgaattttgccgtaaattgccagcaggactcccattaatggaaagattcccagcgaggtcaaggcaaatacattcaagtcatggggattaattaaataggttgggattggtttcgaatttgcctgggttgatttgatggttgattcaagatcagaattgggatttgcgtgatgactcacccggcgttgttcaatcgcttcccgaacgcgttccggtacaattggcaggacggcttcgggactgtgatcatcatgaccggcagtttcgatttgcaatttttccaaatgaaacggttttaagaaaaaccattgactgcgttgaattgtttggattcgaccataggggatatgcgtatgctttttaataaagatcccggagttaatcgtcagcatgtcatccgcgatttcaaatgtgaagcacagataacggacgaagacgatcgcgataattagcaggataatgccgccaaacccaagcaatggactaatgtggtgacgaaccagaaaacgcatggccggtccaaataccaaggcaatcaaaatgacccagtctaatagatgacgaaatagaaaataaatcatagacagggggttaagatgctgtttcggattagacgtcatgatcattcacctccaccgccatttgcataatttgtttgcggaggtgttcgccaacttccggttcaaggccatcgatggtgtgtgacgttgaggcagtcgttacccgaaccttttgaagcttttgtgattgaagcaccggcccagcttccagagtgacatcttggactcgggcaattggaattgagactaggtgacggaaaatatacccggatcgcagctcaacggcatcatcggttaaggtgtaccgccaaaatgcgtaacgataaggaaccagaatgagttcaataatgaaataaataattgcaatcccaattaagacgagtgatggataactgagccattgccagttattggttgtggcaaggaagtaacagccgatgccgacaattgctaaaattagaaacgtgaataatgcagatagacgccaaacagttttgatttggggtggtaattggttggattcggtcaatttaatgaacctccttaattttttgaagtgtacctaattttggtataagtttcaacagtgtcatcaattaaaaaagggcgcattatcctagacattatcccgattatagcgttatacttctttttatgcgcgttgatcgattaatgatcgtttaggaagggggaagttcaattgtctgctaaagttagaaattcgataattgtgcttatttttggaaactttctggtatgtgtcgggatgagtttgatttttccggtaatgccattcataaaaaatgaactgcacttatccgcaacggatatgggaatcatgaactcgttgtttgctttcgcgcaactgattgcttccccgattgttgggcagttatctgatcgaattggccgcaaaccgattctggtatatggtctgctattatatatgttctcagagattttatttgcggcaacgaattggttatggatgtttgatatttcacggacaatcggtggtctgtcggcggcaatggttgtgccaacgactaacgcactggcagctgatttaacgacgccgaggcagcgagccagagtcattggtctattgtcggctgcctttagtggtggtctaattttaggaccgggaatcggcggcctgcttgccaagtttgattataaaacaccattttggttcgcagcgggattaggctttctaagtatgctgtcacttcaattcatgctgccaagtgaaaaagaaattgagggctatgccaaagaaaatgttgtcccgccaacgcctcatttgcgacaaaaatcctcttggacacaaaccaagaaattattcagtgggccaatgggtttgctgtttttgctgattttaatttcatcatttggcctggtaggctttgaaagtatctatagtttatatgttaacgaagtctttaaatttaccatggaaaatattgcgttggtactaacgttaaacggcatcatttcactcatgtttcaagccttgttatttgaccggctggtcgtctggctgaccgaaaaacgattggttcgctattgtttcttcctatcatttgcgggcactatttggattattctggctcattcaaaattagaagtaatcattgcgaccttaattgtgtttacagcctacgatttgattcggccggcaattaccacgctgctgaccaaggccagttcaactgctcaaggattgattaacggcgtcaatatgtcattgactagtgttggtaatatcattggaccgatcatgtctggggctctcttggatatgaactatcattttccatatttagtggttgccgttttcttacttatttcatggttgttgacctataaaattcaggaaaagtttaaagctaatgtataatgtcgatcgtttttgatggtaatgaaccattggcagtttaaactcagttatcatgctgcaatctaaaaagtccgtaaaaccattctcacaatcggtgagctggttttacggacttcttgtttaactaggtcattgtttatttaacattcttcatttcttgatatttgggttcccagtgcaggtcatcgactgcctgttgcacattatcgattggatcctggttaagctgttcattaactgcagcttgggcagtggcaatcgcaacggttcttgaaaaggcatttaattttgagacgggtggtaaaacggcggcacccggtttagttgtgtcaacgatcccaccaagtgaatgagcagcggcactaatcattgaatcagtaagtagtctagatgttgcggcgatggtgccggcagccagtcctggataaaccagtgcattgttggcctgaccgatctcatatgaaacgcctttgtaagtcactggcttacttggaacgccggtggcaatcaatcccttaccatttgtccatttgattaagtcagcagcattggcctcaagtagtttggtgggattggagattggaaaaatgattggtcgcgcggtgtgttcagccatttcattaacaattgattctgtgaacgcccccttgaccgttgaagtaccgaccatgattgttgggtgaacggctttaacgactgcttcaaggttagtgagttcggcagcattcttaaattcagtccgttttcgtgcaaacggtttttgttccggggttaagccgggtgtatcttcgaacaagaggccctgtttgtcgacgaggtagaaatggcttttggcttcttgttctgaaagtccctggagaatcatttcatcgtaaattcgttgggtaattccggcaccggctgttccggcaccaaacgagagatagatttgatcggtaagcttttggcctgaaatctttaaggcacctaaaataccagccaacacgataatgccagtgccttgaatgtcatcattaaaagtggtgattctgtccttataccgatttaagattttggcagcgttgcttcgaccaaagtcttcccaatgtaaataaacttttgggaataaggcttcaactgttttaacaaattgttcaataaagtgatcgtatttttcaccacgaacgcgtttgtgacgattgccaacgtaaaatggatcgtcaagaagactttgacgattggtaccggtatcaagtacaattggcatcacttgattcgggttaatgccagccgccgcggtataaaccatcagttttccaaccgaaatatcgacgccttgaacgccccaatcaccgatcccaagaatgccttcagcatcgctgacaacaattaatcgaatgtcgcggccattagccccattaatcaaagcttcgcgcatatgttcaggatcgtcaattgatagaaataccgcattttgcggtcgtaagaagttatggctgtaattttcaattgtatccgcgatggttggatcgtaaacaattggcataaattcttcaatatgacgactgaacaggtagaagaaaaggattcgattattgttaaaaatttccattaaaaagaaccgtttttccaagtcagttgatttcttagcaaattgttcatacacttcagtagcctgttcgtcaatggttcggacaaccggtggaattaatccgttgagacctaactcatcacgttcctgttgggtaaaaccagtgcctttgtttaaaaatggatcgtttaaaatttgttctacgtgcatctcgattgcctctttcttgattgatatctttgttataatgccgataagagaatatagtcaaactaaacacttatgataaaaataatttatgacaagaagaggtgccctcatgcaactcaaagatttagaatactttgttcaagttgccaaattggcaaacctaacacaggcggcacagtattttagtgtttcccagccgacaattacttatgcgattaagcggctggaggattcgttggggactcagttattggctagggatccacaacaccggtctgttcgattgacggaaaccgggactcagtttttataccatgcccggcgaattttaagcgaaatgcagcgagcccggttggaaattaataatcgtcaaaaagaaaagttggtattgggattaccaccgatcatcggcaattacttttttccaaggtacattggtaatcttaaacgggaaaagttgattagccggttggaaacgcattcccttggttcagaggaaatgctgactaatttgctaaatggcaatttaaacttggcctttattgccacagcagcaccattgaaaaatcccgatcttgatttattgtgtcttgatgaaaaagcttttagaattatctgtggccaaaatgagttggatttctcgggatcagttaccttcaagcaagccgcaatcaaaccctttattgcatttgacgaaggctttattcacaataaagtttttgactatttagaaactcgttcgggtgtgacacctaatgtgatatataaaacgacggacgttgatattttaaaaaatatggttagccataatgccggtctagccttgttaacagaattagcaattacggagcaagatgatgttaaagtgttagcaattaatgaaaagcaagtgccaacgtttcagatttatttagcttatcggcatgatcatgttctatctgcggttgaaaaagcatttattgcgattattagggaccagagcgggataaagcgcgactgatcaaatcacaatatgttacgctaatagtgatccacaatttaaatgattggagatggcgttacttggacggattacaatcaacaattaaattgaataatggcgttgagatgccacgattcggtctcggcgtttggaaaagtaataatcacacggctcgtgattccgtggctgcggcattgcgagatggctatcatgccattgatactgccaaacagtatggtaatgagcggggaactggtgccggcattaaattaggcctgcagcaggctggcttgaagcggagtgatattttcgtgactaccaagctttacaatggtgatcagggaaactatgacaaggttgccaaggcttttgagggccaattaaaggacttgggattggactatgttgatctttatttaatgcattggccggtagacgcaacatatattgaaagttatcaggcgatggaacggctgcaaaagcagggtaagattcgggccattggcgtttcaaattttgataatgaccgattagccaaactattggaatctgcagagattgtgccagccgttaatcagatggaattcaacccaactaatcaggaaaagaaaattttacaatttgatcaaagtcataatgttcaaatgacagcttggtcaccacttggcggcggcagatcattaactaatccaatgattgataaactagccaagaagtatgatcgttcggcagctcagattattttacgttgggagtggcaacgtggcattgtcacggtcattaaatcagcccacgaaaaacggattattgataatagccatatttttgactttaaactgagcgatgaagacgtccaaaccatcaaccagcttgatcagggcgaacgtgggttgtggtataacgactttaaatggcataatccaaatggtgaattcggtaattcagttgcgcaatgggatgataccaacgaacaactatgatggtcatttaataattaaatagatagctaaacggctggggtaaatttgattttgctccagccgtttttgattgtgactagcggtgttgctatggttgaatacgaacgagtttaactgatactgattattaaattgaaaatatgtaaggggtaattgattccttaatatatggattactttgtttagatcttgaaacgtagatcgtggttattaccacaggctaagttagagaagtcgcaactttcggtcatataagctctaaacttaatagtcaaaacaggaatattggggcgttctggtctaccgtgccaaaacgtgcaaaagagccgcaacttccggccatataagctcctaaacccaatattcaaaacaggaatatttgtgcgctttaagttactgtgtcaaaacgtgcaaaagagggacagcccccggccatataagtggatcaacccatcattccaaaccaaggaataatgggttggtccacttatattctgggggctaaacgtccctttttgcactctcattcccagcgataaaacttcctcgccacatcataaatcaaccaaaagataaaaaatgaaatatttgaaaagatggatcggctcagaaaggacccgatgttttggcttttggcttcccaacccatcagctgaaaaacaccgtcaacgataattgagacgatgatccacatgataacgtcactaatcaatagggttaggtatgaatgctgatggaatcgccaaaatttttctgctaaggtgggtttctttttaatatggatcacctccagttggtttcttatgaaataggttactagattgcctggtatttggcaattgaccccagaaagagttacaaggttctacttgagttaaagactgctgggtggccgattgaagggtgtatgtatgaattagctccataatgactgcgtggttattgactattcagtcattatagaatatactttggtcgaattgagagaaggggccgtgaaacttggtaagtttggttaagtgattggtttatttagactataaagttgggatcacgacacgttattttagtgatgcaactttgacctaatgaataatagggggcgttttcgatgaagggtgatttagttttagagactaacgggttacagaaatcatttgggaaatttaaagctttaaaagatgtgaacctacaattgcataaaggggaggtcttagggttcatcgggcccaatggtgcaggaaaatcaaccacaattcgggtaatcttgggattgattaaggcaacaggagggtctgctgaggtctttggccaaaatgtttggaaggactcagtcaagatacatcaggacttggcgtatgttcctggtgatgtttatctttggcccaacttaactggggggcagacaatcgatctgttgcttcacatgtcaggacaagcacatacctctcggacagatgacttaatcaaaacatttaaattggataccagtaagaaaaatcgaacttattcgaaaggtaaccggcaaaaagttgcactaatcgcagcgttctcaactgatgttgatttgtacatttttgatgagccgacgtctggattggatcccctgaatgaagttatttttcaaaacttggttgctgaattaaagaaagctggaaagagtgtttttctttccagtcatattctctcggaagttgaaaaaatgtgtgataccatttcaattattcgtgaaggaaaggtaattgagacagggtcattagaagcaatgcagcatttaacccgaaatacagttgtggttaaaactcaaaatccaatgaccgctttaaaatctgcggctggtatccaccaattgacgtttaccgatgatcatgagacggcagctgagttcagtgttgattctgatcaaattggcaacgttatgtcgctgctgtcagatagtcgaattgttcagttgaaaacaacgccgccaacgttggaagacttatttttacgttattattcagcgaataatgaccaaaaagtgggtgagtaaaatgacacagtatacccaaactttcgctttattaaaagcaaatttaaaacgtgattggatcaaaatcttgatctggctggccgtcttggctggcatgtttgtggctgtcgccgccaaattcgagggcatttatggaagtccaaaacaaattgcaacaattgcccaaacgttgaggtcgcaggccatggtctcgttatttgggccgatgactcatgccagcttgaataccgcaattatctttgcctccgaaatgatggtcttttggggaatctttatggtgatcttcaattactcattatcggttggcgctactcgtggtcaagaagaatccggattaactgaaatggtccttgggggtcaccctgttggccgattggcacccattgcggcagccggattggaattattggttgccaacagcttatttgctctaattactggttttggtatgatggctgccaatatgccgggaagtgattttaatggtaactggctttttgcagtaaccttggcgttagttggttggacgtttggaatgatttcactgatttttgcccagctggtcgccgatagtcataatgttgccatttataattatgctttctttgggatcacttatctggttcggatgatgaccgatgttgctaatcctgattacacttggctatcgccgtttggttggattgaaaaggctggcatttatactgaaaataattggttgccggttgggttattgaccattctgggtttgattgcatttgggatggcggttgctttgaatatgaaccgagatatcgatgctgggattatccaagttcgagcgggcaagcgtcgaagccgatttctgcgaggaccggcaactctcctgctttggaatcaaaaatcgatcagtttgttttggattatcgggatggcggttctcggtgccagctatggttcggtctttaacagcattagtaaaatcgtcaatgactcaccggtcgtccgccaagtgctgggcgcaagcggtattgctcatgccgaaaagacacagcttttatcatttgttggtattttgggagtgatctttggcgtgttggccgttgtcggtggcgcgatggttattaatcatttatacactgaagagattaaaggatatttacagttggttaatacgaagccacaaagccgaagctatttattatcaacctattttgtttatggttggctgctttcggtcatcatcctttttgttgctttaatggcggcgatgggagctggtaacgctgttttgaagcacccgttagcctttcattatttctggcggacctttgtggcactagtaccggttttaaccgtatttattagcacattagttgctttgatcggctttttaccaaggtggcgttcaattgtttgggtgcttctcggtggctcattcatgatttcgtactttggtcgattggttgatttgccaacgtgggcattgaaaatatccccattttattggtttagaaaagtgccaatcaacgaaattgatggtaccccggttatctggatcttgatcattgccgccgtgctgatcgtaatcggttacattggatatcggagacgggatttctcgaattaaagttcagttgattctaacgagttgtgctaaattaacaaactagtaaagagggatgatcatggcaaaacgattaccaagagacccgcaaaaagaagcagcaattttggcggcagcaattcaggcctttggaacgaatggctttcgggcaagtacagatgagattgcgaaaattgccaatgtttccaaaggatcagtattccgatattttgacaataagaaaagtttgtacaccgctgcagttcagcaggcaatggcaaccttaatttcagtggttgatttgaccgtttggacggattcagatgatttagtgaaaatgattattcgggcaacccagtataagacagctttatcgcatcaatatcctaacgagttcgcgttgttaacgcgggtatacgctcatgatccaatggtaccggtaaaattaaggaaccaggtgtttgagacatttaacaaatgggccgaacagacacaaacggctgttgttaattcggttgtcgctaaattaaagttaaggccggagctggatgaacaagttgttaaacgatttttgtcaatgatgattcaagaactgtcaagatggctccaaacctattttgaaaagcatcccgaattaaaacgaatcgaagatatgacagccattattgatgaaatgaccgcatatatggatatggtggaatatggtattgtcaagcagaccaaaagttaattgactctttatttgattatgcaaaaataagctccttgattcaacttcctatgtgctttaggagaattggattaaggagcttatattctgggatctaaccgcttgctgggccactctctatttcctagtctttgtcgtagtcggaaactttgttcgtaagtcggtttgtcttcatcttataattatcaccagatttttggatgattgcttcatattcaaagacttgaatgtgatcatggttgccgttatcaaaggtatatttaatatcgtaggtaaccatggtttgaccagtatcgtaaggcacaaccttcttgatggttggttccatttcgtagttatcaatatgatcattcttttgataagagtcaaccattttgagtaagtcctggtaaataatggatgtgctgccgccagtaaagtaatcgtcaaaatcatcatcgttggcagagtccgcatcagtaacggtaccgtcactaatgtcaccccagatgttattgattaaatcactggcatcatctgtactggcaaaaccggagaacactggtgtgacagttgatccatccatggacatatcaattttagtcttgtcggaattgacgacttttccggaggcagttttcattgaaagttggacggtcatatcctgactgaatggatattctttaatgtcgtaaaatccgctcttattcagcgtgccaatttttttaccacttaaaaagacggttgaaccagcctgtcccttaatggtgtaagagatggtttgtaaatctaatgagatatcttcgtcatcactagttgggtcaatccaagcgtatttgccattgttaaccaatttgtgaccattaaccgtatcggaagtttggacggtgtattcgccaggcatgtatggaccaatctttttggggttggttgtcccaattttatttgagagaacttttccatttacttttaactttgcaccggcgcgattcgtttgaatttctggatagattgttttgaccttgagctggtagttatcgaacagcaagaatttatgaccggaattgacaaaggccaaatgatcgttcacatagccggtactggttagttgccctttcagctttgctaactgatccttattttgactataataagtaatcagcggttcaactgaagatgacgtgattttaaaacttgggtcgttacttttaaccaacgatgccacggttttaccttcatcctgcttaatagctgtaactaaacgatcagctgtggcagttttgccatagtaatgatttagaaaaagatagccaccgataagtataataaaaacgaccaccactgaaatgacctgccaaggcttcatggcctgccgtggtgtccgacggtgcggctgctcagggcttgcagtcgattcagctgatgacgacggctgagttggtgctgattgagttggccgctgaggatcattattaggatgattcgttgatttagcctggagaccagccaaatattttttaacgttgaagccgcattccggacaaaaaatgtcgcttttactgatcggctttccacaattgggacagaagaatttttgattatccattttttattcctccactcaatttaatagccggaaaatgtgttttgcagcgtattggctaaattggtcaccatgtcgttgaggtactgcatcgaaatgaggtaaatgacgatggcagggagaatttcagcaaccagcattgaataaaaagtgttgaattttccctgaacgtcttttaggaccatcacaacgccgtagttaatgacaacttggctgagaccaaataaggcaagaatcagaaaaagcaaaaatgctgatgcggcgacactaacaaataatgatagcacgaatgttgctaataatagcactgaactaatattcaaataaataccgaataaatctgtgaagtctaaaaaagcgatattgtcgttgagcatgagacgacgaacggcatatgcaatgatgagataagcagctaatgaaataattaaaattcctgaaattgccataatatttgaagcaattggttcggttacggaactgacaacttgtgaagacagatcgttgccggcactattttcaatggcaccgacaattcttctggaaaagacgccaaacatgattaacataatgacaacgtagagcccgatcgacattaaaccaccataatggggtgcttcaatgttattattagggttaattagagattcctttatgtaacgtaggaaagagttgaataagtgattagttgctgcgtatcgggtattggtctgagttgcatcagcagctgcctgactaccagttgaatttgcttgttgctgattgttatcctggttggtgctgaaggctgctgattggttaggattggcttttgaatcagcggcggtcgagttcactttagttgtttgtgaatccggtgccggtgattgtggggtactagagtctgagctggctgctgaaacatttatgaggttaaagccgcagtagacacagaacttagcatccgcaagattctccttttgacaatttggacatactttcataataaaaacttcctttcatgtatctttagttaatgaaaataggcgttacgatttattataatatatttattaagtgaattgttaaccaattatgaattaagtgggtctcgttttaaaatattggaaaacgatggtgatagtttggtgaaacagggaaaatttgcaaaatccagtcgattaaagcaaattaaagcaattcaaaagcggcatcaacaacagaatagccgggtgatcacggctgacaaatttcaggcttttctgttagtccgctatgggctcacgatgaaatcaaagcttcgcccggtcgataaggaaacaatgcagcgctttttgatggcttggattgaaacgggtggaacggacagcccatggtcaatggcaaagatggcagtgaccgtttttcaaaggatcaacgtacgggtcccttatcagttttataaacaaattgttcaacactgggaaaaatttcaaaagttcattaaacgagaagtgccagccgtaccactagcggatcgcgtgattgtgagtgatcttcttacggaagatcaattatctaaaattgtcgttcggcagctggccgcaaattcacttttaaatacattgggcggcaatcccgcaatgatgagtttaattaaacctgagcaggttgatgagttgacagccggtttaatgagtggcaccgccattgattgggatcaggttgccgcaatgtttgaaccaattccgtttgacgtcagcacggctcctgatgagccaaccaagcggtggttgaatcagttattagcattatcatagtaggaggaactttcatggatcaacatcatgctttggaatgtgttaacttagttccgatttttaaatcattacctttaattcaaaaaacggcagtggcggatttagttgttaaacaccaatatcccaagggcaccattatttatttagcgggggataccgttggccattttatgattttagaagccggtcaaattaaaatttcgcaggtggcggccaatggtaaggaacaattgttaaaagttctgcagccaggcgattttgatggcgaagctgctttatttaatggaaatcagcgaaatgtgacggcaaccgcacttgttgattcaaatgtctgccaaatcgatcaagatgcatttcaaaaactattgagccggagcccacagttggcggtaaatttactgtctgaaatgagtcaacagattaacaacctgcaagcggataaaacagttgcggcaacttcagatgttaccggccaagtggcgaaatatttattggaaaccagtgcggcgcttcatgaaacaaattttaagttgccactaaagaagaaggatattgcgacttatctggggacaaccccggaaacgattagtcgggtatttaagcagctaacaacaaaaaagttgattgatacgacagcagctaatgtcaaaattagggatgaagatggcttgatggagctggtttaaagtcaattggcaattgattggggggcgaaatgatgttttcctgggcaatgttgtgggctttgttgccattggcgattggttatttatttaggcgagggaaattacttttcttaattgctggcaataacatggccactaaaccttatgataaaagatcgcaattggcaggacgcgttgtggggttaatgatgtatgtaagtgcgcttcttgtgattctcgtctttattccgaatatcccggatctgtattattacattctcactgtaatctatatcatcatttggattgttgtcatcgtttatttgaataagagtgggccagcaagcggttagaccccagaatataagccccctgccttgatattcccgattttggaatatcaaggcagggggcttatatggccggggtctgcttgctggcccacgtttcggctaagtacaaagttcaacgagatattcctgattttggaatatcaaggcagggggcttatatggccggggtctgcttgctggcccacgtttcggctaagtacaaagttcaacgagatattcccgattttggagtattaagtcagggggcttatatggccggagactgcttgctggctcacgttttgtctaagtatgaaattcttttaggcttagacatttagataagtccttatacggccggaaattatcttttatcgcactctgattttagttaatttaatcagatctgccaacaaaaaatgacaccactgccactaagataacggcacctaagatagaaggtaccagcgccataccggctaagtgaggtccccatgagcccaataatgcttgaccaatcgaagagccgattaagccggcgataatattggtgatacaacccatggatttacctcgattagtgatggcaccagcaattgcgccgatgatggcaccgacaatcaatacccatatccaatgcatcataatcacttcctttaacttggattaatttcgcttttgacgatcctttctaagtgagtcgatttgcttataaagggaaaatgcgagttgaccaattgcaatgattgcagatagtttgtaccaaaaaccactatttttttgcatgctaatgcctcctaatattttgaaaatcaaggggtaacggtttgatgattttaggacaattagaactggatttaagtaatccactttcctgcgatgaccaatttattaacgtaatttcatggtaacaaggccaggattggctgtctaatttgtgaactggcaattgaatcccaatcagcaatgagggatgcttttgttcaaatatgtgcgcatcattctaacagcgatgtggcgattgaatactgctaatttattctataaatattaaaagtcattgatttatccgtatcaatattttacaattaggtagtaaacgtaattatactatgtagtactctggaggatttaacgatggacgaaagtcgcgtacgaaatgaaattgtaagcggaaacatttcactgggtatcgagctgggatcaacccgaattaaagcggtcttggttacggatgatttccagacaattgcttctggtgattatctttgggaaaacgaattagataatggtatttggacctatccgcttgaaaaagtttgggacggtattcaaaccagttatgcaaccttagcacttcaagttcatgataaatttggagttgatttaaagaaaattggggcaattggtgtcagtgcaatgatgcacggatacatggcctttgataaacagaacgaactcttagtaccttttagaacttggcggaataatattaccggccaagctgccgaggcattaactaagctatttaacttcaatatcccagaacgttggagtattgcacatctctatcaagcaattcttaataatgaagatcatgttaagaacgttgatttcatcacgactctggccggctatgtgacttggaaattatctggtgaaaaggttttaggtgtgggagatgcttctggtgtcttcccgattgacgatcaaactgttaactataataaggaaatgatcgacaagtttaccagtttgccggaagttcaaaaatatccttggagcctgcctgatattttgccgactgttttacctgctggtaagaaggctggcgaattgactgccgatggtgccaaattattggatcaaagcggccaacttgaagccggatcattaattgcgccccctgaaggcgatgcagggactgggatggtttcaaccaacagtgttaagaagcgaactggtaacatttctgccggcacatcagctttctcaatggttgtcttggatcgtccaatgaaagctgttcaccgtgatatcgatatggtaaccacgccggacggtgccccagttgccatggttcataccaacaatagttcttctgatattaacgcgtgggttggtttatttggcgaatttgccaaagcacttggcctgcagcttaaaccagatgatctttatggcactttgtttgccgaatcagttaagggcgatcaggatgccggcggcctagttaactatgcctacctttcaggtgagaatattaccaagatgccagaaggtcgaccactatttgttcgtaaacctgatgcaaaattgaatttggccaactttattaagactcaaatctattcagcatttgcacccctcaaaattgggatggatatcttattacgcgaagagcacattaagaccaatgtgttggttgctcaaggtgggatcttcaagacgcccgttgttgcccaacaagtcttagctgatgcccttaacacgccgatttctgttatggaaaatgccggtgaaggtggtccatggggaatggctgtcctagcgctcttctgtgtcaaccgtaagaacggcgaatcacttgaagactatttggccaatcgggtatttaaggatgcaactaaagcaaccttattcccagaacctgccagtgttcagggatacgataaattcatcgacaactacaaggctgccttgccagttgaaagtgaagctgttaaatcaatgaaaatgaagtaaaaacgaaaggtgagtcaatcatgttagaagaacttaagcaagaagtttatgaagcaaacatgcaacttcctaagttggaccttgttacttttacttggggaaacgtttccggaattgaccgtgacaagggattatttgtcatcaaaccctctggtgtgccatatgacaagatgaaagcatcagacatggtggttgttgatttgaatggtaaggttgttgagggtgacatgaatccatcaagtgataccccaactcatacttacttgtataaccattttccaaatattggcggaattacccatacccattcaccttgggcggtttctttcgctgctgccaagatggatgttccggctgtaagtacaacccacgccgatactttctatggcgatgtgccatgtgcaccagccttaacagaagaacagatcaaggaagcttacgagttgaatactggtaaggttatcgttgatgaatttgaaaaacgtggcgttgatccggatgctgttcctgctgtcttagttagccaacatggtccatttgcatggggcccaacacccgataaatcagtatataatgccaaggtgcttgaggtatcagcagaaattagttatcacgcattgcaactaacacgtgatgaaatccatgtaccacaatatctcttggataagcattattatcgtaaacatggtaagaatgcgtactatggtcaaaacagtgccaagtcaaagacgcatgcggaacatgagtaaacagagtgcgccaacaagcgtttagctcccagaatataaagcacttcggccgatatcccgattttggggtatcggccgaagtgctttatatggccgggagctgcttgttggcacacgtttcggcacagtagcccggtcagcagccgatatcccggttttgggatatcggctgaagtgctttatatggccgggatctgcttcatggcacacgtttcggcacagtagtctgaataaaagaccaatattcctgttcttggaatgttggtcttttattgcttatatggccggaagctgcttgttggcttatcaaccgcggtgagatatagccaattccaagtcaaaagactatactggtgtatattttgaaaaatggagatttctaaatgcaaaagaaattaaaggatcgcctcgatgtatttgtcgatgcgattattgcaattttgattacggtgatggtgttagagctaccaattgagattaccaatggtgtcttgaattatcaaagtttgttcacggcgattggcatttacgcggttagtttttgttttattgccaacttgtggtatcaacacgcagttatttttaatgaagttgagaaggtttcaaatggactggtcgttgttgatttgatcttaatcttttttgcgtcgctgatcccaacgtttactcggctaatggcaatcgataccaattcaatgacggttgtaatgtacggcgtactggatttgattatttcagtcctgtttcggcgaattgtcaggtcaattgtccacgataaatacactgacaaggatgatatgcgaaaattgtacaatgtgatttatggacgagcgttttacgaatcttgggtttcttatgcggttttgattgtcattggttattttttaccgaaattttcactgattcttttcatcattattcccattcggtcatttattcgccatgcggctgataatgaggagtttaatgatatcggtgatttgggtagtcatggcagggaagcgtttgtgaatttatcagccagtcaacggcgattatttaaacgtttggctcatgattatcggaatcggacaaggacgattggtagcaacccggaagctcaaaagcaggcttggcaggacttttctcagcaagttgaaaaggaattaaatttatcagcggctgacgttatgaagtggtcccaccaagatcatcatcaggggcgtgagcgagactaagtgtaattaattgaccaacctccgttcaaagattaaactgactgcaaaatatgaatggaggcgtttaccatggctgataaacccttagtaacaatttcaattcccacctataacttgggcaactatctggaaaaaacgctgaatagtgtctttaaacaaacctatcaaaattttgaaattattttagttgatgatgcgtcaactgatcgaacggctgaaacgattgcggccgttgcccaaaaggacgatcggattagaccatactatttttaaaagcatgaaggagtttcaaaagcgcgtaactatgcaattgatcatgctaaaggtgacattatcgtctttgttgatggcgatgacttgctggaccccaaatacttggaggtcatggtgactgggttggttgatcctaaagttgacctgatgattgttggctttagctggggctggcgaggtggctacggttacgaacgaaatccgcaatatgaaacgataaccaaacgtcgggcatatgattcgattaattaccgtggtgataatattggtggctatacatggaataaaggctttcgaatgtcgattattcgggataaccaaattcgatttgatgagtcaattgatttagctgaagacctgttatttaccgcggattacatgttggcttcccataaatttttactctatgaggcacctctttacaacaaagttagccgaagtaacagtattatccatagtgccacatatcaaatgagggctaaggagcaggttgttcggcggcatattgatgagatgggcatgaatttgacggtataagacgatcgttaaatttattattactaatttaaatgattttcgaaaaaataaaggcctcgcgaaaccgtttttagggatcggttttgcgaggcctttattcattattgtagagccagatcagctaggtgttagtcctcttattagaaattctgctgcttctttacttgcttgatttgtgttgatgggttgattggccagtgctgcgggaagaacgtatcccataacggttgtcacaaggtagcgtgcaattcgaatgaggggccatttgattaattccccgcttttttgatagtgacggaatgctgttccgagtggcccggaaatcaaattatccaggagatgaccaagtccggttaacatttcttggttggtaatcgcttcttgaagcacaattcgcagttggggcatgttatcgacggcaaaatccattcgatttttaatgactgtttcaagaaagcgactaaagtctgggtaaggtggcgttatcacggcttcagtaaattcatgagcggctttcggaacaacccgctgaatgaaaggaccgatgattgcggcaagaattccctccttggttttaaactgtttataaacagtgccttctgaaacgccggccatctgtgcaatgtcactggtgctggtattattaaatcccctttcggaaaatagcgttaaactggctcgcagaacggccttctgtttatcagtcagttcgagttcgttcaaactctcggcaaatagtgcctggatattgttgattgccatcgtatttggtggcctccttttgattaaacttggcggtaacgcctcatggacatgatattaaaaatgagaaataaagctgcaaacccgatcaggattccgagctttggcagaatatccatgaatgtaaaacccttttcgataacattgctcatggcactagcgccgtagtataacggcatgattctggcaacgggctgcagccaattggccatctggtcgattggaataattccggagaagaagatttgaggaatcacaaccaccggaataaattgcaccatttgaaattctgattgagcaaaagttgagataaaaagccccattgccaatgcaacgaatgctaataaaatgttaatcagcaacatattccaaatactgcccagaatttgaattttgaaggcgtaaatgctgaacccaacgattagtaatgtttggattaaagcaaagataccatagccggctaagtagccgctaataatttcaccacgtttaaccggcgttgctaataaacgatttagggtgccggttgtccgctctcgtaatagggcaattcccgagattaggaaaacaaagaagaagacaacaaatccgatcatgattggtaagagggtatcgaagaacgttgaatcgctgctgccgtacaaatagtgggtattaaccgtgtaattagtcgcacccttgggtttgttggcaggtgccggtgatgtttgaggctgggctgcttgttgttgtcgagcagcagtgggactttgagctgccgatcgttgactagcagcggccaaggcccgctgcattttcttgatagcttgctgttgtgcttttaaggctttttgttgggctttaattgctgttccggcagcttgcatttttagcttgacctgagcttgctggagactttgtttcagaatcgcacttttactttgatcactattttgaagtgttaaggtgattttattacctttttgagcaatcagtccagcataatcgtgatcgcggatgacctgttcagcgcttgcattggatgatacctgatgaaacttaatgtgattgtttttaattactttgaccaacgtactgtctacatttcgaacacccaatgacgcagtttgatctgtattggattgaaaaaggaaatacatcaatgtcaaaattaagagtggggcaagaaacattaatgcgagtgtgcgtttgtcacgtaacatttcagttaaaactcgtttaatcattgcggctgttctcatcttgctgcctccctgcttttaagaatactgcttcaactgtgtcgacttggaaatctttaattaattgatccggggctccttgagcgatcgcaacgccgtttcgaatcatcatcagctggtctgattgttcggcatcttccatcacgtgggtggtcagcaaaatggtcttgccttgcttggcaatctttcgtaactcggcccaaatttgctgccgaagttcgggatcaataccaacggttggctcatccagaatcagtagttcgggatctgagaccaaggcaatagctaatgataaccgacgtttcatgccgccagaataatctttgacgtatttatccaggtcgtcatttaaattaacaattcctgcagcataggggatttgttttttgagtgtatcgttgttgattccttgcattgcaccaaaaaactttaaattttctcgtgcggttagggtactataaagcgcatctgtttgagccatatagccaatcttggctaatagttttcgattgggcatttgttgccccaaaacggtaacggttcctttttgaggggtcagcatccccataatagtgctgactaacgttgtctttccagcgccactgggaccaatcaaccccaaaatctcaccgttatgaacagttaagttgatgtcttttaagacaatggtcttgccatagccttgttgcaaatctttaacttgaatagttattgccattatgatcacttctttcttaatgagtaagtcctcactcactagtataattgatttattgaaatgtgcaaggtttatcttaattttgattgatacggtggttgcttaggggtgactgtttcgaaaacaaatcacttgctgagacactctaattttcactaaagattcttacccgctacttcacttttgaccagtttgcggtacgataaattagttaaatatccaagagaggtggatcttattttgcaaactcatgtcaacccatcccataagcagattacaaataggttgctgattatgatcgcaacattgtttatggctttggcaccacttaataatgcttatgctaaaacaaataaaaaacagtatcagtttgaagcaaaggaaatttatgtgatggatgtcaagtctggtcagatgatttatcaaaagaacggtaatcagaagcgaccaattgccagtctgtccaagttgatgactttgtatttaaccaaacaggctattgatcggcacaaattaaactggaatcaaaaagtggcggttagtaagccattaattaaaatgagcaaaagttatgaattagggacatttaagattaagcattccaaacaatatacggttaagcaattgtatcaagcggcattaattgcatcatcaaactcagctgccattgcactggggcaagccgtggccaatggtaataatacgcaatttattaaacagatgaaccaacaggctaagaaatggcacattgatgccaactttgttagtagttcgggcttggacaatactgatttaaagaagtatcatcttcaaattccaggatcaagtaataaggcacagaacatggtgagtgccaaggcaatttcaacggttgccgctaaagtactgactgaatttccgtcaattaccaattggagcaaaaagtcagcgatgaaggtgggcgatcaggtcctggttaacagtaatcgcttactgccgggaggtgctttctataaaaaagctaatcatgtggatggattaaaaaccggttttacggatacggctggattatgtctcactatttcatactggaagaatggccgacatctcattgcaacaattattgatagtaatacaattttctcgtcaatggttaagttgattaaatcgattgatcgccattatcgaatggttaaagtcccgttgactactcatcaatttagtgttgataagcatgttgttaccgcgacgccgcaggtgaagacaacggcaatctggctgagaaggggatcaacgcaaaccaagagcactaagcagtataccaaaacaacagaaaagcttccggtcaagcagggcgaaattgttgggaataccctgattaagctatcgggtggtcgaacggcagcggtaccaatgctggcagctaattcgattaaagcaaacgtaaataaaaagacagttaaacaggttaaaaatcaatcatggtggcaaaaaatcggtaactttatcctgaatatttttgtcggactggtagcattgatggcaaggttgattgagacggtggtgaagctgttttagagagtgcaaaaagggacggttagctcccagaatataagtcacataaccccatgttcctgaatttggaacatggggttatgtgacttatatggccgggagctgtctctcttttgcacgtttaggcacggtagccaaaaacggcacccattcatttaccaaattgatacgtaaaggtgcgttaatctttacaaacatccggttccgttgtacttaaaataggttaaacttagaacaataataatcatacttggagtgaacgagatggctaattataaaattgttcaaatttctgatactcatttaaccgttgatggggccaaaccagcaaatcatcagttgattgatccttatgaaaaattacagtcagtttttgatgatatttacgtaactaatgttgacccggatttaattgtgatcactggcgatctggttcataacggtgacgaggattcgtatcgtcattttcatcatattgttcagcaagaggaagaaagattgatgaccccgattgaagtgattctgggcaatcacgatcgaactgatcaattttacgaaggctatttaggtaaaccgtcactaccacgttattactttgacgttgaaagtaatgattggcatttatactttctggatactaagtgtggcgatattgaacagggatacttggatcaagctcagttggagtggttaagtgatcgattgagccattcggaaaagccagggctaatttttatgcatcatccactactgggagcaccggtaaagcaaatgaaatacagtattcttcaaaatggtgatgaattaaaacgggtaatttccggaacggatgttagagcgatcttttcaggccatgttcattttgcaaatacgtatctacagaatggcgtcttaaacgttgtggctgattccacagcctatcatattaattgtgccaatccgcaccagcattttgtggtggatgggacgagttataatattgttcaccttgatggcgacgaaattggtgttgagcaacgtttactgcgcttagatactaagacaattaatacgtttaagattccaaatacgaattttgttgaccctaaattgatgaagcggcagatggagaatgcaatggggtagagtgcaaaaagccgcggttagcttccagaatataaaccctgcaaatcaatattcctgattttggaatattggtttgcagggcttatatggccggaagctgcggctcttttgcacgttccgactaaacttgatcatttatttctgtcgtaattttgaataaagtgccatatctcgataggcaccgttataaaatgcatattggtttaaaatcccatctaaatgaaagtcacggcgttcggctacgctgcggcttttttgattgtgcttatccgccattaattccaatcggttcatgtttaattcttcaaacgcaattttttccaaggcagcaacgcagatcgtcataactccttggccttgaaatcggctgcccaaccagtaaccgatttgacaacgatgatgtgtctgattgaaaccgtgcaaatcgagcatacctgcaacttcgccatcaactaaaatgacggcaaaccagaaattaccttgggccattttttcggcaccatcttgaagaaagtcgcgttcatctgacgtggcaactagtaatttaacccagggcagccattttcctaaatattggcggtcttcgtcaatgagttccagtaaaggttccgcgtcagattgagtcggtaatttcaatgcaattttttcgttgatttgattaataaacatgatttcactccattttcttccctaaaataagtatactatttgtgtcagcagaattgaacacggcttaagggggctttagcatgtttacgatgactggtaattccgaaaatcagatctatatggaaaaatatatgcgtaatcaatttaaatttttaggcttaaaagcaccggaacgaaaagcacaatccaaatcttttatcaaatcgtcgaaaaaagcgcctttgaatgaagtgctggctgagattgaaacgttatatcaacgtccgtttcgcgaatatcagtatgtggccattgatattggcgatgcaaacgtcaaacgactaacattcgacgatattcaaacattgactaagtatatccaaattaagtcttggtgggatacggtagattcatggcgaaaaacgtttgaaaaatatgccaggcttcatcccgagcaaaaggaacgggtttttaacttattctatcaacatgataacttttggatgcgccgagttgctattaccttgcaactattggaaaaagagacattagatacgggattactaaccaaagcaattgagtatgacattgagaccaatgccttttttattcaaaaagcaattggctgggcgttgagaaattatagtaaatttaatcctcagtgggtgacaacattcatgagcgaacatcaactgtccaagttggcggttaaagagggcagtaagtatttatgaataggagtgcagtaaactaatttggaatttggattgcaatgatttactgaggtgaaatgggtaaaagtaagtagttttcggtcagatataatatttgatttttatcttgctctggcaacttagccaaaacgtgtgaaaagcaagcagattccggccagatataatatttgattttcgtcttgtactggcaacttggccaaaacgtgtgaaagagccgcaacttccggccatataaggcacttaagcggtatccccgaaatcagggataccgatcattttttgcaacttagttgaaacgtgtgaaaagcaagcagattccggccatataagccctgcaaaccaacattccaaagtcaggaatattggcttgcagggcttatattctggaatctaaccgcttgttttcacactctaaaaaaattcccaccccgccaagttcccctgacgatcgtgagaatctctctccggcaccttacctcaatgtcttgaagcaaggtggtgatctgtgaatctaaatccaataacaaccataatagctgcgactaagaatgaaagtagaccaggcagtacgttagtaaaaccaaagcttgcgacaatcgaagcaaaaattgttccaattatcaaagtcaacaaaccaatcaacgtgatttttaagttctcatccatcactatcgcgccccctactattattggtatgtagaatcgcaaacaattagttgaatttagaccgttttgaaacgttggaatctattgcccgcgtttctcttaccgccttcattatagtgaactaacatcgtaatgtcacccatttcggggtatgtaaattagtttctgattgtccaccaaatttgcaattgtgatgtaaattggttatcatcataagtaattaataagagaggtgtgacacgcattgaaaattacaaatcgttaatacagaagttaatactgactcgctgtctcgttgacaggggttttctgtgcgatttgtaatatggtaaggataactggtttagagtactgtcaagaatttaaccaatcgttatctaaacgattcttggaatgtgttttcaagaatcaatgtgtgaattagaatcgaaagttagtgtcattctaattaaacatccacgacaattcaaagttcagaaggcctgtttgcaaattttttgcatgcagccttttttatgttaaacagatgacctgtttgataagatggccaaatgaggtgatctcttatgggaacaattaaaattcaaaatttaggattcagatatgatagtatgctgacaccacttttcaataattttagtttaaacattgatgagtcgtggaaactgggattgattggtcgaaatggtcggggtaagacaaccttcctaagaatgctgttaggccaactgacttatcagggtgacattcaatcaaatgtcaggtttaattactttccgcagccggttgcccacccagactcaaaaacggctgatgtcttgatgcaactggccgggtattctgaaagtgacctttggcggattcaacttgaaatggataagttgaaattgactgatgaagttcttgatcggtcgtttgccacattaagtccgggtgaacagaccaaggcactattggcagttctgtttagtcaaagtgggacgttcgagctcattgatgaaccgactaatcacttggatatcgaagggcgccaggtggttgctgattatttaaaacaaaaaacagggttcattgttgtgagtcatgatcgttactttattgatcaagtgattgatcatgttctctcgattgatcgggctaaaattcaattgtttgatggcaattataaaacttggaaacgcgaatttgaccgtgaaaatgattcagaacaatctgaaaagcaacatttaaaaactgaagtcaaacgattaacggccagtgccaatcagaccaaacagtgggctagtcattccgaaagcaagaagagcaaggggagccataaaaaacgcgagcagaacgttcagttggataaaggattcttgggacataaatctgctaagatgatgaaacgagcacaaaatacactgaaacgggaggaaacagccattgaagaaaagaaagggctgcttaaaaatattgatgacataccgcaacttgctttgaactacgaaagaccgcaccaagaacatctgttgctggtagctgacttacaagttcagcgaaatggtcaggatttgaatcaaccattatcttttgatttgcaaaggggtcaacgattggtactgtttggcccgaatggcattggtaaaacgacgctgattaaggcgataatggggcaacacaagctggtttcaaacggcacaatttcgtttaatgcaacaattaagacgtcatatttgacccagaactttgagcagttacgtggctcaattgcggattatgccaccgcctatcatgttgcactttcggaattattaaacatgttgcgtaaattaggatttgagcgttcagcatttgatgaggatcttagtgaattaagcatgggacaaaaacgaaaggtatcactggccagatcactgtgtgagaaagctaacctctatatttgggacgagccgctaaattatttggacgtcattacccgccagcaaattcaggatctcattttgaagattcaaccgacgatgttggtgattgaccacgatcaagcattcattgaggccatcaatactgaaccattggtaaagttgaaatcagcggttcatgtagaccgataattttttcataaattgggttgtaagtgtttagttaaatagcagcaaagcgggacaaaaggcgcttaacttccagagtgtaaatccgaatattctgaatttgaatatttggataatccggttacacggcctttcgtcccgcttttttacttggtaataattgtgtttacactaacagagactggacaaaatgactattgtcccagtctcctgttcgaggttattaattaaatgaaaatgagacaatgcggaaagattatgcccattgttgatgctcgtatgccatgccccagaaatggagttcgaaccaactactgcgaacaaatgccgtcttcatacccctttgttcgtccggggttgccgaagcaccgagctcgttgacgatctgaatcatttcattggtggcatcggtaaagccatcgctgtcataagtatcaatgaattgttgataaattttaaccggtgagccatttttaatcagctttttgccgatttcattgtacaaccagtagcaaggtaacaacgctgccgcggctcgggcaggtgaaccctcatgaagttcatggtacatgtgggaaacgtagctgtaagcgttgggcgcgattggtgttgcttcaatttcagccggggtaatcgctaattcccggaagaatgttttgcggacatcagcttcgtcatcgtgcagtccctcggcacccgcatagaggaactccttaattttagggcttgaaatgtgatcggcaatttgtttgtgaagatcaccgaagttttggagatagtaacgatcttgtttgaggtaataacgaaaggtatcagtcggcaggttaccggcagctaattccttaataaatggatgattaaagctttcctgccaaaggggctctgctaattgatgcatggattgcgtaatttcgggcatgatgatatctccttcaaagcgtttggtttagatgattgactagtagtattttagcatgttttgaatggcgtgttccattaaatggatgagattagtaatggtcagtgtcattgagaaagggcaaacagaacttaattgtgaacagccgatcaaattgttgcgatctgccagtgtaaccgatatcataaatgtggaactttaatttgattgataggttattctgcaaggaggaattcaatatggatcgtttgaaagataaagttgcgcttattaccggcggtgtggccggcattggtttaggaatcgctgaatgttatattcgtgaaggcgccaaggttgttttaactgctaatcataacgttgatggtggtaagaaggccgttgaaaagtttggtgacgataaatcgttatttgtccaaatgaatgtagccgatgaaggtgattggcaagacacgatccagaagacaattgataagtttggcaagctggatatccttgttaacaacgcaggggttggtggtgtcaacggaccagttgaaagtttaagcttaaaggattggcagcaaacgattgatatcaatttaaccggcaactttttaggcgaaaaatatgcaattcaagcaatgaaaaaatacagtaacgctaagggatcaattattaacatctcatcagttgccggtttggttgggttgccactgagcccggcatactcggcaagtaaaggtggtactcgattattaactcatgcaacagcgctgtcacttgcacaacagaaagttgatatccgagttaatagtgtccatcccggctggattgcgactgatattgtgcccaaagaatatgagaagcaaattgtgtcgaccattcctgttggccatatgggtgagccggttgatatcggtgaaatttgtatctatcttggcagcgatgaatcgaagtttgccaatggcgccgaatttgttattgatggtgcacaacgggcatagtttcatagtaacgacaaaaatgcttcctaacgattcgttttttaatcgttaagaagcctttttgatttgtaaaccagagaattacggttccggcactttcatacttcgatcaatcgttgaccgaccagtcgcatagtcaatttttacatttggttgaacgttgaataggtaaacgttaaagtttaacgatttatcagtgctcaaggcctccagatgaatcccccgagccattaattcgttatcccgaaaaataggcttggaataaaagatgacgcgtttgccggcttttaatgaatcgcggatcttttgttcgtaaatggtttggacccgttgatttgaaaaggcggtttgggtgaataaatttttgggattgttttgatcaccagatgaatcacgtggattgtagcgaccgtctgaactgatccccttggaaatggagtaggcaatcaaatgaccacgattgataattggctggcggtcgacaaacttttgatgccaagcagtcggctcaacatattggcgcacacggttttcatctgaagcaaggttacgagattccaaataagccaaattaccacggctggtccgattcagactatccaaattagcgtaacggacctcatttattttccatttggcgggatcgagattggctttgttgtgattcacataaacaaaggattgatcaccggaatgataattcagtttagcaagttcgtcattggaactgacgtttttcgtatgattaagcgtattttgcgaaatgttttgaatgaagttactgatatcactgggttggccgccgctaatcaaccagccaccgacgataacaatcagggcaatgataatgccctgcaatgaacgggtctgctttttccgtcttcgcttgctcatgtttttccctctaatcgttagtagtgtccgctatcaaagataccagaaataactggattacgaaagcggtttgggaaagaaagaagggagattgctgggataattaccattttgactgactgctttttgtttaatcgcgataattaccgagcggaaatacggaaagcaagcaacttacggccacgtaaccaaattatccaactgttcaaacctggaatatctggttgaactttttacttagtagaaaacgtggcccagcaagcagcccccggccatataagtcccctaaccttaatattccaaaatcaggaatatcaaggttaggggacttatattctgggggctaaccgcttgctgggccactctgtttacttgacattctcctccaaaaatgcactaatcacggtactgattttgtcgtatgtcgcttgggttggatgtaataaattatcaccaaaaatggtgttgttaattgttgctgggacaatatcgggagcttcagtccgccagtccagatatttaacaccgttttgagcataaacttgggcttctgcggtgcataattcacctaatgtgtagtcatgatagccggttgtattgtaagcatctgtttcctgatcggtgccaaaggatgtgacatagcagtcaagtggcagaataccgaacaattgtaatgaaggatattttgctttgatggctttaatttgctcatcgagaacttgtttaacgtcatcaagggatgaatggaaataatcattaacgccataagcaattgttgcgatgtcataatggctgaaatcagtttggcttactatctgagttaaatccaaatcggtatcacccacaactttaccgttattttcaccaaggttggtatccttgaccatcagttggctgccgacttgttgaggataaggagcggtcgcgtaacttgagccggtccaacctttggtaattgagtcacctagactaaccattgtcatttgggtgaggtttttggcgtaaatccaaccggctacggaaggtttgcgggcaaccttcacgtaataatactgcagaccgtttttgagggttgcctgtttcgttgccagtaacgatcgggacgagtaattgcgtagccaatgtgtttttttcgcagccttattggaacggtagggatagttccagaaagccgttttagttttataattgatcgctttcattcgtaaatcaacgctcttggtggtcgcaattcgatacattggatcaactttagcggcattaccggttatcgtctgactgaattgaactgcaaaaaagctaagcgccaaaagtagcagtaacttaatttgatgattaaaattagctttcattaaaaatggccttctttaaaaagtaattaaccggatagacatcggtattagatgatttaatgtgtgttgaaccttaaattaagttatttttgtatacatgattcatcaacgaacgggtttcggtaaattcgtttgcatcatgcagaacaaccgtgataatgcgattgtggccggacttcttgccggttccgacgaaacagtaaccggctagatcagtgaagccagtctttaagccgtctacttttaatgaggactggtaatatttgcggcccggcaacaggttgttatagttgtagcaccgttgacccgcaacctttaatgaaccaattttggcgtaagttaaaacgctggggtgatcagcaatcagatgtttggcaattaaagcgacgtctttagctgaaactcggttggcattgccgccaggggttgaatatccataacctctgagggcgttttgctccatgccattagctgtaacaaaggttgctttaccaagtttccatgacttagcctgcttgttcattagtttaacaaattttcgattatactttggcgtggatccaccggctacccattgaccaagcgcaattgcggcactatttgaagaatcaatcaatgcagcttcgtataattgtttaactgtgtaatggttcttggtaaatttaaaattaccgtaaacggcggatcggccaagtgattttaatcctgaataagaagttgtcaccttacttttccaagtagctgacgtattagccaccttttgattgaccaagtataacgtcattaattttgaaacggatgcgattgctcttggggtgttcatgtttttgtgccagagaattttaccggttttagcatccattgcgactgccgctttagcatatttcaagccaaacggtgctttaccttttttcaaatagcgatgccaaacgtaccctttaacgttgttagtgctatttttaactttatagtaggttgatttagttttgccgtgttttaacgtgactttcttagtagcgtaccaggttgtgtaagggaacttttttaaagcatgtaatttctttgtatgatgaagattgaaaattgcaccctttgatgatgcgcgatgatacgctgtcgatttaactttggttgtcttgacaacttggtaacctgctgcattggcattgattggctgatgaccaatcaagccgccgatgccaaacgtgacggcgattcccattaagtataataatcgatgttgacccatgactttcataatttagctccctaattttgatattgtttcgaataatgactcacgcagtctatcctaccgctaaaaggttacactgagattactatgatggtcatttagtttacaagatgattaaggaatacagagtgggccagcaagcggttagaccccagaatataagccccctaacttgatattcccgattttggaaaatcaagttagggggcttatatggccggggtctgcttgctggcccacgtttcgtctaggtagccagcccctaaacccatattcccgaatttggaatgtgggttcattttgcttatatggccggggtctgcttctgattccacgtttcgtctaggtagccggcccctaaccttgatattccaaaatcgggaatatttctttggactttttatttaaccgaaacgtggtcaaacaggcagcccccggccatataaataggcccaatcaatattcccaagttcaggaatattgattgggcctatttatattctgggggctaaccgcctgttggaccactctggtttttaaggcaaatcatttccagcagagaaataaagatcataccattcctgtttagtcaggttgatatccgcaccagcggcactgtccttaatatgctcaggattcatcgttcccaacagaacttggaccttggctggatgtcttaaaatccacgctgtcgcaatggcgttctttgaagcatggtactttgttcccagctcttctaatttcttgttaagttccggatattttggatcgttgatgtacatgccggcaaataacccgtagttaaatggtgaccaagcttggattgtcatgtgttttcggcgagcatattccaagataccaccatcatgatcaactgaggcatcatcaatcatattgacatggagaccaccacggatcatgcctgaatgaaccacgttaaattgcagttggttgatgagcagtcgttggttaatccatgattgaaccatttcaacttgttgtgggttgaagtttgacacaccgaagtggcgaactttaccttcacgttgcagggtatcaaacgcatcggcgatgtcagcttcttccattaaaggatctggtcgatgaagtaagaacgaatcgagataatcaattcccattcgttccagaattccgtcaaccgaatcaattaaatgctgctttgaaaagtcatatctggcaccaaaaacgaggccgtcatgactgcgtttagggtcaaggataataccaccctttgattgaatgaacaatttatctcgggaaataccggaagctttcaatgcttctttgaatttggtttctgaattaccaccttggtaaatgtcagcggaatcaatgtagttaattcccgcgttaacagcggcttcaagcgctttggccgcatcttcagtgctaagatcacccattcgcataatgccaagggcgacttgagatgcttcgaagttggtgttaccgatcttgattgtcttcataaagtaaggaacctcctttgttattaacttccattataatacagaacttggtgagaatgatttgaaaaggattcctcggaaaattcaatcattaattcgcatatgatatactttggctaagaataagacgatctgacttaatcgtgaagaaatgaggaacccaattgagcgaaacgacaattactgaattgattaatcagtatggttatttaggaattgcctttttaattgcatttgaaaatatttttccaccgattccctcagaactagtgttggtttttactggctacttgactttaaccagtaaattgacaatctttggtgcaattatcgcggcaacaattggggcttttattggtgcagttgcgctgtatggggtcggtcggctgctgagtgtgacccaacttgaaaaattagtttcgggacgactgggaagaattctcagattaaaagcttcagatattgaaaaagccagccgctattttaatcaacatggtgcggccgcaattttaattggccgttgtattccggtggttagaagtttgatttcgattccggcggggatgaccagctacccatttcaccgatttagcgggctaacgattttagggaccttcgtgtggaacacagttttaattctaattggccattttgcggggcgggcgtggtcgcagatgttggcaatggtcgatcagtggttaattgtaattttagttgttgtcattgtgatcgtggcttgtttgctttatgtcaagtttaaaaataaacggaactgataagatggtttctgcttcattatccaacttagctaagacggagttgaagtgtcccacaattactagacaagaagtctaatgattatggggctttttttacggtcgtggcacatctttttaataaatcgggctttctgacaaaattgtcagattgatcgacaaaatatcagatttaaaagaataaaaggcgctaagctaaagagtgaagttagttaaattgtgatcaattggctgatgttagcatttattgatcatcatgatagaaactcggggatctttggttctcgaccaagaaaggatgagcaatgtgttgaaaagaactttatcattgattatgaatgcatcttttagcgttggaatcgttatcattattgcggcttatccaattctaggaaaaaatacgattggaaaaccgggaatgtggcttgcagttttgacgtgttttctagtcgatattgttgttattggattctcattaataactaaaagcggattattggcaaatctctatcagggaatcagtttgcttgtttatctgataatgattggtatcgcaatactggttctatctgggggactacagatcctcagcattctacttggaatgttgggcatcctcaacagtggcgggtatctgctaatctttatgaagccgcagttctcttaaaattttagtttcctttttggtaaaatagacattatttagagtgattgagaattagtagcaatgggggcattgaaatgaataaagtattaattattgaagataatcgaatcattgctgagcaaatgcaatttggtctgaataaacgggggttgaagtgctatattgccgatgacttcaataatattattaaggaagctcattttgttaatcctgacattattttgatggatctttatttgccagtttatgacggttattattggacgcaaagactccgtgaatattcaacagtaccaattatttttgtctcatctgcagaagaaaagttaaatacagttgctgcaattagtactggagctgatgactttattgaaaagccgtttgacctagatgttctaaatagtaaaattcaatcttggcttcgacgaacctatcgatttgatcaggcaagtagctatcgtcaattcaatggctatcacttggatttaacccatgatactgtcgcattgggtgatgccaaaatgaatttgactgcgcatgaaacaattattttacagaccctattcgagaatcaaggacaagttgtttcaaaaaggattttaatgaccgcactttggaataatgatcggtttgtcgacgagaatgccttgcaagcggctttggtcaggttgcgaagaaaagtggctgccattaagttagatcactttttgataaccaaaaaaggggatggttatttcttgggagatgttcaagaaaactaattcaacgttttaagatatttattgggtctttagcttttataaagaatgttaaccgattttgaatgataatttgatgctgaaaaaattgtttaaatgtttccattgatcacattttatacataaccatttcatactttgttcacacattaagtttcctgttttgttataattataagtgcaactataaggataaggtaatttaaacaataaggaggaagtggatggaatgggtcaatcaaacggcggaagtcattcttgagagacttgagacgagtcgacttactggattaagtgaccaacaggcaactacccgtctggaacgatatggaccaaatcaattgcaacaaacagaacgtgagcccgcatggcggatgtttctaaaaagttttaaagaaccactcatcatcgtcttgctgattgcaacaacactggctttagcaagtgctttgtatgattttaatgtgactggtgatcgtcaacacgccatggcgtcggtttatgaggcagtggcgatcctattgattgtggcgattaacggtggtctgacgttttatcagactcgctcagcgcaaaagtcactggatgctttggccaatttacgccaacatcatatgacggtcttgcgtggtcaaacttggaaatccttagctgccactaagttggttcctggcgacatcgtcagtgttaaagcaggcgactttattgagggcgatctgcggtggctgaaggcttctgaacttcaaatcaacgagtcacatctaaccggggaatctgatgcaattaccaaaacagttgatccactggcggctgacactgaacttggtgatcaaaccaatatgggcttttccgggtcgatggtcgttaatggtaacgggattggcgttgtggttgcaaccggcatgcaaactgaacttggtaaaatttctggtctcatgcaggggatcgatgatcaaaagacaccgattgaaaaatcagtccatagtttaagtaaaaagttgctgataattgctgcagggatcatcttattgacaatcggttacgatttagtgaaacagttgattgaaaccggtgcaatcgcaattgacagtcttgccggcatttcttcgacagccattgccattgcggtggcttcaattccagacgcaatgccggttgtcctctcgattgttttaacaattggggccaagatgctggctgatagtaagggattggttaaatcgctaagcagtgtcgaaactcttggcgcaacgacgtatattgcttctgacaagacgggaacgttgacgaaaaatgaaatgacggtcacccgatttctggcaaatggtgagaattatcgggttgaaggaaacgggtatacaccagttggtgactttttaagaacggatggcaaaccgggtcaacctgatgattatcaacgtttcttagaagtagcagtgttaaataatgaagccgaaattaaaccggatgatcaacaaaattggcggccatttgggaatccaactgatgtttctttagttgtcttggcagctaaacagggagttaagcgtgatgccttactcgagaagtctggggaccacgacattgatattattcgagtcatcccgtttgacagtacccgaaaaatgatgacggtggtcattaaggaagatgacaaatattatagtttgacaaagggtgcgccggatgtggttgccttgagaaccacgcacgtgttgcttggcggccatgtagctgatattagtaacgctcaagatcatattgatcaaaccatcttggattttgccggtgatgcattacgaacgattgccattacccaaagagaagtgactgaaaaacaagctttagaggcaaccagtgaagaactggaacgcgagctatgttttcttggggtagttggtattattgacccgccacgtgaagaagtcaaagcgtcaattaagaagttaacggccgcctcagtgaacgttgtgatgatcactggtgaccatgacgtgactgccaaagcgattgccaagcagcttgggattattcaatcggataacgcccgggtaattgtcgggcgaaccctagaaaagatgagcgatgaggacttggcaaaagtcgttatggataccaatgtctatgcccgggtaacgcctgaacataagcaacgaattgtgaaacaactgcaaaaacacaagcaggttgttgcaatgactggtgatggcattaacgatgcaccagcattgaaagcagctgatattgggatcgccatgggaattaacggcaccgaggtaactaaagacgccgccaatttgattttactggatgataaatttacaacgattgagaaatcggtagaatctgggcgaaccattttttcaaatattttaaatttcatgcgtcatgagctgaccaccaatgtcgctgaagttctctcattactgctgggcgttttcttgattacggcaccaatcgggcaagtaacggcggtgacgccaacattaacagccctgatggtgctttgggtaaacatgattagcgactcactaccatcatttgcgttgggatatgatcgaccagaatctgatctcatgaaacagcaaccacgaaatacgcagcaatcaattttggcaaacgggatgctgaggcgcgtcttggttcgtggcggtgtgatgggcggtttagtctttgttgcctttgtttgggcagcatcgcaaggctttagtgttgcccaaagtcagacgattgcctttctaaccttagtttttggtcagttatggcatgtctacgatgcgcgaagtgccaacacactttttgatcggaacccatttagcaactcacgattgacactagcggttgggtttgcggcaacgtcttcaattttggtaacgttaattccgttttttaatcacgttatgggaacggcatcgttatcgatggggttatatgctgggattatcgtgatttcggcaattccaacgtttgtcttgtcaggaattaagaaattagtcaagaggggcggtcgacaacggcgtgattgggatgttgccgaggaagagtaagaaaatttaaaacgataactcaaataggctgcggtatattgaatgtgtaccgacagcctatttgggacgtctcgttattagattgtctaaatgattactttaaatattccgcaaagttgcgaacatttttctggacaaaatcggtttgagaaatatccaatcctgtgccagtataaatgttttgaatcagcgcatgacctaaaatcaaagtaatataattcgcagcagtaatgtcgacgttaaccagctcgttgatttctcccgagcgcttcatctctgtcattcgggatatcaatattttcttgagcttcattggtaattgaatgatcatttcttttaattttgggaactgaaacgaatcccgcatcccaattaaaaatagcgctttatgggtttcaacgaattgattgtatatctcggcaacctgcatcaggtcactcacaatatcaccgcttgcgatgaatcccgcgttggctgtatcaatatcgctcatatatttttgcaccagctccttaacaagttgttctttatccttaaagtgacgaaataaggtactctcgttgacgccagcagcttgcgcaatcttctttgtggttgtttccgtgtaaccattttcctcaagcagtttggaaaaagcattcagaattttttcatccgttgttaatttttgggccattatcagcaaccttacctttcaaaatcgacttgttaagcccattatatccgattaacttaattgatgaaaatcaagaatgggctgatgctttctgaaggtaacgattacgatattcagtatcaaaatgccaaatgacaaaagaatcagttgcccccaatacataccggtttgattaccgccaaacataatattaaagtctgattgaacgctgtaaaacattggggacatataatgagctgccttgaaaaacaaattgagcgttattaacgggatcattccagcacctgaaacaacttgaatcatcgttaggaagatatttaaggcggttccaatttgacccagcaataatactaaaatcaaattgaaattaagtgatgcgaagatttccaagccgtgattcagccacagattgataaactgtgaacctcccagccccataaagccggcaatgctccatgatgtaaatagtgacccgatgatggctaacaagacggctgctatttccaagaatgagaatgatttaaaccgaccaattattggtgcaaacttggcatacgtaccataaaggagcaacgccccaattaaggttccaagataaacggcaatgtttgcaataaacggtgccagtgcatgattcattccagtcttaaccgggtggactcgaacaaagttggttccgacagaacgatcaacattttgatacgcattggacactcggttgcgaatcccgctggcttgttgattaacctgtgtttcgagcttttgttttgctgccaattcctgctgctttaggagtgcttccagtcttggctgctgagcgcggggggcctgtgcaatctgctgttttttcgcctgcaatcgattttgaagttgagcctgtttggtttgagctgttttttccaagctcgtcattggtgcttttgctaacatcgccttccctttttcaatgatgacttgttgattaacagtattgccaatattttgagaaactgttttcaatgcactcacttgcgaatatggggtggcttcatcaatataaaaattcaaattagttggagaattactggtgacttttgatttgaagtttttcggaatttcaataatcatagctgacttcttgtgatgtaattgtgttttagctgttgatagactggatacttccttgatatgtttaaatggcagtgctttttcaacttgattcgctaacgttttggtattcttatttcgattaaccaccgttacggttaattcatcagcgtgtttaggcattgcttgatacccggtaaagtatattgtaaaaattaaacaaccatataaaattgaaacaattgttgctaagataaccccacgactcgtcaaaaatttttttagattcattttgatcatgcctactttctttattcaatgccagaagtatagcagtgtttttaaatgcatgcaagtacttgcatgcatttaactgatcaaaaaaggactgggacaataatcgccttgcccagtctctgttagtgtaaacacgattgttaccaaacaaaaaggcaacttccagtcgtgtcaccgaattatccagttattcaagtccggaatagcttgttgccctttttatttagctaaaacgtagcccagcaaacagtccattttacgtttacggttttaagtgcgccgctaacagcagcatcattggccgccgcagttcatcccgcatttcctgactatcggctaacattttatccgttggagttggttcgataaccctgtctaattcgaatccatgatcgagtaatgtattgatatatgttgtcagtgttcgatgatattttttaatcggaaagccaagaaagtcggttgtcctttgaccttccgcaaaataatggtcaactggccagtattggtgtttgccggttgggtcatcaacccattcttcgttaccttgagccgtgaagatgggatgttcaacgctcatgatgagttgaccgttgggtttcaattgattgtgaatttgttgaatcagtccggcatagtcttgaatataatgaattgccaaggagctaatgatgacatcgaatttagatttaagttgattaattgccagcatgtccatcacacgataggtaatgttggtttgctgagtcatggatttagcttttgcgatcattttcgctgaggcatcgatgccaacaacttgtgcggcaccgtgatcggccgcgtaccgacaatgccaaccataaccacagccaagatccaaaacggttttattagtaaaatttggaaacagcttgcggagttcatgccattctcctgccgcattcagcccatatttggaacgtggcatattactgtatgtcttaaaaaatgagtcatcatcataaatatctgtcattgaaaaatctccttatattgttaaaacacgcatttatatgaatttttaggcgttcccttgagtatccgtgccactcaagtgttcaaaaaatagtcggtgtcttttagcaaatgtatcaattaataagtcgaccatcacgaataataggataatcgatgtgattagtatgcctaagtgaatcatgcccatctgagacattggtgcggtaccggttaggtcaagcaggtaaatatcggctccaaagacgccgccgatgacaccgtaagcaaaaaagtttcgaagaataagttgataccaatttgcacggccaccatgtttattgatcacattaattttaacgagtcgcatcccaagagttttctgaaaaatcatttctgctaataaaataaaaatcaaccataaaatgggtgttatcagccggttcacagacgatgatttaatcattaagtcaaatggtacggaaacgatactaataattatccagtcaacagccagggctgccaagcgacggaaggccgaaacgttttggctctttgccattgttcttcgccggacactttcctgagttggaagaatcccgcttaagccgtttgccagcccaacgccgagccagccgcccagcgtgtttaacattaaatcatcaacgtcaaacaatcgataaggccgcggatagatgccatatagtccagttaattgagtgatttcaaagaataacgacaaaccaaaactgatcaagaccgtttgtttccaagttcgacggaaataatagtggagataaaagccaaacggaacggttagcaaaatgttaaatgcgggttgaatcacagtaggtgcttttaacgctgctaaccaagtgccgggatggcgtaatgcgaatggattatatttgaaaaattccaagataaatgtaaatggtataaagttatgagtaggtgttgttaaatgggcaacaaagctccgggatggcaatgggagaattgttaaaaaataagcacacatcatatagaagacaaatgtgtacagcataaaaatacgccattttggtaacgctccgtaacgatgataattaactactaagatgggcaacgtaatgaaaatggcaataattggaaaaataatggcggttgtgtaaatgacaaggatgtattgagacatctaactaaccaactttctagattttaatatcaataattttgatcttgtaattaagatctggcgcactaactgacacaatatcaccggagtggtggttgagcagcgcggaaccgatcggcgaggcaattgaaattttgtcgtgatcaatgtcgacttcgggagtcccgacaatctgataggtttgagtggcatgatcatcaagaaattcaaatgtgacgtatttaccaacttccacggtatcgttattggaaggtgtgtaaatttgggcatactgaagttgtttccgtaaaaaccgaagtcggctttccaaatgacgtaaatctcttttggcagcactgtactcggcgttttctgaaagatctcccagtgcccgagcgtcagccagtatctttattcgacgtggtcgtgagtcttctaaatcacggatttcggttttaattttttcgtagccggccttagtaattttattaaaatgaactgccatgctgattcctccccactcaattgaattcgcttctaattctataacattgccggttccagaccaaatggtttcaaccaaattgtagtaaaggaattgatgtttcattagttgtaatcgaaattagctccaaatattaccagatgtaacataaggtttaacacgtctgtaattttctagtcacacctctgtaaatacaatagcgtagtatctttgctgttgagtaaatacggaggagaaaatttttcatgaattttaaaaaattaattgttgttttaatgagtgccttgactttatatggcacagtcaatgttgccgcaaccccagaaatcgcagatgcaagcacaactaaagtatacaaatcaaatctatcaaaggctaatctagctgccaagaaatggattgccttccatgaatcacgaggctcataccatgctcgaaatggtcgttacgttggtcgttatcaattaagctcatcatacttacatggtgactactcaaagggtaaccaagaaaaaactgctgatcattacgttaaagcacgttacggtagttgggttaatgctaagaaacattggaaagcatacggctggtactaaattaaaggatcttggttatcagttagagactaggtagtgtgttgagtcatgctattttatacataattatttcaaataagtaagaacgataagcggtctggattaaattttgtccaagctgctttttttattgtcaacatatagacacatagataccagaagtgattgctgacgagataatggtttggaaaagccgaacattctgtcttgattcataactaagtcagaaggtgttgtcagagaataacacgtgtctgtattcggtctgcagttcagtattccagggcactaaggttaagcctttgttgaataggaatgcgtgaaagaagagtagtcatcagctctaaagcccgcctaaggtaacttgcaaattttcttaggttattgacattctcagagttaatcctgttttttcacgctctgccattgttaatgaatcttattcgtgttaatataatttcattgatttaaacacgaataaaagggagaatatcatgaataatgtttctgtttcggacaagaaatcaccagttcgcaatgcgattttaggctttcaacatttgctcgccatgtattccggtgatattctggtgccattattgatcggtgcagcgcttaagttcaatgctgttcagatgacttacttagtatcaatggatatttttatgtgtggtgttgccacgttacttcaaattcggagaacaccaattactgggattggattgccggttgttttgggttgtgcggttgagtacgttgcgccacttcagtcagttggtaagaatttcggattagggtatatgtatggcggcattattgttgccggactgtttattatcttggttgcgaagccatttgcccacttacggaagtattttccacttgttgtgacgggttcattgattactttaattgggttcacgttaatgccggttgcttttcaaaatatcggtggtggggatacagctgctaaagcctttggtaacccaactcatttatttttaggcttctttactgcattagttattattgtattgaatatttgggccaaaggcttccttaaacaaatttcaattttgattggaatcttagttggaacgatcactgcgattgctatgggaacaattgattttgcggctgttggtcaagcgcattgggctcaattgccacaattcttctatttttctgcgccaaagtttgagtggtcttcgattgcaacgttaattctggcggccttaacctgtatgattgagtcaactggtgtctactttgcgttaagtgatattactgggcgtaagctagaagatcgtgatttggagcatgggtatcgttcagaaggaattgctgcaattcttggcggtgtctttaacactttcccatattcgacattctctcaaaacgttggaattgtgcaattgtccggtatcaaaacattaaccccgatttactactcagctttcatgttaatgattttaggcttaattccaaagtttggcgctattgcaacgttaatcccatcatctgtattgggtggtgcgatgttagtgatgtttggaatggttggtgcccaaggaattaaaatgttgtccaaggtcgagttgaataacaaaaacttgttaattattgcaatttcggttggtttgggaattggggtaacaacccaaccaagcctattccaatatttaccagcaagtgttcaggtcattatgagtaacggaatggtagttggaagttttacggcggttattttaaacattcttctaaatcacacgggattgagggaacgggtggaagaagaatagagagtgtgccaataagcgtttagctcccagaatataattaataaaagccaatattcctggttttggaatattggcttttattgattatatggccgggagctgcttgttggtgcacgtttcggcacggctgatacacaccctttccgttaaatgctccacgcaatcaaaaagtcgagattaggacagaagttaatttgtcctaatctcgacttttaatttgatgtatcggattattcagtaattgttctaagtgttaatttaggctatctctttggcgtgtattgatcaacaacgtcagagataatatccagcaaatcgttaacaggctcagattgttgtttagtcttgatgtatgaaataccaaagtcagctgttattttatcggttgggatcttcacgatattaacatgtttcttttgctcatctgacatgtatttatcttcagcaaacggctctggtgtcacaattgcgccaacgtggttaagagctaggtcagatgctaggtggatatcagggacttcaatgctgaattcagctgaaattcccaaatcacttaagtagttcgtaactagtcgttggtaattatcacgctgcggggtgctgatgaatgattcaccggttaaacgagctaattcatcttcgttatagtcaacatacaattgaccttccttaaacacctttgaagattcaggaatcacaaagacaagcggtagtttagcgattggcacgtactcaactttggggctttgtagcggatgaccaacgaagaaatcaagggatcctgataggaggcgcttttcggcatctcggctgttcattcggataatttgagcatgaatattcggatattttttatagaagcgaattaacaccggccgataaacgtcgtcggttacaatttcgttggatgcaattgttaaatgaccatatttgaattgtgaaaggtgcgtcatttcacgatccaaatttgcccggagacggttttcgtcttgcaggtataccaataggcgttcaccagcgtaagtgagttgaattggatgtgatgatcggtcaatcaaacgaacaccgaagttgacttcggcattttttattactcgactgatataaggttgggtaacaaaaagtgcttgggcagcttttgacatatttccttgggccttaatttcttcaagaaatgaaagtagtttactgttcataatactattctcctttaagattctctcttagtttaattgtttagttatcataccgattataagatattctgccctaatgtgcattcatattgacttatacaccgtctaattatgagcaaaaagtcatcattaagtatatcaattcagaacttggtagtaaagggtatacatatatatagttgatcattaaaacaattcttaataattagaaaacaattaccatatggtactatcataaaattgtgaattaagtggcaacaaaatatgaaaaaagtatgttcggggttaaaataaaggtacaattttgattggagacatgtgtttagggggtacttttatgagaatcgaacaatcaccggaatttcaaattcacttgcaaaatttgagacataaggaaccattatatttggaaacaatttataacgtcggcaatggtcatttgggagtgcgggattctaatccattgcaaggaaacaatctcgactatattgggtcaccagggctttttgtgaatggcttttttgattataatgatgtctcgtatggtgaaaaatatacgggatatcctgagaatgatcaagtcattaaccggctctgtgatccaagatatattcgaatcaagatagctgatgaagattcggcaactgatcatttccaggttgacaatattgacaagaatttagacatgcaaaccggtctacttcatgaaatatttagtgttacgactcctgaaaatcgtaactttaatttagttattgaaagttttgccagcttaagcaaacaaaatgtttatggcattaaatattcaattattccaacaaattttgatgaggaggtcgaaatcattaaagttcatgactatattaatcagcagactcaccaacaaaatgaagatgttcgggttaaccaaagtgtgggtcagatgcaacttgattttattcatgataatggccaaccaagttatttggtcactacttttcgaagtcagcagggactgattttaacttatcaagctggtgaaaataagctacctgatccaccgattgaatattttatggatgaagacagacattatggctatcatagtaagtattttgccaaacggggcagtcagaaggaattttccttcttatttgcagtaggggatattcacccgctggttaacgcccagatgtattcagatcaatacgtgtcggcacttgacaactatatccgtgatacgacttttcggtcggaattaatggcttcagctcaggtctggcagacattttggttgcatagtgacgtggtaatagatggggatcctgccattcaacagtcattgagatttaacctgtttgaactgaatcaatcagctgggcgtgatgagtacaccagcattcctgccaagggcttgaccggcaacggctatggtggtcatttcttttgggataccgagattttcatgatgccatttttctcttatacgcagccgaaacttgctaagaagttgttaatgtttcgatatcataccctgcaaattgctaaggaacaggccagtgaattcggcttaaaaaagggtgcaatgtatgcttggcgaacaattaacggttatgagtccagctcatactggcttgcaggtatggcgcaatttcatattaatgccgacattgccttttcagtcgaacaatattatacgattacgggtgatgaagaattcctcaaaaagtatgggtacgaaattattttggagacggcccgtttttggatgcaatatggtaattttgcggaaattaatgggaagcagcattttgtcattaataaggtgacagggccggacgaatatagtgccttggttgataataattactatacaaacgtgatggcacaatttaatctgcgcttggctgtcaaatatgcgacccaattcagcaatgatgatatcttgagccagttgaatgtttcggggaaagaaatcgatcaaatgaaggaagccgctgatctgatgtacctgccatttgataaggaaaagaatattaaaattcagtaccaggattttgaacagttaccccgaatggatattagtaaggttgatcaaagtaaattcccactgttactgcattaccatccattaatgctatatcgctatcaagtcaataagcaggctgacacaattatggctgatattctgttcccacttgggaatcctattgaggaattgaaagctgattatgaattttatgaaccgattacaactcatgattcaagcctctcgaaggcgatgtatgccatcgcggcatcgagagtgggcaagcaccggcaatcttatgatttcttttcacaggctgttaaaacggatttgatgaattcgcatcataacactcaaaatggaatccacgcgggcagcttgggagcggcctggatgggtgttgtgtatggctttgcgggcattgtcaataatgccaagcactttagtttggaaccgaagttaccatcggcgtggaacagcattaagtttaagttgcgcctgcatggtaatgaatgcttatttacaatttatcaggatgaggtccagattgaactgatgagtggtaagggcattgaggtctatgtgtataacaagcgggtaaaggtggagccggagaattcgaagatggtgtgtgaatattagagtgcaaaaagggacggttagcccccagaatataaggcacttcaaccaatatccctgattttaagggatattggttgaagtgccttatatggccgggggctgcccctcttttgcacgtttcggaacagtaaccattcctgtttttggaatgttggcttttattagttatatggccgggagctgcttgttggtgcacgttttgacatggcagccgtccctggtcttgaggggtattggttgaagtgccataaatggccgggagctgtccctcttttgcacgtttcgacatacaatcacttctgatttttaaattcggcccttaagtgacatggtcaagaaccctgtggtgggcaccctttaacttaaagccagagtaacggacaattattgaacaatattttagatgcttttggcgcaaaaagattaagctttcaggcgcaattttgaaaaaaagcgacactttcgtttattatttgttatgatagtgttatgcaattattgagtaagtcatggatatttaaacaaaggtgaagctcaattcgagtggtcatcggccatgaacagctctttcttgacaacgaactcctagcgaaggggatgcaatcttcaaatgaaaaaagaagcgcgccaatctaaaattgaacagattattaatcagtatacaattacgactcaagatgagttaatgtcaaagctcaaggtagctggaattaacgtcacgcaggcgactttgtctcgcgatattcgtgagatgcagatcgtcaagcaacctgatagttctggtaattcgagatatatgatttttaaatctggtaatcaaaatgagctggaacggctttatcgaatgattaatggcaccgtgaccgatattcgccaaattcaatttgttaacgtcattcatactcagtcgagttatgcaaatcctctagccgctgtgattgacgacctaaatatggacgatgtggcaggtacgttagccggctatgatacgatagtaattttcagcccgtcagtcgatgcggctagagacttgaatgatttgtttaccaaacatgcaaatccagatattcttgtatcttcaattaaggacaattaatttttaagcttacgttgcgttgggttaccatcatcaaataaaataatgcccagtacctgagtgtcaatcattcaggtgccgggcatttttatatcatttaggaattgaaataaagaattgtgattaattcgtgaatagtttatgaacattcaaggcgctactattaaaaaaattagaacaaattatgaactatatgaacaaaatacgataatatcaactcgaaggcgttctaattaaattcttatcttttaattaaccacagtctaaatgtataaagattcaaaaatagtgtttaaaatgcaacttacgtgttgtaagattgataatatgcaattgcagtcaccattatgctaataatgttaaaaaatccgcatttttaatgctaaaaatcacacgataatctttttgaaaagggctaagatatagttatattcaagtaagggataggaggtaacatcaatgacaagtccaattcataactattcagaaatcggcaaattaaagacggtcctacttaaacgtccaggcagggaagttgaaaactttacgccggaaatgatgccgaggctgctttttgatgacattccatatttgccaatggcgcaaaaggaacatgattactttgctgagacacttcgagataatggtgtcgaaacactttatcttgaaaaattatctgcggaagcactagatgcgggtggttcggaattacgcgatcactttttggagcaaatgttagccgagtcaggttatccttatggggcaactcatgatgcgttgaaggaatatcttgatagtatgagcaatcaggacatgataattaaaatcatggcgggtgttcgtaaaaatgagattgattttcatcctagcgacttagtcagtgcagccgaaacggaagattatccgttttacctggatccgatgcctaatctttactttactcgcgacccgtctgcttgtatcggtgaaggaatcagcattaatcacatgacatttccagctcggcagcgtgagtcattgtttaatgaaatgattattaactatcacccaagatttgcgaataagggaattcatgtttggcgtgatcgtaatcataacacccgaattgagggtggtgacgagctggttctaaatgatcacgtcatggcaattggtgtttctgagcgaacatctgctcatgcgattcaagatattgcccgtagcctatttaaaaatagtcagtatgataccgttttggcagttagcattccccacaaccatgcgatgatgcatttggacactgtatttacgatggttaactatgatcagttcacggttcatccgggaattctcggtgaaggtggcaaaattgatacctggacgatcacacccgggaaaggcgaaagtggtctgcaacttcaacatcgaactgatttaaaggcagttttaaaagatgttctgaatttagatgatatcgatttaatccctactggtggcggtgatccaattatcgctgaccgtgagcagtggaacgatggctcaaacacgctgacaattgcccctggggttgtggtaacttataaccgaaattacgtctcaaatgaattactgagaaaacacgggttaaaagtgctggaagtgatttcgagtgaattatctcggggacgtggcggcccacgttgcatgagttgtccaattgttcgtgaagatttataaaagcgctaataattaatactaaaatatccaaatatgaggagaacgattatgacaaacgattttaagcaaaatgtctttcaaggacgtagcgtactggctgaaaaagattttacggctgctgaattagaatatttagttgattttggcttacacttaaaagctttgaaaaaagctggaattccacatcattatctagagggaaaaaatattgcgttactgtttgaaaagtcgtctaccagaacgcgatccgcgtttacaactgctgcaattgatctgggtgcccatcctgagtatttaggtcaaaatgacattcagttaggtaaaaaagaaagtacttccgatacagctaaggtgttggggagtatgtttgacggaattgaatttagaggatttaagcagagcgatgctgaaatcttggcccgtgacagcggcgttccagtttggaatggcctaactgacgaatggcatccaactcaaatgctggctgactttatgacaattaaggaaaatttcggtaagattaaaggcttaactctgacgtttatgggcgatgggcggaataacgtggctcattcattattagtaacgggtgcgatcttaggggttaacgttcatattgtgtcaccaaaggttttgttccctagtgacgagattcaaaatcttgctaaaaaatttgcggctaaatctggtgctgaattattgattaccgatgacctggatgaaggcatgaagggatctaacattgtttatactgatgtttgggtttcgatgggtgaaaataattggaagcaacgaattgatgaattattaccataccaagttaatatggctgctttgaagaagactgggacaccgaacgatcaattaattttcatgcattgcttacctgcatttcataatacagatacgcaatatggaaaagaaattaaggaaaaatatggtttgagtgagatggaagtcactgatgaggtctttacgagtaaatatgggcgtcaatttgaggaggctgaaaaccgaatgcactcaattaaggcaatgatggcagcaaccttgggaaatttgtttatcccgcgagtgtaaaaaagagtgggccaacaagcggttagctcccagaatataaggcacctcaccgaatattctggttttgaatatttggtgaggtgccttatatggccgggagctgcttgttggcccacggttttagtcaagtaacttataaaaaatgaactagaataaataaaagactgttaattgattaaatttaaagggtcggcggcaaacaccatctgtctgcccccggccctttggattcagaaaagagagtgaggaaatcacgatgggaagaaaaatagttgtcgcgttaggaggtaacgcgatcctttcaaaagatgcttctgctgctgcacaacaacgggcgctacttgagacggccagacagttagttaagtttattgaaaatggcgatcagctcattatttcccatggtaacggccctcaagtgggaaatctgttgttacagcaggcggctggtagtacccaagataatccggagatgccacttgattcttgtgttgcaatgactcagggaacaattggttattggatgcagaatgcgatgaatcaagtgattcgggaacggggattagaccaggccgttgcgacggtggtgactcaagtggaggttagttccgatgatccggcgtttggtcaacctaccaagccgattggcccattcatgaacaaagctgaagctgatttagctcaaaaacaaaatcctgaattcaaatttatagaggacgctggtcgtggttaccggcgagttgtcccgtcgcccaaaccaataggagtcattgaaacggctgcagttaatacattggttgatgctgggattgtcccaatcactgttggtggcgggggcattccagttgttcgggatggcaatcgattagtcggtaaggaagcggtaattgacaaggactttgccagcgagaagttggcagagttgatagacgcagatgcgctgatcattttaacggctgttgataatatttacgtgaattttaatcaacccaatcagaagaaactgaagcgggtttcgaccgttgaattaggccgatacattgagcaaaaacaatttgcaccagggagtatgctgcccaaagtggaagcggcagttgattttgttaacacaacgggaaaagaagcggtcgtgacggctctggataatatcgaaggctttatcaaagaaggggaaggaacggtgattgtaaaacagagtgtgtcaacaagcgtttagctcccagaatataaagcatttcagctaatatccttggtttagggatattagctgaaatgctttatatggccgggagttgcttgttggcacacgtttcggcaaggtagccattccagtttttggaatccgggctttagtagtttgtatggtcggaatctggttattggcacatgttttggcatggtagccatttgagatttctggaggtattgatatggcttgctcttatatggtggagatctgctgattgtccccaatttaacatggtagttatttaaaaatcacgaaccaaatgtcttaaaaattcgactcttatttagccgtcattcatagaacgattaggcgcgcaacgtgtctaaaatctctaactgcggtacacttttattgaagcgtctttaagggacatctgaaaagatttaagcaaagctgtttttgagcttaatgtcagtgattagtcaggtagtttcttctatatttgaagcgtaggggggatgatcggtgaatgattttaaaagataaaagtgattaccaaatgtatcgtgataaaattcgtagccatcccgagtttaaatcattagacgatgagggcatccacaaattaattgatgcgatgatcattaaaaagtatcatcgcggacaaattttatttgatcaaggcgatccacgagacaactattactttattattggtggggttgtgaaaacatttcattgggatgaaaatggtgaggagcagttatatttgtacattcggccaaacaaggcgttcccttatattggcctttttgaagatgacgattatgcgtacactgttgaaacgatgaccgaagtcaagttggcagtcattccaatggatttttatgaaggtctattacaggaaaatccggaaatgatggtgagtgctatcaaagaaatgagtcgaatgattgatatgacggagactcagcttcagcgaatggtaacgaccagtgccaaatgccgcgtctggaatgcaatctggtttttaggtcagcaaattggtgatcgccaagaagatggcagtattttaatttcgtatccgattacgctaattgaattatcaaagattagtggaactactcgagaaacgactagtcagatggtgcaacagcttattaatgaaagcaaaatttggtatcaaagaaaatattttcgaatattggaggttcgcgatgggaaagcgttgtgattgggctgattctggtaatcaggcacttcgagattatcatgaccaggaatggggatttccgacaactgatgagcgacaaacctatgagctcatgattttagagatgatgcaggccgggttaagctggcaaacggttttgaacaagcgggcagcttttcgaaaggcgttcaagaattttgatgtgaatcaagttgccaaatttggtcaatcggaatatgaagggttattggtaaaccctgggataatccgaaatcggcttaaaattcgagcagcgattaataatgcacagctgttggtttcgtggcatcaaagaggtgagtcacttaatcggtatttatggaaaatggttaataatcaaccagtaattggccattacgattctctaaaggacgttcccgcaacgtcgccattatcggttaagattagtaaagatttaaagaaaaaaggctttcggtttattgggccaacaattgtttattcgtggttgcaggcactaggcatcctgaatgatcatcttaaatcgtgtccgagttactttcaggcaattagcgcggctgagtcacttgattttgattcataaatcagtgataatgatgggtattgaactgccaagatcagttaaagatgactgatttgatattttagaggtagttcctgcacactttagaaagtaggaaaaataaaaatatgaagcaactattctttgattttgatgggacgattgctgattctgaggttggcattgttaaatcgattaagtattttattaataaaatgggtctgcctgagctgactgatgatcaatacaggcagtttatcgggccggcgttggtgacgagcattcataaattctatccgcatttatcggagaatgacgtttcaactgccttgaaatattaccaggaatactatgaagatgctggcatttttcagttggatatttacccagggatccttgaagagttgggtgttctaaaaaacgcggggtatcatttgcatattgcatcagctaagcctgaggatatgattaatttaattagtgatcacttcgacttgggacactactttgatggtgagtttggcgcaaccagcgacgagcgaacccggatcacgaagactgcagttttaaaatatgctttagaaaagactggtgccaatcataaagacagcgtcatgattggtgatcgggacaccgatatgattggcggctatgaaaatcaggtcaagacattgggcgtgacttatggctttggggatgtcccggaactttctcaagcgcatgcgagtctaatagttaatcagcctgacgaaattcgacggggtgttgaacaattaagtgtccgaaaagcttcaggtgctaggtttaactaacaagtatcattaaccacatgttgttcaaacaaattatctacaacatggcttcgattattatcaaaaacaatgaaaacgagtgggccaaggcaaataaacaaattttgtcttggtccactcgttttaaattgcagttgcgattgaaccggcggatggcagaatagttttctgtctatttgaatgttgagccatttttgtggatgtaatgatgggcaaccgagcctaaaagtgcgaaagagccgcagcttccggccatataagtcccccaagccaatattccaaagtcaggaatattggtggcgtttaaggcacccgagcctaaacgtgcgaaagagccgcagcttccggccatataagtttcccaagccaatattccaaagtcaggaatattggtggtgtttggggcaaccgagcctaaacgtgcaaaagagccgcagcttccggccatataagcccttccaaccaatattctaaaaacaagaatattggttggaagggcttatattctggaagctaatcgcggctttttgcactctctacggtttcacatacgcaaacccttgctcctgcaaggcaattaggtcgaccactcccgctgggacaatttccacattctccggcagctggttcgcttttacaccatggctgttcatcgcattgttgcacgcgtgaaattggacaccttgttcagttaagcttttaatagcgattcgaatgtttgcaacaaggtaccccatgattgcattgccatttaccaggatgacaatttgatatgacatttgctgagctttggcataactgattaagtttttgacgtttcctaaggcatgttcccattttcctaattcatcaatatgaaaaacaacttgatgcataggctagtcctcctttgataactcaccgtcatctaaagcttcaataaaagcactatagtcacggtgaacttgtttggcgtaagcggtagcccacgttacaaggtcgctggcaagcttcttctttttgccaacataaccctgaacaattgcggcagtcgggctttgagcatgccctcgagctaaaagcagtgcacaaatttgggcgtaggttttaaaatcgtcttcgtccatcttttctaaattcattgattctttcatgtcccagaattggcgaacatagaagcttcggccagtgtcagcattgtgataataaccaagcaatggatcagatgcccgttgaagaacctgctgacacgtcacaattcgctcaccattatcaggaccgttctggctgtattgcgttgtgacatcgaatccttgaagacgtcgggttggtaaagcttcctttatttgaagaactaagtggctgccatcaatggctgttagaagcactaagtaacaacgggttccgaagctgccaacgcccacactatgacgaacaatatcgctgatatgaaattgagaaagtaataaggcaacgtctggactaaccgtttgattatatttttgtaagtggtctgagatttgtttgaatcggatatctgagacatgaactgtccgtggtgcgttttctttgaagacaaggtgaccacggttatcaattgtggtaaattttttcacgactttatcagaatttcgttgttcggcactatcacgaattttgcgccaaatctttggcaggtccttatcatccgcttcggtcttcaagaaagtttcaacttcagtagaaaaatagtagcgttccatcgctgaatgatcattgaagcattcagcgaggatctgttgataagtttgaattgctgattttaaaaccccgtcaattgtttcagcttttaagttattttgttcaccagtgaggataatgctgaccagtagtcggcgaacgtcccaatcccaagagccgatagtcgcttcgtcaaaatcattgaggtcgaataataatttgcgctcgggagatgcataaaagccgaagttgccaatgtgcgcatcacctgaaataatcaccggaatattactggaaacttgtttggataaatcataagccattaattcatcggttccccgaaaaaacgaaaagggtgaagcagctaatcgcttatgacgtaacggtagtaattcggaaatgagtttactttcaacgtgttggatgccggatacaacatcccgatcgattggtttaaaatcagctaattgttcgaaaggaatcttttcgcggatgttcttgcccatttgaatgagctcgttaactgatttatcaattttgatttgactaaggtcatagcgaagatttgaggttgaattacgaggtaataagtcttttttcgtagacatagatgatatcctttcagttttttagtatagtgtaacgcaaaacaaagttgtcttggtggaaatgtgcggtgtaagttgacttccgtgaatctaatggtcttccaatatcggtgttatataacggtttgttggcacagtctgtcgacacatggtacaattaatacaatgtacttatcgagttttttggagatcgaggtttatggaaaaaatatattgggaaagtatcgaagtcaatcaccgaaaatttttctttacggtaactagcaaaggattgagctttgtgtccagtccgggccgctatctatcggagatttttgaattttatccaaacaatcgctacaactatcagttcatgtatgatgaaaaagtgacgaatatttacttggatgaattaaccgagtactttaataaaaaaagaaaaagttttgatttgccactcgacttggcgaatattggcacagatcttcagcatcaagtctgggatgctatccagaaaattccttatggtgatacagtcacctacaaacaattggctgaaaatgttggcaaacccaaggccattcgtgcggttgccagcgcggttgccaggaacccaattttaattgtggtcccgtgtcatcgagttatccgtgcaagtggggaattaggggattatcgtgggggtaaagacatcaaaaaagagctgcttgatttcgaaaagcagcccgctgcaaaacaaactttaatcaagaagttacccttaccgcgacttagtcaattaggtagacctgatctttaattaaatcaaatggttgatgatgttcgttcaacttcttagcgctttctggtttaatgaagtgggcttggtcccaaaacttcattgaatccgtggcgccatttttttcgccaatgacgattagttcaatcttttgatcgctggctcgaacggcttctaaaacgtcactatcaatggtacttttatcaggggaccaactcataatgacgtagcgaacctgattttgatattttttgattgccgacacggcatctaatttttcaactttagtgacctgatgcttaccggtttgattttctgtgacccactcaagactgtcggttgggtaaaccgtgaccccggcgtcctgcaatcctttagaaatatagccgttacctgccattacctctaagacactgttagaaccgatgtaatcagccagacttttaatgaacggcgctgagatataagcccacatgccatattgatcctccagatagtcacggaagcaacgaagtcgtttatctaatttgggtaaggcgtcagtcagccgattccatagttggtcgcccttgggatcgtccttctcaaattgggagttaatcttcttaaaaatttgatcttgaatgtcgtcaggcaataacaattcgggtaaatcctgcggtaataagcctgatttgatcaggtggtcactttcaatgacgttattaatgagaaatttaacctgtggataatctgaaaataaatcgcgatcttgtagcatcttctggatataatctgactcagtcgatgttttgttttgcttgcgcttcttttttagcaattgttttttctgtttattagaaagcatgttaaacccctagttatatttgatatcaaaattcgattggaggatcaggtggttatttgccggtatctttaggcatccccaaatccaattcttcctgctggatctttggccctggctgtggctttcgacccgttttaccatggacataaccggaaattaattggtaaatttgataacgatcctgagagtcaagggtctcgccctcaaattgaatggtttgaccagagatgaacattttagccaaatcataaatactgctatcggttaatccggtcaggtaatccatcgtaaccccaaagaacttggctaatttttgaacttccacgtatgacggggttcttacaccacgttcccagttaccaatttgagatggcgtgttttcgtgatctttgtctgttgggaattgttggtttaaatcttgagctaactgaaccaacgtaatgtgcttgcctgtgcgtaacgctcttaatcgttctggaaacatgtaatcaccatcctgtctgttactttcattatactgcactttgaggattcgcaaaatgaatataacggatcgttggttaatgcgctgcttgatttattttggattgtggtaaaatagggcgactatcttttgcgtgatcagggtgagccaaaggccgattacttttcagaggacaattaaattatctaaatacgtttcgaatggaatagtaggtaatttgattgttcagtctttcgagtaacatcagagccggttcagcaagagatgagattaattattttaggtgggattaaaattatgaagaagcgcaataagattcttattgcctgtacatcggttgtagctgttatggcagctgggctttttggcgcaggcatgtatttctataaggtcgcggttgtaccggcacccaagtcgtttttaagtaaaccggaaaaaattaagcccggaaataaactttatcctgctcaggagtggtataagcatgtagaaaaacaacgttggcacgaaatttccgcaacccggcatttaaaattggatgcgaattatatcaaagcagctaagccgacgaaaaaaacgattgtgattgcacatggattcatgggtgataaagataagatgttttcttacgcttatttgttccataatcttggttataatgtcttacttcctgatgcgcgcggccatggagatagtcagggaaaatatattggttatggttggccggatcgattggactatgttaagtggattaagcaagtgattgcgaaaaatggtcaagattctaaaattgttatgtttggaaccagtatgggcggtgccacaacgatgatggtaagtggtgtcaaagatgttccgaagcaggtcaaagcatatattgaggactgtggctatacggatgtttatagtgaaattgcctatcaggcaaagcaattgtatcatttgccaaattggccactggtaaatatcgttagtatgattaccgatgtgaaggatggttattcattcaaagaagcaagtgcattaaaacaggtcaagaaaaataggcgaccaatgttgttcattcacggagcgcatgatcattttgtcccaacgagaatggtttatccattatataaagcggatcggggaccaaaacaattgttaatcgtcccaggcagaggccatgcaagatcgtatcagaaccatccggaattgtataccaagacggtgaagcaatttttggggaggtatttcaagtaaaagagtgtgaaatcaagcggttagatcccagaatataagccctctaaccaaatattccagattttggaatatttggttagagggcttatatggccgggatctgcttgatttcacacgtttcggctaggtagcaaatccatgaatcttccaggtttggggaatagcggttggcagggcttatatggccgggatctgcttgatttcacacgtttcggtcaggcaacaaagtattcccggctctggaatgtccaatcgtcaatagctttcgcatctacggatgtgttaaactaccattaggactgttttacgagaggaggtccctagttgatagttgtaattttaggggtaattgcctgtgtaattggcgccgttagtggtgttaagttgcaagaaaagcatcaccaaacagaaattaaaaacgcccgtgttcaggcggatgaattgattaaccgtgcaaatattaaggctcaggaaaaatcggacgaaattgtggctgatggtaaaaagcaagcaattgattaccagcaaacaattgacgaagagctcgatagttatcagaccgataatgttactcggcaaaatcggattgatcaacgtcaaaatgggttaaagcaaacggctaccagattagatcaatttcacaataacctttcaagtaagaaaaaagagcttgatgaattaaaaacagccattgaacattcaaatcagcaagctgatgacttaatgcagcagcgaaatgatcttttacaagagcgcagccgcttatcaagtgatcaagcgaaacagcagattttagaccaattgaagattaatttgaaccgtgaaaaggatatcgagttacgttttcaaaatgatgaggcagaagttaccgcacccaagatggctaagattatggcagttgacgccatccaacgggggcctgtcgatatgccgcgtgaacatattgaacatgatgttttgatttcagatattaacgttaagcaaaaattaattggcagggaagctgcaaatattcgttatattgaaacattaacgggaaccgaccttgtctttgatccagatgatgcacacttattacacgttgtaacgcaagatccgttacgtcgagaagttgcaaaaatggtcattacaaatttggttgttaccaagcagattaatgcacaatcaattgaacatcaagtggatgttgcccaacaggatcttatgaatgaattacgccgaaccggcgagcgagtggtttcttcattacacattggttggatgcatccagatttgattaagttagttggccgtttgaagtatcggacgagctacggtcaaaatgtgctaaatcactcgattgaagttgcggatattgccggtgtgatggctgctgaacttggtttgaatgttaaaattgccaaacgggctggtttacttcatgatatcggaaaagcaattgatcgcgaggttgacgggacccacgttgaactgggagttaaaattgctgaaacttacgatgaggatccacaagttgttaattcgatcgcttctcatcatggggatgttgatgtcacaactccaattgcttacttagttgccgctggcgattcaatttccgggggtcgtccaggtgctcgaagcgaatcggttgaagagtacgtgaaccgacttaagaatttggaaagaattgccagcagtcagaatggtgttaaggaaagctatgcaattcaggccggtcgtgagattcgaattgtcgttgatcctaaaaaagttgatgatgttcaaaatgctgaactcactcatcatgttaaggatcagattgaggatgaattaacttatcccggcaaaattaaagtaacatcaatccgtgattttaaagcaattgcctatgttggtgatgaaaaaaagaagcgtaaatttaaaaaacgtgcttaaatgagaacgagccgggagcggcaaacattttctatgttgttatcttggtagtaattctgatttaactaaagggagccagacaaaatattacttttgtctggctccctttagttagattattgaccactttgtgtaggcaataagatttttgatattcgattataaatagcaaaatagttacttcggaataatgttgaaattatgattatttgttgcttcgataactggatgtttttgtaaatacgccatgatgacttgactgattgtcatgtcacttgagcggacaatcttatctggggtatacatgggatagtgcccgccaccactggctcgatacctatttaatgtaatatatagggtttgatcatccctaatatctttgtcgtgatattttaatcgggtaacgcgttgaccgactggcttagagatatctaaggtgtaatcgattccttcatacatatcataattataaaaacgttctttgggaaacatgaattgttcattaacgattacttgaccatgcttgacgtcaaaatatttagcagtgacttctaaagcagcctttaaatcagctcccgaaatttttgaaacggccagcgtgttgggataaacataattggtaataatgttgcgcatggtaattggactttcaaacccgtgagcctcattattatacaaggcggttgccgaaatgtcggttcccatcttatccatttgaatcttttgaataaattcaataaaagcactctcttcaattcgagccttaaacggatcatcaaatgttaaattgcccttaatggttgaaagtgggcggtcaagccaatcctgtaagtgatctgcgagtggcctgattgttttggcaatttcctgatcgggttcgctgttgctaacgctgattaattcagaagtattacgtttaattgatttgtcctgattggatgtttcaaaagaaattttaccaacaaattcaccgcgtgaaccgggttgaataatcggtacattaaagagtcggctggcgatttttcggtgttgatgaccagagattaaggcatcaattcccttgatgttctttaaaatatcatagcctcgattttcgcctggattaatatcattccagttaccggtatgatcccgctcaaagccaccatgataaacgacaactaagatgtcgactttctttcggagctcaggaatgtatcgattgcacgcgtctagttcagactccagattaaaatcatttaaatcgttaacgttcttccatttcttagtactggtggttgttaaaccaaagaagccaactttaacgccgccaatttcgatgattgtgtaaggatcagctaaaaaggggttgttattatgatcaataatattggcacaaatgaattgacgatcggagtgttccatcataagggtcaggtagtccagaccgtagtcgaactcatgattaccgattgaaccaactgagtagccaacctcattgtaggcattgataaacgtttgccggtcttcatcattagcaagcttggccacaaaataagccattggtgacccctcgagaaagtcgccattatcaatgacgattactttttcatcgggatgcttttttatatagtttttaatggtgctgctcgctttttctatgccaaacggtttatcagaaccgcaatcgacatagtttgtgggttcaataaaaccatgtgtgtcactggtcgctagtagtgttattttcatttttttcacctacagaaaacaattatatcgtcaagtatagtcaattctgctcaaaatgtaaatgtatggggaatcgatcataaatcgttaatacaataggatgtgatttttaaattttgaggtaaggatgggtggaatttattaccatgtccaaacgtgcgaaagagccgcagcttccggccatataagtcccccaagccaatattccaaagtcaggaatattgatggtgtttgggcaaccgagtccaaacgtgcaaagagccgcagcatccggccatataagccctgcaaaccaatattcccaaatcaggaatattggtttgcagggcttatattctggaagctaaccgcggctttttgcactctctacccatttgtcacatacaccatctgatcagttgagatactctggttcaattgatcggagacttccctcgaaattgttttgtttctcagtgcatctgccacatatgaatactcgtactgaaatgcctcgatcagaagctgattttgacgatcgtttgaagcatctgaatcgtcgattctcatatggcgaaaattgtacccgtttttaacaaacgcgacagcagcactattgtctggcgtttcaatcttgtccaagtagtcgtttactcgttgataggtattgtcttcaatgattttacggaattgatcccgcttctgaataatttttcgattttgttcaggactaaaccgagccataaatgattgtctctttttggtagcaagacgtcgtttacggttaggaaggtgaatgagccaaaaatattttagtcgtttaaaaaagccacctgcattacttggtgttgttactagccgccgtgaaatcacgttggcgatttgctgaggaatttgaccatttgaaagtagatctaagacagtttggacttcgacttctcgcgtttgggataatatcgttttaatttgctgacgactagcagattgaccgctcttttggctggtcaacatgtcaatgacataatttcgatcaactaatggaatactttgcctatcctttactttagcgatactataattgaccatttcggttctgtgatgattaaaggtactctgatcccctttgttttttcgaggtagtaagtgtggcaacattagtgaaggaattatgagacttagcaaaatgacaattgtggcaacaaaaatgagttcacttctaaatggaaacccctgccgatacaatgttaatggtagggacagtgccatcgaaagcgtaatcgtaccatgaacaccgccaatcgcagttaaaaaagcttcctgattcgttgcggaatgattaccagtcttaacaaaattgcattttacccagaggaatcgaatgattgccattgccaaataaattgcgattccgattaaaaacagctcaacaattaattgatttgagtaaggaataatatgcacaataacgcttggcagcgtgacaccaagtaaaacaaacacaatcccgtttaaaagactggtcacaatattccaagtggcactggtgaccaaacggacgttggttgatgttaattttaggcgactctgattaatgccgtagataatgccggctgcgacgactgccaaaattccggagcagccaagtgtttcagaaattagatagatggcgaatggggtcatcaaactaaatggcacgatcacacttgaagtatccattgatcgttcaattaaaaacgtttgaagtcggacgaagcaaagtccggcaatcagtccaaccagcaagccaccaaaaaagctgataataaaacttgtgagtccttttgtaaatgaaaagtcgccagtaacaaatgagccaagggctaagttaaaaataacaatgccggatgcatcattaaatagagattcactttccaaaatttcggaaatgttttttgggagttcaactggttcggtgatagatttaaaagccatcgagtcggttggtgtaacaatggcagctagcgcgaaacataatgttaatggaattagtggcatcaaagcgtgggtgaggccgccgattaatactgctgtaataatcgctaaaaaaattgccattgaaaaaatatgcctaagggagcggccaaattgagctgaacttgtattacgaccgtcgttaaacatgagtggtgcaatgatcccgaccatgaagatttccggatacagcgaataattttgaaaaactggaaataacgataataagaggccacatccaatttggtaaaaggtcagtggtatctttggaaatccagtgtagataatgtttgaaataattgccgcaacgattaatagtgcgacagaataaaaaatttccacaaaaataatcccccagtattaaatatgtgtttggactgtaaaaaatattccaacaatattcatattataggttgtattcacttaaaaaagtagtacaattaatttcacaaacttaattataaaaagtaagtaaccgtattgacaaatcttagctgtatgttaatattgttgttgaaggatgttgttttagttttacttcttgtatgaactaggggggattgtaatgctgaacttatatgtagcacaaagtagcgcatcaagtaggaaagcacgtgcatggttgaagagccaccacattgattttaaggaaagaaatattaattccaatcctcttaatgccgatgaagtaaaacaaattttgcgtttaaccgaaaatggcagtgaagacatcatttctaccagatctaacgtttataagaagttgaaccttgatattgacaatttgtcagtatctcaactgattgatttggtagttaagtatcctgacttgattaagcgaccaattatttttgatgatcatcgactagaggttggttttaatgaagaagaaatccgtcgattccttccaagaagtgtccgtgaagctgaacttcgagagcttgaatcacaaattagttaatcaatttagataattaaacagttatacgtacaaattttgagaccgaagacatttattgcttcggtctcttttttgcttgtgaaattctttgaaatacaaacggcgagtaaggtttgaatttccttaatggataaaaaatcagaccgtttttttaataagctgaaccctttataccggattcactttatccggagatttttttaacacctaattcggtcagttgactagtaacatttatttagtagaccgttgatggttcttttttcgagttaaaagttggtaacatttggcattcattttatggccaaacttaaacctgcttgatacaaaaatacctagtaagacaattaacgaacctgatatgcccgtgctatcgacaagcgttattgcagacgctccgccaattgttgggaagaacaaaatcagccatgcaccccattcaattttcttttccagctgcatattaaccagccctttcgatttgttgcattcacagttagtgtagcgcattagggagaaaatttcactttcactgattaatgggggattgctaattattaacagttacccatttaattgtaatgatcattgttatttaaccagaacaaatgtacccatcacaaataatttgtttatgaatttgttatcaatacgaaacgcctattgtattatctctttaactttcctacaatgaagatatttatcagaagtgtcagagtaagaaaaggagctaactgcgctttttgtttctgactattggggattgcggtttgaaatgagcccgatgatcagtttttgatacttgttccgacatatttttaattaggggagattttaagatatgattaaaatggtggcgttagatttagatggtaccttattaactagtgacaagacaatttcaacaacaaacgaaaaaacgttgaaggatcttcataagaatggcgtcaaagttgttttgtgtacgggtcggccaattaacgcaatttggcattttatcgagcaacttggattaacagaggcaaccgactataccattacatttaatggtgcgttggttgttcataataatgacaaggctgaactggctaagagtggtgtttccaaacgggcattttcaccgttgcatgatttcgccaagtctgaaaatgcaccattagatattttggattttgagcaagtttattcaatgactgatttaaagccttcaatgtataaacaacagttcaagggcaacattaattttgtgccaactgcttttgaccagttgaattcaaatgatttgtattcaaaagccatcgtttgcgatcatccggaactgctggatcagtttcaaagtggcatcaactctactctacggagccaatatcatattgttcgttcccagccacagattatggagttcttagcgcctaagatggataaggtcgttggattaaaagcactcttacaacattttggttggcggtttaataatctgatggcgtttggagacgccgaaaatgacttagggatgattgaaaaagctgaagttggtgttgcgatggaaaatggtaaggatgaagttaaggcggttagcaatgccattacagttggcaatgatgaagatggcgttgcaaagtatatcaaacatttttttggttaaatgaacgagccggagttaaccgccttttgtctcacgtttcgactcggtaataatcgtgattacacaaatagggactgggacaaaattacttttgtcccagtcccatcttttatcagttaaatattattagtaatctgataattaattcttcttaaacaggccagttagatgttccataaaggcatttaggtaagcatcaacatcagcattaacagcaaccttcacgtttgtgttaggatctgacaaacgagccggatcgccggttgtccggccataataggttttatcagttgtcacatacatatttagaccaattgtttggacaaaatcaggattaatggcaacgccaacggcaaatggatcatgcagtgcgcaaccatgaaggtctggacttgtgacttcgtaagctttgatataatagtccacaatatcagcaaacgcatccccggacttagtgtgaagatcacgccactgttgggtttctttcttagttaataaggttcgcagggtaacatccaatccaacttgagtgagcggtactttgcggaaaacattgtcagcagctgaagcatcctgctgaatattagcttcagcaacgttggtaacatttccgggaacggtaacggcaccacccataatcgtcacattgccgatctctttagcgatttccggagcctttttgatggctgcgtctaaattggtcaatgggccagttggcacaaggatgaggtctttaccgtactttttaacggcatcgatgaagaaatcaatcccatctccggtttcgggttgacgttttggatcaggaagttgaacttcaccaattccattatcgccgtgaatttgagcactgatcggcatccgatcaaagtggtctgtttcagatgaatgagaaagtccttgatagactggtacgttagtgacacccaacagttccaaaatcttaagtgagttttgaacaccatcttctacgtaaacattgccataagaaccaatgatgccaattagatcaacgtctggatcagcaaccgcataagcaattgccattgcgtcatcaatcccggtatcaagatcaagaatcatttttttctgagccattaaaaattacctccgttaatgttgttatatcaataatgaaaaccctttacctaatcataaccgaaattgacgtgaaactcaattccaaatctaacttgaaaccggcaatcttgtaagttaaccttagagtatcaagacttaggagtaatttaaatgaaaaatagaacaaggagattgggcagaaactttttctcgctggtttggaccggtgtccgtcgaaattatgacaatttagatgataatattgccaaacgattgggcgaaacggatgctgataacccggttgaaattcatctatcgcgaatgttttccgaagtgtttcagcgacacacaaaagatcaggcagatcggttatttattgtgggaacccggacaaccacaccgagtttaaaaaaagtatccagtcggccggttaaaccatggtttttttcgcggatttttctggtcctggcaatgagttttgcaatgctcatgctattgttgtatattttcaaaagtaataaggcgattcccggactaatttttatcggttcgttggcagtcccgttttcactactgatgatgttttttgaaattaatgtttatcaaaatatttcggtgctacagatgctgacaaccttcttgatgggtgggattttgtcgctgttggtgacaatgacattttacatgatgctgccaattcgaacctcggtcagcattgagtcggcactgattgtcggggtggttgaggaattagcaaaatgtgttgtgataattatttttattaattcgtataaactcaattacatctttaatggcgtcttaattggggcggcaattggggccggcttttcagtgtttgaaagttcgggttatgttagtgaatatgggttggcaacaattttcaccaggagctttcaggcaattggaacgcacacaatttgggcagcaattatgggtggtgcgatcattctcggtaaaacccggaagaagccgtttgtgcttaaagactttttcactaggcctaaattttatgtgttctttttaattgtgattgcacttcacacattttgggattgggatattcccaatactggtttggaagtctcactgcttcaagaagcgattgatgtcgtgatcggctggtttctgatttttatcatgattgatgccggcttgcgtgaagtcaagacacttcaggggcaacaaattattattcatcgcaaaaagaaaaaagaaattaagaaacgttaggaggccctttcatggctgagacagattcaagttatgatattacgattattggtggcggacccgcagggatgtttgccgggttctacgctggattaagaaacgcgaagactcagattatcgaaagtttgtcggaattaggtggtcaggtagctgcactatatccggaaaagacgattttggatgttggcggctatccacagattaaggcgagacagttagtcgatcaattggagaagcagcttcaagacgctaagacgactgttaaattaaaccaaacggtaattgatgtgtctaaagacgaaaatggttaccaagtgacgactaacaaagggacaaccacaaccaagggaattatcattgctactggtgttggggcgtttaatcctcgtaaattagcggttaagaatagtgatgattttgaggggaaaagtcttttttacagcgtgaagaacctggcccaatttaaggataaaacggttttagttgctggtgggggtgatgcggccattgatgaagcactcctgttgaagtcagttgctaaaaaggtttatttgctgcatcggcgtgataaattccgggcaatggagagtagcgttgataaattaattcagtcggcgattgaaccggtcacgccgtatcttattaatgggttgacccaactggataacggtcaagtaaaggttgaagttaagaagatgaagactgatgacatgaaggatttagttgtcgataaaatcgtggtcaactatgggtttatcgctcaggatgatgctttgaataagtggacgaatcatccggaaacaagtcggggaacgattaatgtcacggcgagtggcttaacggatctggacaatgtgtatgcaattggggatgtttcaaagtatgaaggaaagcagcctttaattgcaacagcgtttggggaggcaccaattgcggtaaatgccattatgaagcacatttatccggacagacgtgggccggtgcatagtacatcaatgcagagtgcaaaaagccgcggttagcttccagaatataaagcacttaggcgatatccctggtctggggatatcgcctaagtgccttatatggccggaagctgcggctcttttgcacgtttcagccaaatagaatcagcgatttgcagttgaaaagaagacaagctggtgccttatatggcccaaacatgcggtccaaataagcgagccaactaaaagcggggctggacaaaaacaatttgtctcagtctctttttgtggtatcacaattattaccgagtggaaacgtgagaaaaaatcaacccttacaatctggaagctaagcattttttacctcactttactattttgaaactttatgttgcttatgtttccttcccgattccctttgtcgggtttgttcaggccccaaactcttttgcaattggctaacctgtttggaaagttgtgagacttgttttgataaatgccgtaaggtttctttttgctcatcctggctatcttctttagtgaagaagtcagtaattgtagaagttaacaaacctagaaaaccgatgccgccgagcatcaaaacagcagcgacaatcttaccgccgtctgtcttgggggtgacatcaccgtaaccaacagttgttgcagtggtaatggcccaccaaagtgaattttcaagtgagtcatgttcgaatgaggcgaataacagtgaactgaagatgagaatcaccagactaattgatagtaagtaaataaagccggtgtcatacaagaaacgatgaagggactgggtgagctttcccgaccagccgagtttccaaagcagattgtaataccggataattgcgacaattcttgcaatccggaagaagatgaaaatggggtgggaaggaatcaatgcaattaagtcaaataagttggaaatcaggaaatctttcttggatttagcagacataaatctgaccagataatcgatcagaaagaatccccaaattaacataaaagtccatctgaaagggccactgtgaatggtaattgtgccaaccagatcaaaaattgccaaggcaaatgaagcaagtgccaacgtgacaaccagcaagttataaaacaaaattattaatttttggatgtcttgatcgaatcgatccatattgtcatccccgtttaacgtttactgtcgttattggcatctggattggtaatcttgattcggttggaatcagttgacttatgatgaatttcaggcgcgtcagtcttgtaatctttttcggtattaccttctttagaatacaaactggttgacttcttaccccttttggcaatgattcgtttttctttttcgtattcatctgcgtaattatatttacggggatcaacactttcaaatcctttagggtggtaaaagcgcagcaggtttttttcgttgagtgaatcggatagcgatagttcttcagtgacccgatccttatctttcttgacctgggcttgctgtcgcttagtaagtttcattaattgaccggttcgattggaataaatatcgccgctaactgatgtgaaacttgggctgacccaatcctggtttctaaaggcaacaacttgatcatgttgcttagagaaaatatcggttccaaattgaacataccgttttgtacttaatcctaacaaatgcatgatcgttggtaaaacatcgatttcgccagcgtatttctttgaaacgtaaccgtctttgcgaccgggaaggttaatcataaatggtacccgttgaagctgggcgttatcgtaatcatcccaggtgtctggatcacgattcagggctttagccaagttcttattttcagaatcagaaatgccataatggtcgccatacaaaataatcattgaattctttaataaaccggtttttcggagataattgtagaattcatggacagcttgatcgagataatgagcggttaggaagtaattatcaacgaccttatcttgagtgtcagttgtcttgaaattagtatcttccttatcaagatcatagggaaaatggttcgtgacggtaatatattttgcgtaaaatggctgttgaagggcctgaaggtatttaaccgaatctctgaataatagtttgtccttcaaaccataacccaacgagcgatctcccgaggtgtcatagtaactggcatcaaagaagtactgataacccatatttttataaacgttatttcggttccagaagctggcgatgttaccatgaaaaacagcactggtataattgcgccgttgtttaagaattgccggagcggcctgaaaggtattgtcactgccaagctgggcaaatagagagccttgtggcaagccgtacgtactggtttccaacatgttttcagcatcggatgttttaccttgaccaacttggtgaaaaaagttcttaaacgcgtaggttgagtgactgcggtaaagcttgtttaggaatggggtgacttcacggccattaattttttgaccgattaaaaattgctggaaactttccaaatgaagaataatgacgttcttacctttagcaatgccatagtattttttattaggttttgcgtaatgtttatgggtgaatttgaggacgtcgtttaactcggatttggtagcagttgcccgcatgtcgttgttatgctgggacttaatcccgtcgtaaaccgtaaaggcgtcaagacccaagtatttgacaatgtaggtccggtcaaaagtccgggtaagcaattgtggccgatccatttcacctaatgatagattaaccgcgaaaaacaagagtgaaaaggaggtgactgccaagccgattcgccggtttagcggtcgacgatcaattttaattttgcgggtaaccaataggccgataataacgactaaatcaatccaataaatgatatcatgaatattggttagtgctagggaactgccactaagtccctggttgactttggaatacccggtcattgtgctgaccgtcataaaatcagtaaactcccgaaagtaaatgacgtttaaataaagtaaaacagtatttgcaatagcgatcaggagcgcaaccgggtaaaagattcggctgcttttaaagtaaagggcgattcccagtagtaaacaagtggttgccaggggattaataagaacgataaagaattgaaatgggttggtgattcccagtcgaaagtcaacaaaataggcgaccatcgtttttacccagaaacaaatcacgagtaaaaccaagaatccccgacgggtgctgcatttttcaagaattgagttaacgtatttcaaaacgacgactccttgtagtatgactgtttagaatggtttagactaatcgatgaatcaaagttgttggtcatttgacttggattagaagtctcggtattgatttgatcagtcagtcctcgcacacttttattatcatatcagataaatttgaagaataatctaaagttaagggattttgtgcgaatcttaaaagacacttgcgaataacccaacttttacatttggaatacgatggatttggtatactaaaactattaaaagcaaaggatgtggcgttatgagtaaatttacattgtacatggttcgacatggacagacttatttcaacatctacaataagcttcagggatggagtaattcgccgttaacgaagaagggtgttcaaaatgctgttgacactggtgaaaagttaaaaaatacaaggttcgctgctgcttattgtagcgatacgacgcgtgcggagcaaactgctcaaatgattttggataagaacgttgtttcggatgtcaaagagccgattgttgcgccatattttcgcgaagaattctacggttactatgagggaaatgatatggaccaggcttggtatttggcgggggctcctcatggtttgccaacttttaaggatattgttgagaaatattcgattggtaaagctaaggattatttaaaggaagcggatccgtttcaccaagcggaaaataatgaggaatattggcagcggttggatcaaggatttgatttaattaagcgtaatgacaagattaaggatggcgacaatgttttgctgattagtcatggtaatacgttgttgagtgttgtcgaacgatatggtgaggggcaatttgacattacaaagcgtccggcgaatggttcgattacaaagttggaaattgatggtgacagggtgagagtgacggcgtttggaaagtagcagagtgtgaaaagccgcggttagcttccagaatataagcccttccaaccaatattcccggttttggaatattggttggaagggcttatatggcggggagctgcggctctttcacacgtttcggccagataaaaattccagacagttcctgtcctcgtattagtcatgtttttatacgtttcgcccagattcatttagatattaaacaaagtaggtaaaatactcgtggaatttaaaaaatcaactcaactagatacaatttatcatgatgcacgaacaattcgccgccatgtctttgtcgaagaacagggaattgctgaaaaactggaatttgatggtagtgacaacggggcaacattttttgttgcgtatgaaaatggtcgaccagttgcaacggctcgagcaaccgccacggcggccggcgttcatatccagcgggttgcaacggaaaaagctgtccgccatcggggatatgcaaaacaattattacaatatttattggccgattctcagtttaaggggacaaagcgattttacttgggtgcccaggaaacagctgttggattttatgaaacgctggggtttaaagtgtttggaaaaccgttcattgaagttggcatcaagcatgttaatatggaaaaagtgattagataagttatctataagtccgtttgcctcatcttaaatgattgggtaaacgggcttttcctgtattacagcgtctaaaagtgacaattttgcgaaagagttgtgatgattttgagaaggtttttgaggggccttaaaacatttccacgtgtcttgtaatctacagatatcattatttttctgatattcgcaaggaggcctttacaaaatatgaagaaatcattagttgccattttcatgaccgccacgttagtctcttctattgcagcaggcgaagttagacatgacacgactgttaacgcgagttcaaaaacgtatcatctcaccaaccatagtcaaacatttaaaaacgaaaagacttatcaccctaatcaggccaaccccaaagtttatcgtgcaacccttcacgacgatggtgagacggtaagttacacccctaagacgacgttaaatgtcggcgaaacttatcacgtgctccggaaaacagcggtgaaagatcattcaaacaagattgcaatgttcctatatattgctgaaaaagcgggatgggtaaagagtaaccagcttgatgaaggtatcggttagctaaccgatttgaatattgaaataattgcaacttgtaatcgatgccatccccaatgaatagtgaatgctgacgcgaatgataagcaccaagttcccacgtaaacggctaagataccaagtgagggatgttgaatggttaaggactttccaaatgacagccaaagaagctgatcccaaaagacgttcgataggaatgctttataagcgaagttggcaaataaatgaaccaggttagtcatgtaatggtgacgatcgatttggtacctggcaatcgcggcaattaataagatagctgacaagtcataaatcaacatggatggcttgtagtagggtgcgttggttagcttaacgggaaattgaaatgcaaatagttcttggttggtccagtaaaaactgattaaaagtgccaggatcaatagtggccaccaacgtttgagccaatagttaaaccaacggcgaaattgccaagccagggtgccaaaaacgccgaaaataataaagcttaaaaagaaccggtccagtaaataccaatcgtgcatgtgtgggccgtgaaaaacttgccggtcatagaacaacagccagctgacagcaatgacggttgttaaagcagccattgtgatcccacgacgcgggcttttaacgctaaaatgaccaatttcccaaaataccggcatcagcacgataaattgcagcatcattgtgttgtaccataaatgaggcgcggcgttaccatttataaattgccagcaaaattctgccaaatggtgatagtgactgacctgttgcagccagggcataacgagcaggtaaatacttgtccaccagattgtcggaacaaaggaagcgtgccattgctttcgaagataatgagcatatgtaatgtcactgttaattgtggtccgggtagttgtgtaaagaatgccgaagatgaaggccggtgccgtaaatttaaccaggttgtaggtgatcccgatccgcatctgggtttttattgtcggattagtctgcagacacaggctaagaatggtttggagcatgactgccgtacaagcaatcaattttaagtaatcaccgatatctgccgattcatttgaaagatcattttggtttgtcacaatatcactcgattctatctaaattaggcatggttatattgtaagagaaaacgactgttggttgcaacgggctgcttatcgggagctacctttatctcacgatttcactttgttatagtcgtgatgatacaaaaatggctgagacaaaagtaatcttgtctcagccatttttgtgatagttaaattgagttgttgattgtaaattatgtgttaattaatcttgatcaaaatcggtaacgtgagcaccgccaacgtaatgccaccatggggccttgacattttcagtaatgacgccacgattttgagcatcgatcattttaccattaccaacataaaagccaacatgtgaaatggcagaagcgtttgaaccaaagaatactaaatcgcccttttgaaggttactatatgaaaccttcttagctgcattgtattgtgcttgagcagttcgtggaattgaaattgaagcaccttttttgtaaacgtagcttgtaaagccagaacaatcaaatgatgaaggaccagtagcaccccaaacatatggtttgccaaggttttgcttagcgacgttatacacagcagaataatcaggatcagcatctgctttggatgcttgagcattcacaaatccgccagtcaataatgagaaaaatgcaactaatgtcaaaagaactttattatgtaatttcatgcttttcaacaactccctatcaaatttacaaagataatcttaacaattgtatattgcaggactgtgacaaacaatttgcaatgcagttaaaagcaaattatggcatgaaacattgtacgcaatcgtttgaaatggcggcttgtaaacgttagcctcaaggcttttatttgtgcgtacaaataaagaataattgatatatttgagacattttaaattgaaataaaagcaaaataacggattttgatgggaaaactaccgatttttgacttgtaaagttacaatgcctttacaaaatcttatgaattttggctaaaatcaagtttgaaactttgaaaatagtcgcaaattaacaactaaattgagaaaaaatgttcaaattcaagtgctggtatcccagagagaactgaatgttaaatgcagtttcggtttagttgaatcagacaatcaaacttaactgcgtgtgatcctggatcctattgagtgaaaaagtgagtcaaaaaggcggtcggtttccaaattctgaggaaaccggccgcctttttgatcttgattctaaggttattgcgacagttatattgcctttcagctactgtacactatttattctttaatagattctttttgttgggaagcgtgattgccaatttgcccattgatgatacgatcatcggcagaataagataataaacacagccggtaaagataacaatgagggcaatttcaatcattgcataagaggcaccaaaggttaacgcaactgcgagagcaacgacaaccagcataatgtagcgcatcatctgtccccagctagccattgttggtctgatccattccagcaaagatagttctgtgtacctaaatgacagccccaatgcgataatctgccaagcagccacagccgttaaaatggccacagcaatcaatggcacttgccagtcaaactgtttaataccagcaacaaaatgcatcgttaagtaagtcagttgaaaaccggtaatggcggacataatgaaggcaaccgtccaatacaacggttgtaaaattgagcggctgacagcgaaaacagtgagtaaaacgccagcaatcaaaagaattagtaaggttccaaaatgatggttcatctttgactggttaatcgattgaatcatgggctcacctgtaaaagcaacttttgcctttgataagggtgtgcctcttagttgtaaactaacctggttttgcaacttagtcatttgtttaagattggatttacttgaaggtgcatttttaaggacaacttggattgtcgtaatctttttatccttactggtgtaatttaacatggtttgcaaaaaatcggtatcggataattgggcttttgtaatgtaataaacgttagctgcacctgatttttgcagcccattcaggtaatcgtaaatgccattcaattggttggttgacgaatcgacttggttgctgaccttttttagctgcttttgaacagcactaatttgttgactgtaactttgtaaattattgtagctgttttgaccgtagttttggatgacatttccttctgaggccaattgtcccagtccagatgagacggattgaagtgattggttcagtgcgttgatttgacgttggtaactttgaacccgccttgaggcatttttttggactgatatgtttgaattagctgcggcactgttaacctgtgaagcaaggttgctgctatcccggataatctgattacttcgctggactaattttgccatatctttaacttgttgttttagagcagctaagttgagcgactttgagttggtctggataccatttgaagcttgagataactggcccgtggcttgtttagtgctaacaccaatagcggccagttggtttgatacgtagtacttatcaattggcatgccaccaggttgggttaatgaataaacggcgctaaccccttgggtatgttgcagcttattggttaacgcatcaatgtgttgcagatacttttcgttatcaagtggctgattactctttaaataaatggttaccggggtcgctttaccttgagaaaagtgggcttgaagaacacgagcccctttagtcgcttgattggtttccgttaagttggtcattggtgaaaagttcaaactattgtggtagaaatagataaatggcagagtaatatataaaacgactaagaaactagcgatcggctgccataatgagaaatcagttgcccgcgtccagtaatgggaaacaagtggcttggttggtgcactggttggccaaaaaatactttcacctaaagcagccgtgaagaccggattcaaagtcagggtaaccagtatcagaacagggtaggtaatggccaaggcccatagagattgaatttgatcaaaattaataaaaccacagagtgcaaaaataatggttaaggcaccgccaaccacgatgattggaaatcgcagatcggcaatcgtttgtttagtggcgtagcgtgattctttttgtagggcaatcacattacgtaattttcgataaatataaatattccaaattgttcccatgaccagtgtcgcaatgccgatctcaatgggaacgtattgggagaatggcaacttaaagtgttgggcaagcaacgttgagagactataagaagttacgaaggcgataaacaggttgataaaagaaataagcggcgctaagacagctcggaaataaatcccgataatcaataccgaggcaataaaaagggtaactaacactaattgggttacttgagctgttttttgattattaacgtcacggacaatctcgggacttgtgacgtaagatttaagccctttaaccttaacttggccaactaattgattcactaaaacgcgcaaggtgttggtcttagcatcaatatccagtgaaatcatctgagttgagccatctttagatagcagttgcgcctggccggcaacattggtacttggtgtaacaattcgtttaatgctgtaaagtgactgctgttttttaagactgtcgattgctttactaatcttttgctgctgttgcgttgtcagtttaccattcggattatgataaacgacagtcactgttgaggtatttcctaagtcgtagccccactgttgacgtagctgatcagctttagccggttgggagttcgtggaaaatgttggttggctatatgattgcagtgtattagtaatatttggagcggaaataattgcaataaagacgacaatcagccatactaacagcgtgaatatccggtttttgtgtaattttgtaatagtttctttcattttccctagtcccctaatatgtatagaagcaaattattttaaataattgcaaattaaaaaagcctttatagtaaaagtttatcatttattgcgggttttaatgaccgaatttctaaagtttttaaaaaaagttagggtgttgtgaattttttgatcattgcgattaaaaattggggcaaaagagtctcttaccatggaccgaagtgagattcaaaaattgtttttcggagtgggcaagataaggaaacattgaatcagtaagtgaagtgacatgcttatttaacaaaagggggatcttatgtgtactagtatttttcaaattggccagattgatggcgcacacgttttagctcgaacaatggattggccgcgattgggagctcgacccgttttttgtccacgtcagtttaagtggcagtcgatttatgataatcatacttatacaaccaaatacgcgctgctgggttccggcggtcagcatgatcatgaaattgatgtgtcggatggggttaacgagcatggtttggctgtccaaaagcttacctttacaaatggcagtcagctggttgaagaacctggagagggaaagatccatctagccccatttgaattatctttctttctattgtctaattaccgatccgtgcaggaaattatcgatcacattgaagagattgaattaatggcggacaaacatagtctggttaaatatggtcacagtgagttgcactttgccgcgtgtgatcgaaccggccgaattgtggtcgttgaaccaatcacaacgccaattgagattattgaaaatccacttggtgtcttgaccaatagtaatcattttgaacgtcaaattgacagactcaataagtatttagattttacgccagcatttgccaaccatagggtgcctttaaatacaccccgggtaacaactggtaacgtgtcaggaaaatcgattccgccaggttcttattcacctggttcaaggtttattagagctgcttatttgaaagaacgcattgatttgccaaataatgaaatcgaagcggttgataattgttggcacttgcttgattctgttaatgtcccgaagagtagtgcgcatcaacccacatattccgtttaccgagcggcagtttgttgtgaaagtcgaaactattattatcagccctatcacgcaaaatcagtggttaaaattcagctgacagatgaaatgatcacgtgggatcacccaaagttttttgatgttcctgatgaaacacggtttattgaactggtataagaatgagagtgggacgaaaggcggcaggaagttgccttttggcgctcgttttcactcggtaataatcatgattacacaaaacggggctggataaaattacttttgcctcagcctctaagaatgtgataaatgagttgaatctaatccattaattggaagataatgagtgtattaaatgaattgaaaatggtgattaaatcagttatgcggaaaaagacttggccagttattttaatattattgatcacaatttgcgtcattggcagtgggtttgtggttagaaattatttgggcttgcagttaggaaattcaattaatgctgtgaaatcaaaaccttcggcgtcaggaacaccatctgttcgacaggaaaatacgtttattaatgaaatggccacgccggcaattaaattatatcgaaggaaccgccaagtcctacccagtgtggtgattgctcaggcttgcctagagtctaattttgggacatcgcagttgtatcgggatgctaataatatttttggtgttaagggaacttattatgggcaatcagtgtcgtttagtaccagagaggttgaagggggcaggtctgttatggttatggcgcagtttagaaaatatccgaacgtcaatgcggcaatgattgatcataatcgactggtaaccaacaaattcattactaaaaagaatattatgagctatcgtcaatctgcaagtatgttacaggaaaatggctacgcaacggatcccggttacgctaaaaaattggagcggattattgttaagtatcatttgagcagttttgatttaaaggcaatcaatgattagcgtgcgagcattgattgcttttttagcatgataatttctaatcgactgttcatcgatccaggttatttgcgtgatcatatgtaggtgaaaaatgttttaactggatagtgattcagatacagcgagatatactgaatttactgtgcattgaacgtcattaagtatgggataataaatagtaagaatagaggaaataaggcatgtttcagatttggttgttagttttagcattgattctttttacgcgtaatgtggttcattttaaaaagatctctcgtttagagacagtcattatccccgtatattcattggtggccggcattatgactattcagaatgatccaccagcattagtgccattagtggtgacgattcttgttggaataatagtgggatggttccagacaacgggtttggcagtccggataactggtcaaaaagataataacagtcgacctgtcattgagatacggcgtaattggcagtatttgttgggatggcttgttatctttgcatatggaatgggatttgcagtgcagtccggcgaaaatgtaaatgtattttccgagttgggtagtgaagtactgaaagatctttttctctggacgaatttttcacaaacagcaagttggtgtattctaattcaatcagcgtctgccagtatcatctatattttattagtgattcataaagaaccattggttaaggctgcaatatcaagaaaaaaataacgtaacgtggtttttcttggctaacaggcctgtttgatatgcgttaaactgttagtaaattaattgtggagaaaaacgatgcagaaaatttttattattgaagatgaccagacaattcgaaatgaaatggttcagtccttgaaaaagtggaattttgaagcgttttgggttcaagattttcagcatattgattcagaaatcaagcagcggattcctgacctgatcgttatggatatcacgctgccattttacgatggtttttattggacgcaaaagattcgggaattctctcaagttccgattatgtttgtatcggcagcagaaatggatccaaatgcgattcgagcgatttccattggtgctgatgactacttgaccaagccgttttcaattgccgtttttatttctaaaattcaagccattttgaggcgaacgagccgagttagtcgtttaacggatacaattaaatttggcaaatacacgctaaacatcattaccaatgtattgaacgcagaaaatcaatctgttaaattaacggcaactgaagcgattattttaaaactattatttttaaatccagatcaggtgatctcaaagaagaaaatcatcaagtcaatttggcaaaatggtgattttactgacgaaaatatcctgaatgtcaacatgagtcggctccgagataaattaagtcggattggattagctgatcagattgcgaccgagtatggcaagggttataggttattaagtcatgaaaaataaaccaagattgatttttagaattattgtgtctgaatgggggattctggtggcctatctcctgtttattttcctattttattttatctgcgtgctttataaggtcgatttggatgttgtcggtgatttggttcgctatacgttggcaccatttttgattgtcgttggtttcagagtttatcaaaaagtgatcgatgttaaagcaatcaatattttggtgaaggacggaaatttccaacaattccagcttcatggattttatggcaggttatattcgcaagccctcaaaaaactaatgaagcaacagttgactgaaacacgtgacttgcaggaatcccttaaaaatcgggaagactatctaactttgtggagccacgagatgaaaacgccgcttacgtcactactgatgattgctgaaaacaatgccacggtgccgagtgaagaagtatctgaaaaaattgaattggttaattaccaacttaaacagttactcacattcgatcgattggatgacttcaataatgatctggactttaaaaaaattgatttggtagaatgcataaaaaaggtgattcaacaaaatgcgtcatttttcttatcacatcatgtgatgcccgatattcatgtaccaactgttaacgccctatctgattcaaagtggctatcgtttatattagagcaaatcatcaccaatgcggttaagtattctgataaaaacagcacggttcaaattgaatacaacaataatgtgcttaaaattagtgatcaggggattggaattgccaaaagtgatttgccacggatatttgatcagggattcaccggtagtaatggacggacgcatggcgaagcaactgggatgggattatatatggcccgaagagttgccaaaatccttgatatcaaaattgatatttcttcaacggaaaatgttgggacaaccgttaaactcatttttaatcctaagaaaataacaacaaaataacaaattgtaagattccttaatgcattgtaactacaaagattgggggatcctttttatactgggttaagaaatgatctttaggaggagaataatgagcttattaaatttaaaacatattaaaaaggttttctcagaaggtaacgaaagtgaagttcaggcattaaaggatgtcagtttttcagttgaaaaaggtgactatgttgccattatgggagagtccggtgcgggaaaatcaacgttgttaaatattatcgcaactttggatcagccaactagtggtgaaattcgattaaatggggtcgaacttagtcatttatctgaaaatgaagcatccaaatttcgaagagagcatttaggattcgtttttcaaagttttaacttacttgatacttttaacaatcgggacaacatctatttgccattggtattgtccaaaaaatctcatcaattcatggagaataaattagcaccgctaagtcaaagccttggcattgaaaacctgttggagcgccagccatctgaaatttccggtggtcaaaagcagcgagtcgcaattgccagagcattgatcaccgatcccagcttactgttggccgatgaaccaacaggtgcccttgattcaaacaataccgagaaaattttgagcgtctttgaacggattaatgaaaaggggcaaacaattttaatggttacccacagtgctcaggcagccagttatgcacaaaggacgctattcattaaggatggcaaaatctataacgaattgtatcgtggggatcaaagtcgcagtcagtatcttcaaaaaattattgatagtctgacggctctggaaagtaatggggaggtcagataatgattcaattaaaacttgccgttcaccatttaaccaaaagtaaaagtcaaagttttccgtttatcctctcaaatttgatgtgggtaaccactacttatattttcctgtcgatgatctataataccaacattagagagaatgaatatggggcagtcgcaaactatgttcttaaattgggtttggtatttgttattttgatcgctgccttatcaacgttttacgctgagcggctgcttagtaaacagcgaacgcaagaattagggttatacagcatgttgggtctcacgaaaaataatcttcgtcaaattatttttctggaaaatagtttattttacatcatctgtacgattattggcggtatccttggcattacattttctaaattagcatttatgagcttgaaagctcttttcggggcagcatcgctccatcaaacctttacattgatacctttggtttatgttgccgtgattttcgcggttatctttttgatgattatcctgtttgacttttggggattaaggaaggtaaacccaattaatttgtgggcgaaagcgactaaaccggaagcagagcccaaatcgcatacgttacttgcaatcatgggaatgattgttttagcacttggttattatgtttcagtgactgttaagccgactggtgccgcgtttgggcagtttatccttgcaattatgcttgtcgttgtgggatcgtatttagtatttattacagcaagcattagtttattgaaggcacttaggaaaaatcaaagttattattacaaaccaaatcactttatctcggtctcgaatatgctttatcggatgaaacaaaacggggcggggttagcttcgattagtttgctatgtacgtcaattttagttgcattaattgcctcggtttcactagttgcggggcaaaaaaatcttattaatctttggagcccacgagatgttcaaattgtggctaaagcaccacttcccaccagtgcaaaacagggaatcaatgagcttgccgataaacatcaggtgaccatgagtgatccccaaactgtcactgtgaccacaccggtgatgggcgttttgaaaggcaatcagtttaaggcccaatttaataccaaaactgaaagcacattttcgtcactcgatcttcaacagtacaatcgcattcagcatacgcattatcaccttaggtccaatgagatacttgtgtatgcaccgggaaccaattattcacaacagactttgaacgttcggggtaatcgttatcaagtcaaaaaacaagttcagagcttccacggatcgtttgtctatggtcacgtgatttataagccaatttttgttgtcgccgcaaaccaaaagattgcccgccaaattaatccgcagccaaatgtttacgcgcaaggatttaatacccgtggaaccaaacggcatcaaaaacaatttgcgagcgaggttcaacgattcttgaaaattgatccaagtaatttcacgtcaaaatatgtgatgggtgacttgctaaaagcgatgtttggcagcctgctattcatgggcattttaattagtatcgtgatggtttgcgcgacaaccatgattatctactataagcaagtttctgaagggtatgctgataagcataattaccaaattatgagtaaagtcgggttgagtaacaaggagactaagaaagcaattcgaggtcaggtgctgacggtctttatgctcccaattattggagctgttttgaatttgggatttgcgctgcccgcgattaagagtgttctgtcacttttttccatgtatgatttgaaaattttactgacggtaagttttgtcacgatcggggtgctgatcatcagctatctgctgatctacttggcaaccaccaatatctatcgaagaattgtcgaaaaaaattaatattcgaggctgagataaaagtgattttatccagccccgttttgtgtaatcatgattattaccgagtgaaaacgtgcgccaaaagggctctttccatactctagtgaaattttgatgatgatttttaaacttcaaactgaaaacgaaataacctggcaagttcaaacaattttcacctgatttaattttgagttatcacttcaccatggaaagagccgccaaaaggcaacttcctgccgcgtaaccaaattatccaaacattcaagcccggaatattcggataattcgattacgctctggaagttaaccgcctttcgtcccactctcaacttgctttcaagattgatttctaatcatgacgggggcaagttttttgctttatggtttggttgggtaataatcacgagaacactgacgaaactaaaataatgtctgcagagatcaatttggtcggatcagggcttaattgaaacttcagcgatttgcccgcccacacttttactaaattatggtagaattaattagataaaaattcagacattgagaaggaagagtggtagtaaattgatggattgggtgtcaaatttgtacggcccgttttttgatctacacaactggagtaccgttatcgagagtgggagtgactggctgattattttatcgctggttacaattgagtgtttgctttcagtcgataatgccgtagtccttgctgcacaaacgcaagcgcttccaaccaaatctcaacgtgaaaaatcgttgttttatgggttatggggcgcttatttgttccgattcctaattattggtgtcggcacatacctgattcatttctgggagatcaaagtgattggctccctgtacctaatgtacttggtattcaaattttttaccaagacaaaggtcgttcatactaagaaattagccaacgaaaagaaacatggcatttcactgttctggtcagtcgtgattcaaattgaattcatggatgttgtcttttcggttgactcggttctggcttctctggccatttcgcctaatccagttattgtgttaataggtgggatgattggtatcttggcaatgcgtggggttgcagaagtaattatgaagttgatgggtgttatcccggaattacaacccatggcttatattttgattgggattattgctttaaaattattcttgtcaatcccactgattgatattgaaattccggcacctttgtttggtctgattgtgatcgccgcggtgatcattacactgattattcattatgttcgtaagaatagggggacttccgatgagcgttcagataactcgtaataatttacaacaagaagttgatcatcagctaaccgttattgatttttgggcgccttggtgtggcccttgcaaaattttggacacgattttagccgcattggagaaagattatggtgatcagattcactttggcaagatgaatgtggacggtaaccaggatattgctgaaaaatatcatgttttaagtgttccaagtttggttatttttaaaaatggcaaagctactgaaaaggtcactggtgtttatccaaaggaaaagctggcaagctattttgataagaaagttgctgaaatgaacgcaggctagcgaaacttcttgatatctttatctttaataacgtcagcgagttttcggtctagaatatccaagccttggagtggaaaattgaagattggtgccatcaaatgacgacgattaggatcagggacaacctggttcttttttagtttgggcaacatggtttctagatcctgtttagttaatttaagttgacgggcgtaaaaaagaacgcgttggaataccagatttttaaaccacaggtaataaacgatgcaggcggcggcaatataccaaaaaactgaccaagtcataccaattttgtggggtgataagaatcccagcgtaattgccaagatagcaaaaacacaatatgttaaaatagctgttatagtaagttttacttttgttgacatagagaaccaactttccaagtgagatttgtgatattatttatctataattataaacggaaacgaagaaaataggatagtgaggtcaaatcagtgaatttttcaatagagacaattgagtccaaggactttccggcagtgcgggggattatcgcggatagctataagaatgatgagcctaatactgatggtgatgaggttgatatgatcgaccgcttacgatcatatgaccaatacaactcggattttgaagtggttgccaaggatcatgatcataaggtgttgggccattctttaatggtaccggttaagcttcgttcgcagaagcgttcgcttaaaatcgcttcaattgttgaaattagtgtgctccaagattatcaaaatcaaggaattggccatgcgttggtaaaggaattggagacgcgtgcacaattagcaggttatccggcggttgcagccattgataatactgatttcttctatgaaaacaactatgtggcttcggaaaactttaatatttattcaacgttaccggtggacttgggtgccaatctgattaagccactatttgatggcagcttgtttaatagaagcggcaagatttattatccggaggagttcttcgggggcagagtgtgagaacaagcggttagatcccagaatataacgagcttaaccaaatattcccggttctggaatgtttggttaagctcgttatatggccgggatctgcttgctctcacacgtttcggctaggtaaaaatcccagaaagcttctagatttggaaatattggctggaaggggttatatggccgggatctgcttgttctcacacgtttcggctaggtaaaaatcccagaaagcttctagatttgggaatattagctggaaggggttatatggccggaatctgtttattttcaaaaagaatggtacaagctaattatttacaaaatttacaatgaaaaacaaactaattaaataaaagaattgttttcaaaccagtagtcaccttgtctgggggtcagaaagccggtggttgatgcgaaccggtcagggtaacgtgtgacgaattattaactgatggaataactagagccattatccgctagtgaggagccaatttggcttgaatttgggtggtaccacgttaaaagcgtccctattatgatcagaaatgattgtaatagggacgcttttttatttgagttgaatcaatcaggtcaaacttgatcgttaagaggagaatttatgatgagtaaagaaaattcagcaccgcggattggattaattgagggaattattgttttaatcgggatgttgatcgttatgggagttagtgtgattaaaatccaaatttcacctcaaattccgattttggttgttattttattgttgatcctatgggccaaagcacgtggcttttcgtggaattcggttaaccaagggattattgagggaatctcgacgggaattatcccaatgtttatttttattttgattggtgcgttgattagttcatggattgccgctggggtcatcccttcattaatggtctttggctttcatttaatcagtgcaaaatggtttttgccgtcagtcttcttagtctgcacgattgttggaacagcgatcggaagtgcctttacggttatttcaacaattgggattgcgtttatgggaatgggcgttacgatggggattaatccggcaatggttgccggggctattatttccggggcaattttcggggataaaacatcgccgttatcggattcaactaatctggcatcagctgtggttggtgcggatttatttagccatattcgaaacttgatgtggtcaaccattccagcttttttgacatcgttaattgttttcttcctaattggaaacacaagtgccaaattgaatgtggcggcgattgataaaacggtcagagttttgacaattcactacaatattacgttgtgggctttcttaccaattattttgatgtttgtgtgtgcctggcgaaagattcctgccatcccaacactatttattaatattgtggtagctgttgggatgatttttattgacaaacccagcactcaaattaaagccattgtcaatgtgctaacgaatggttttgtgtcaaagaccggtaatcaaagcgttgataatctgctgacccgcggtgggattgtcagcatgatggtcaccattgcccttattatttcagcattggcattgggtggtctgttgatgaaatttggagtgattgaagcagtaatgggaccattgtctcgaagattaaggtcaaacggatcattaattttggccgtcattttgagtggaattggcgtcaacttatttgttggcgaacagtacctttctgttatcttgccagggaatgcttttaaagaaacattttcaaaagctggattggcaccggttagcttaagccgggctttggaggatggtggaactgtcattaattatttaattccttgggggggtgcaggggtatttgcggctaatacgcttgctgtgtcaacaattaattacctaccatttgctatttttagtttgacttcaccaatcttttcgatcctcagtggctatactcgaatcggtttgaaatatttgaaaacggatgaaaacgaccactaaagttagatcggagtaacggttataaaaatcctttcataactacttgtttaacaaatattacctaaccgttacagacattacacatgctccgttattcttaacgcctgtgatatttgctggtaacaacgtaactatacacttgtatttgttgatcgatgaggtcacaaaaatctatgacacagacacgtatataggagtgtgtaattttgaaaaaagtactatctatgattctcgcaacttccgctgcagccgttggaatcttcttcgcaggattctcatatgcatcagcttccacagtagtcacagtgaagtcaggcgataccgtttggggactagctcaaaagtataacgtctcatccaatgcaatcgaaaatgcaaataacctcacaaacgcaaacgtcatctcagttggccaacgtttgactatccctgatggttcaagtcaagtagcaacaactactacgacaacaccaaaagcacaagcaagctacagttacagtcaagcacaaacgactcaaccaagttacagctactcaaacaataacgcagctgccaacacaacatcaaactattcagcaaacactgcttcagcatcaactggcggtgacagctcagctaaagcttggatcgctaatcgcgaatcaggtggttcatattcagcaactaacggccaatacgttggtaaatatcaattatcatcttcatacttgaatggtgactattcagctgccaatcaagaaaaagttgctaaccaatacgttcaaagccgttacggttcatggtcagctgccaagtcattctggcaagcaaatggttactactaaaaagtagctttctaaagaccttttaagtaagtttaaatgcaaaataaaaagatggattaatgagaaactctcattggtccatctttttttgcgttggcacggcaggttatgagcagtaaactggtaaatagcatttgttgtgaaagaggtgatagattgaaaattcaattaacgggtgatagcattattgcgcgacatgaaggactagtcgaaccaatgattaattgcctgctgaaaaataaatttcccgatttgatcatttataatacagcggttgctggaaataatacatgtgatctattaagacggttagacagtgatgttttatcagtcaggaacgttgacaaaatatttgttctaattggaattaatgatgcagctagaaataagcaggtttcactagatcgttatacgcaaaatctagaaaaaatcatcaatcaattattaaaaaggtattgtcagagacagatttattttatgacaccacctgctgttgatgaacgtaagcaacgctatcgggataaccaattaattgcaatgtatgtaaacaagctcgaatgggtcgtgaaacagaaccattgccattttctcaacctgtttgaagcgttaagccatcatcctaactttccaaagattatgcaaggaagtctaaatgatggtctgcattttggcgaaggcggttatcaggtcttggcaaagttgattagccagtgtttagtcggttcgaaaggaattaattgattttgaaaattagagaatatcaccttaaagataaaaatcaggtcattcagatgatgacaacgacaattcaatccgttaactcaaaggattatgatcaatcgcaaattaatgtttggtcagcgattgatcccaaacgctgggatgctgggcttacaaattatctggcgttggttgccattcaaaataatcaaatagtggggttcgctgatatggacttgagtggttatttggatcagttatttgttgatcgaaattatcaacgacaagggattgctcgtcaattagtaaccacgttggagaagcgaagtccggctgcttctttttcaagtttggcatcgatcacagctagaccttttttcgaagctatgggctatcacgtggttaaaaaacatatcgcagaactgagaggtgaaacctttattaattatttcatgataaaataactgtcatttagatgaattgacggcttaattttctcggtttcgctgaacatttagccagataatatacagcactacaagagtaatcacggccaacgtgtaaatcaaggtgactagcgtgcctaccttaaagatgacgttaattgtgactgatatcatcaaaccagtcatgatcagaagaatgagtccgacagtcaaatgatgcgctcgaaatgataggatacttttgatcaataggtaacaagtagccatgatgcagacaaatggtgcaattagtaattgaatatttgatgacttgatagaatcatcttcctagtaccttatttgaggtcatttgaattgctatctttaattaaaacaggcagaataacagagtgagacaaaaggcggttaacttccagagtacaactggattatccgaatattccgggcttgaatattgggataattcggttgtacggcaggaagttgccttttatctcacgtttcgacttagtaataatcgtgattacacaaacggggctgggacaaaattacttttgtcccagccccttatattttaataacatctaattgatagtttctttaaataacaatgaatctgacacatcactagttattttaagcgattagtcaccattcaaaattgaatttttaacaatcacgtaatcaactgttcgaatatcttttagttctttaccacccgcataggaaatggatgattgaagatcttgttgcatttcgtttaatgtatcagagatcttaccgcggaacggtactaacatctgacggccttcaacattgcggtaagcgcccttttgacgttcggaagctgagccccaatactgtttatattgtttgccatcgatggtcagcatgttgccaggtgattcctcatggccggctaatagggaaccgatcattaccattgaagcaccgaatcggactgacttagcgatatcgccattgtaacgaataccgccatcagcgatcattggttttctggcagcttttgagcaaagtcgtagtgcagccaattgccaaccgccagttccaaaaccggtcttgagcttagtaatacatgctttaccgggaccgatgccgattttagttgcatcagcaccggcattttcaatttcccgaacggcttccggagtgcctaagttaccggcaatcaagaaactgtctggtaatttttccttaatatagtggatcattttaattacccagtcagaatgaccgtgagccacatcaatggtaatatattcgggtttgttatcttcagcgacgagttcatcaataaatttgtattcatcatccttaatcccaacactaattgaagcgaaaaggtttaacgaatgcatctttttgatgaaagcaccacgggtttcaggttgaaagcggtgcataatatagaaatagccgttttgggcaaaccaaattgccaagggctcattcatgaccgtttccatgtttgctggaaccactgggatcttaaacgtctttgggccgaacttaatcgatgtatcagcatcgcttcggctcttaatgatacatttatttggaacaagttgaatatcttcgtaatcaaaaacttccattattgttacctccgaaaagtaagcggggttcattaaacatcaacctaataccagaagttcccagaagtattagggatttaaacttaatttgataaaatgtgaacggcaatgttgaaaagtaacacaattggctacttgttccacacatctgccacaacattggtttgttcgcgatcgggaccaacagagaaggttgcaaatggcacaccaactaattctgaaacgcgttttagataatgttgtgcgttagcgggtaaatcactcagctttttaacttttgtgatatcttcatcccagcctggtaactcttcgtaaacggcctcgcatttattcaattcttttaatgttgctggataatcatcaatttctttaccatccaatttataagcaacacagattttaagggtcttaatcccggttaaaatatccaagcagttaagtgataggtgggtgaatccggaaactcgagccgagtggcggagaaccacgctgtcaaaccagccgattcgacggggccgtttcgtaacgacaccatattcgtggccaacttctcgaatatgatcaccagtcgcatccttcaactcagttgggaaaggaccagcacccactcgggatgtgtaggccttgcaaacaccaatgacattatcaattcggttcgggccaattccggttccgactgcggcaccactagcagttggattagatgatgttacaaatggataagtgccgtggtcaacatcaagcatgacgccttgagcaccttcaaagaggacatttttattgtcatctaatgcgttattgattaaataggaagcatcaataacgtaaggtcgaattcgatcagcgtatttgttatattcattaaagattgtgtcgaagtccaaaggctctgcatcataaatcttagtgagcaattcattcttgatttcgagattacttcgcagcttttcagcgaatgtatccttgtcgatcaagtcagcaatccgaattccaatccgttcgtatttatccatgtatgcaggaccgattcccttattggttgtcccaatcttggaatccttcttcttttgttcctgcagaccgtctaataggatatggtatggcatgatgacgtgggcccggttggaaattcgcagattatctgtgctgattccatcctgctttaatgaatcaatttcattaatgagggatttcgggttaacaacgacaccgttaccaatcacactgtatttttcctgatcaaaaatacctgatggaatcagttgtaagtggtaacttttgccatttaatacaatggtatggccagcattgtcgccgccttgatagcgagcggtaatatcggcatcttggccgaagaaatcggtaatcttaccctttccttcgtcgccccattgacttccaacaaccacaatagatgacatatgaacacctctaaattttattgccaggtcatcaacccagcatttttaattttaccaacatcgaactgaataatcaaccaaaaggttaatgtttataaatgctaaaacgtttaatattcgactttacgaatagaaacgaacaaaacgccttcaaacaccggaaaatctggtcaaaacatgaactatatgctattattatcttgtcattatttagtagtagaaaggaatcaatatgatagatagatattctttaccggaaatgaaaaatatttggtcactgcagaaccaatacgcgtcatggctaaaagttgaaattgccattgacgaagcgtggtccaagctgggaaagattccagcggccgacgttgataagattaaaaagaatgcgacatttgatgttgatcaaatcgctaaaattgaagcggtcacccatcatgatattgtggcatttacgcgggatgtctccaagtcccttggtcctgaacgaaagtggattcactatggcgttaccagtactgatgtcgtagatactgcttatggggttcgaattaaacaagctaatcaaattattaaagctgacattgatcattttatcgatgtaatcgccaagcaagctaaaaaatataaagatacggtcatgatcggtcggactcacggcgttcaagctgagccgacaacctttggtttgaagcttgcccgttggtattcagaaatgaaccgaaacaaacgccgatttgcgactgcttcaaaggagttggaagcgggccaaatttctggagccgtgggaacttttgccaacgtcccaccatttgttgaacaatacgtttgtgatgaactgggacttcacgcgcaagaaattaccagtcaaattttgccacgtgatcttcacgcagactacattgccactttggcactaattgcgacgagtttggaagagtttgcgacagaaattcgtggccttcaacgttctgaaattcatgaagttgaagagcactttgatgctggtcaaaagggatcttcggcaatgccacataaacgtaatccaattggttcggaaaacatttgtggcttggcccgggttgttcgtggccatatgattacggcttacgaagatgtgccgttgtggcatgaacgggatatttcccattcgtctgctgaacggattattattccagatacattgaccttgttggactatatgctgcatcgtttctctcgaatcttggaacggctgactgttttcccagagcgaatgaagaagaatatgggattgacttacggattgatttacagtcaacgggtgatgttaaagttgattgattcggggatgacccgtgaacaggcatatgacttggttcaaccacttactaagaaatcatgggatgagggattacaattccgtgatttggttgagggtaaaaaagaaattactgatgcattgagcgaggaacaaattgctgatgcatttgactatcattatcatatccgccatgttgacgaaattttcgccagagttggcttggaatagcatcaatgataaataaggaggggctgggacattagtcatttatcccagtctctgttcgtgcaaacacgattgtaccgagcgaaaacgtgcgccagcaagcagaccccagaatataagccccctaacctaacattccaagatcgggaatatcaggttagggggcttatattctggggtctaaccgcttactggcccactctgttttgtttaaaacatttttttgcaacttgtcactggttccgttatgctaaaataaaattggaaggggaaacgttatgcgaaagaaaaagattcagattggaatcggattattggcactaactggtttgctggcaattggtagtctgtcggtaagggctgattcagcaactgactcactttatcagtattatcgggttaatcggaccttcaaagtttggactgccggtattaaagccaagcattggattaccttgcctaaaggaatgatcgttcaggcggccaaacaaactcagttgtccagtaatggcaagtcgatgaatgtggctgaatttaatttcagaatgatcagttacgcgactcgaaaaaataagttacacatgaaaaagacttggcggaattggaccgatgcgaccactcgaacaccacagtatttgacagctgttaagccgccgaaagttttattgaccgaccatctttcagcatcgcggcaaagtggggttctttctaatcgtgcggacaatcgtggcaatatggtaattgcaacggtcgatgggtatttggaatattatcaaaagctttatccgaccggggattccaatttcaagccgcaatcctataccaaaattacgaaaattcggcaatcaggtaacgttaagtacttttattatcgacaccacattaaaggacttaaagatcaagccgttcgcaaatctggcaagtaccgctaccggctaaaagaagtcaatctaaacaaaaaggtaaccctgcagtatccatctgtgaatgatgggttaccaagtacttattttgtttacactttaagtaatcagaagtattatgtcccaaccggtgaattcaaataatgatccgagtagcgggcaaagtatggtatgaaggattttagccatagaaaaagtttaactattccaaaaaattatcaggcttgtctttttctggaagcattaatatgaattggagccgattatttgaatactgtaaataaagttagactggcgatatggttatctcgttttgcgtacattgcattttttatttggctggttgttgatttcttcgtgttagatttaaatgctggagtacctggacttttattcttgttaaccggattttggctggtttatttagaaaatcaattggaaaaattagatccgaaatacgcggatactttttggtgcccaatttggcgctttcttttattcccttggtttttggtcatgtagccttgataccgtaaatacattagattaaaagatttctgcctacaatgaagtcgtgggagtgcccagtgggtggtgacgttcaataatttcataataaaagttcgtatggcactttagtgagtgccttggagtaatttcgggactgggacaataatcatttggcctagtccttttgtatcattacgattattaccgactggaagatgtgagatgaaggacaattttcggccgagtaattgccatttgtcccactcggcttttcacgttagcgttaggattctttgccagtcccggtaaaacagcgtaatacgaatcattaggcagttgtccttgcacttcagaagccagcgatgacgcttgtgaccaataaataaccacttatccagataaattaaccgcttaagcaaatgatatttacttcaagatcctgaagtggtgtacttaatccataggcgagagagggcgttgagatgaaggttcgaattgaaattgatgatcagttaactgaaaaagaaatcgtgattaaagcgccaagttatgatctggaagttcagaacctgtatcggataattcaaagacaaactgaacaaacacagtctttagtattctataaggacaactcagagttctatttggattttgacagcattttgttttttgaaactgatgatcgccaggttcatgctcacaccactgatgatgattatcaaatccatttccggctgtatgagttggaaaataaactgccggatcagtttataagaatttccaagtcggcaattatcaatctaaacaacatattctctctcactagatcagtttcgggaaccttggtaaaatttcaaaattcccataaacaagtgtatgtatcgcggcgttactataagcagttgaaagatcggctgcagagaaggggctagtcatatgtggagagcaggtaaacggcggtttgtcgttggttttatctttttgctgggtgcaattagtatcttggcggctaagatggggtggttcagctatcatctgagtgcgtcaacgattatttggacaattttattggtgattgttttagtgtcgtgtgtcgcggatttaaatatctttggttcggtcttctcactggcgtttttgagtatgctatacgcggggccattgggaattacgcatttggtgccgtggacgatcctgctaatcgcgttgttgattagtatcggtttgtcgattattttgcagccactgacacataagcattattggcaccttacgaagcggtaccgtggcaactggatttcgtataatttcacgggtggtgataaagatgaggctaatgaagacgaatcagatggtaagataattgatgatgatcagtcccacccgattgttaatatgaaaatgggaagcagtgttcgttatattcatagtgatgattttaagcaagcagatatttatgcgtcaattggtgatttgaaggtttattttgacgatgctaagattcaaggcgatgcagctacaattaatttggatgcaaatatggcagatgtcgaattatatgtcccaaagaattggcgaatagtgaatcagattgatccgtttatggccgatgttgatgttacgaatagaagcgaaggaatcgatggcccaacagtaacattgaatggcagggcgaaaatggcggatgtggatgtgtactttgtataaagagtgctgcaacaagcggttagtctccagaatataagccactaaaggaccctatccctgatttttggggatagggtcttttagtggcttatatggccggagattgcttgtttcagcacgtttcggcaaagtaaaaaggaacagaatcaaaaggtcaaattgtggattctatatggccgggatctgcttcatgtcgcacgtttcagcaaagtagcaaaaaatcagggatgagttcttttagtgctttacatagctggatctgctcgatcgcacttgtttcagcgatgactcccgttccggtttggaatatgccaatcgaggctatatttctccatggcgaccagtgtctaaaaatttaaccgtgtcaccaacaattgtataaataagtaaccagtttcctttgataaataaagcccgttctgatttctttgccttaatgacatggtcgtcgtggcggtcatcaacagggtcaccgtttaacagctgatccgcaatggttttgaattctgtttcggtatagcgaccagcccggatcatattttgatagtgtttcttaaaacgagactgatattttggcttatatttcaaagttaatgacttccttcatcggatttgttgaagttggtaggattcagttagaatccatttttacatattaatcatacataattaaaagttaaaattccaaatatggcggtatatggatgcgataaaagaagatatccgctaattgcggataaaaaaagagtcaagacgggggaacgccttgactctatcgtatcaatattctgaggggaatatgaatatgaaaagtaataaattaatgggggattaatctatcactcaattattggggggtgagaagaaataatgtttatctcttcttcatggttcttaatatacagggtaaatattaacaaaaatggacgaaaatgtgacttttgtgtgaagtagggaatgacttttagtaaacccggtgatatcaaggcagataaagggatctcggctattaataatttaaaattaatctgttttatcaattgatttttgtaatgaaagaggttattgcctaaaagtgtgtcattaataagtcaatctaattaattaatcagttaaattgagatagttaacatacaggacaataaaagccgaatgagccaaccaaataaaaaggatctcggctaccggcagatttaggacataaaaaaagataaggtgtgggggcaccttatccttgctaatatctttattgaggggggaaatgaaagtgaagccaaaattgacttttctgaatcatttctatgtttaagaaagtcgttctttgacatctctttatgcttatacaataccgtagagattttgcgaaaatgtgcttaaagtgtgaagattttgtgaactttcaattagatattcttcaattaaggagaatcaatgcaattcatccataaaaagcattttttgaagggattatgtgtctgctttgatcaattataagttaaactaatagtagcgtaatcattttgaggaccatttctgaatgtgttagttgatcatgaaccaatttccccgaaataagtacttaggctttttcactgattgcttcaactcacaaaaaaagataagacacggggatgtcttatcttaagatacctatattctaggggaagaatatgaatacaaaagtaataaattaaagggggatttaatttattgccaacatgaagtaaaagttttacctcatgcaacagttctttactataaagatgacttgttgccaaaatgtgaataaattgtgaagattttgtgaactttacaaaaaagttagaaaatatgtctgataaatcatataagctgtaaaattaattacacgtgcactaagcaattaattattgaaaggagattgtttcaatgagctttatggcaaggcggttaatcaaacaattcaaaaatgaagattataagaaaaatgttgctcacagttttttacatcccaatcaaaaaatcaatctttttcgggatggtaagaaaaaatatcaaattaatcagataaattctggtcaacttgtgacgattgatttggtcaaaaatcctaccaatcagatcatttatttccatggtggcgccttcactgttccaatgaatactgatcaattagaaatgattagtaaaattgggacggctgcaaatagtcgaatccgaatttttgattttccgttactgccaaaatatagtgccgccgaaatcatggattttgtaatggctgcctttaataaagtaactgccgatccgctgcctatttttttagtggctgattctgccggggctgctctggctgttcagttgtttatgaaagtaccaacgaaaattaagggtgcctcgttaatatcgccatggttggatatgcgacttgatgaagcggaatttgttgaacgggaaaagtcagatgtgatgttggatttaaaaacattaaaattgattggtgatcagtttgcagctgggctgccaagtgattggcaggatgtttttaatcctgataatttaaatattggtgatcttcaaattttttatggtgataatgaattattgacgccatgtaacttaagatttattcaggcattaaaaaaatccgccagtgttatgccggatgtcaccagctttaaagacggatttcatgattatacattatggttcaaattaccggaaactcgaaaaacagttaaggagattgcagcttttattaaagatcgacatggtgcttgagagctggaaaggcgtgggtgtctgaccatttcatcatggcaccttggaaaacaagggcgaaaacggttccgaagttagtcgcgtatatattgccggtgattaggaaacaggcccctgtaataataactggtggaatataactaagccattgtgagatgactgcactaccatgcgtaaatttaaaccgaataatgtaagccaggtcgtcattgggatgcataattaaattggcacgagaatacattgaaacggccattgctacacagaacaggccaatgatgtcgagaatgacccgccaccagaagtcgtaggttggaacgccgagtgaatcaaaaatccattctgaaaattggaccaggtaactaaatggcaaggtaaacaataagttcgaaaagaagcgacgtcggtcaaattgacctaataatagctgattcgataatgtcacaataatcccgtaaagaaataacgttgttcctaatgggatattaaccattttggagagattaaccgctgaaccggtccaaacggcacttccaaggttactggaaattgccagtgcgttaccggcagcgttgataaaaattgataaacatagataatagaagcgttgtttaaaatccttcgtttttgccataatataaaaaagctctccttaatctcaatagctaccattgtataatacttattttgcttttgaaatggtgacgatcaaattagtacgtttgtcgaactaatcgtgttaatataccttgtagaaggtgatcttgtgcaaaaaacatattcggaagtagaagcagaaaaacactttgatagtaatcgcctttggtttggccgctttcgaacaacgcgttcgtttaataagctgacaaaaccggaaaaagtggctgcggaatatattacacgggcgtttgtcggtttgtcttataagtatgaattacgagggccgaggcgttatacggctaagtcagttaaacatgttatcttagacttatttccagaaaaaattgcagcaacaaatgttttttttacgtcggttatcccagtcttacgccgttacattgtctttttaggtgttcagcataaaattagcaacgcaaaaacattggtaaatgcgctggattcaattaaacccagtgagcttttggcgcgaaataaggatacatcaaattgggatttgcataagaaagaaggcatgcaaattctgatgggttatacaagggatgcggatccaaaaacagtgagtatatatgaagacatctataatatgggtgtccctttaagattttgtttcgattttagtgttaacaagccccccaaggatatcattatgctaacggagagtttgcgtaagcggtttgagcaggcgttgtatgagaaaaataaatagagtgcaaaaaagggcgctttgatcccagaatataacgcaaggaaccggatatcccaggtcttggggatatccggttccttgcgttatatggccgggatcagcccttcttttgcacgtttcggctaaataaaatcggtgattagcagtaaaaaagccaacaggtagaatcttatatggccgggatcagccctttttttgcacgttttagctaaacaaaatcagtgactcacagttaaaacgccatctccaaacgtcttatatggccggggattgcttggcttttgcacgtttcggctaaatagaatcggtgattagcagtaaggaagctaacaggtagaattttatatggcggggctgctttgcctttgtacgtttttaactaaatgggatcgacaattcacagttaaaaaacaagtccataaaattccagtcggatttatatttcaatttactaattgcaaatgttccaacaaaagcatcaactgagtccaaataaaaatggcttaggatcaaccaatgttgtctcaagccaattagctgttttacagggtatattcgaagctttgactacacataattaacttaacacggtaactttaacaatgttgtcgagactgatgactgttacctgtttgccgggtcgattgataaaggcttggttatcgttaactgccgcaacggtaccggtcattttttggtctttcaattcgatcattaccatcttatgtgctttatacgcattcattaattcattcgatatttcttttgacgcgatagtcatcattctcacctcgatatgataaacttaagtatagttcacaattatgtcgattgtaaatattttttcgtaggataaaagactttttaactttaatgataacaattttgactgatttgcgctaaagtagacatatacgtgtattgaaaggggtattagagatgactgaacgccaattgattcaagaaattctaaataccgttgatgttatttataagtttgtcaacaccgacgatgacaagaaggagtatgagatcgtaattaaccgtcaggacggtgataatcgaccgcttgaaaacgttaataaagagatcaaacattattttacagatgccaattttagttacgatgaaaagctgaacacaaaagacggcgatgatattcacgttgacgtcaaacgttaattggtctagtttaattatgcttcaaaaaagttaataatccaacaatttgaattgatttgcacattatggtatagttcgtaatgtgcatttttaatataaaaataagttatcatttaataaattatttgggattcgtgttactatttttaaaataatatgaaatcggtttcgtttgattggagtgaagacaatggcaagtttaacagatcagccaaaatatttattgtcaattgaccaagggacgacaagcacccgggcaatgatttttgatcataatggtcgaaaagtaatcgaggcatttaagccgataaaacaaattattcctcataatggttgggtagaaactgatccaaacgaaatttggacttcggttttaaatgtgatttcatccgcttttattgatgccggcattcatccggaagacattgccggaattgggattgttaaccaacgtgaaacaacccttatttgggacaaagagaccggtgagccgatttataacgcaattggttggcaatctaagcaaacggcgccactggctcgtaaattaaagaatgatggttattcaaacctaattcacaagaaaaccggactgattattgattcgtatttttctgccactaagattcggtggattttggatcatgttgatggtgctcaggagcgggctgaaaagggtgatttgttatttggaacggttgatacttggctagtctggaaactttccggcggtgaataccatgtaaccgactataccaatgccagccggacgatgttgtttaatatccatgcactccggtgggatgacgatattttgaagttattaaatattccacggataatgctccctgatgttaaaacatcgagtgaactgtatgggacaacgaagaactatcaattttacggaattgaagtgccgatttccgggattgctggtgaccagtcggctgccttaattggtcaaatggcatttgaacctggaatgattaagaatacctatggtgatggtgccttcatcatgatgaatacaggggacaaaccagagttgtcggatgataacttgttgaccaccattgcctacaatatcgatgggaagacaacctatgcattggaaggttcaatttttgcggcgggaacagctgtgacttggttagccgatacgttggaattaatcgataatgtgccggagtcgcggcaggcggcaatgaattcgactgacgatgatgaagtgtatgttgttccggcatttaacggattaggggcaccgtattgggaacaggatgtgcgtggtgccgtgtttggattgacacggggaacaactaaggatgactttgtcaaagcgacattacaatcaattgcttatggaactaaggatattattcaaacaatggaagccgatacccatatgcatattccggttttgatggccgatggcggggcttctcgaaacagctatttaatgcagttccaggcagatattttaaatatcccaattcagcgggcagcggatgaaaatacaacggcgtttggcgcggctgtattggctggtttgggagttggttattggaaagatctggatgaaattaaggcgttggtagataagggccggatgtttgagccaaatatggaagcaacgcgtcgtgataaattgtatcgagggtggcaggcagcggtggatgccacgaggtcgtataagttgacaaagatttagagtgcaaaaccaagcggttagcccccagaatataagccactaacccccagattcctgttctgaatctgggggttagtggcttatatggccgggggctgcttggcttttgcacgtttcagcaaaatgaaatcggtgagcagttaaagatcaagttgcaagtggcatacatggccgggggctgcttgtcacagcacgtttcggcaaagtcgctttaaagggggttgggctgaggtgctttatatggtcgggaccagccttcttttgcacatttcagcaaagcaaaatcagcaatttccacagagaaatccacctgaatggaatcaattgtcctcatatatattttgccacaacaaaaacgcctctaggggaggaaaaatcatattcccccaagggcgtttttattttgaaaatcgactaagccgataatctatttagcagctgcttccttttccattccggcgattgtatcttcaaatcgggtccggatgtaattggcagatgcttttaacttttcattttcatcatcagttaattcgagatgatcttgttcaatgatgccgtcacgaccaacaatggctgggtatgataggtaggtattgtattcctcatgccagttggaaacaggaatttcagttcgggcgtcactaatgatgatattagctaagcggacagcggccgatgcaattccgtagttggtgtaatgcttgccatggaagacagtgtaaccaccagctcgggcaacttcatccaatttagctaaatcaatgttgcgttccttagcaatctcagtaattggtcggccgagaacacggactgttgaccaagcagtaaactgagagttaccatgttcgcctaagttatagccggcaaccgaacgaggatcgattcctaattcggatgacacggcacgacgcattcgtgatgaatcaagcaaagtaccagttcccatcacgtgattctttggtagaccggtaaacttttggtacatcgtggtaataacgtcacacggattagtgatatcaactaagatcccgttaaacccagatgcttttaattttgcactaacgtctttgaccgcgtttttggtaaatggtaattcaataaaacgatcatgttctttgttatctttttgaagcaaaatatttccaacggcggaaattacaacatcagcatctttaagtgctgaataatcgttaaccgtaatgttggtatggactggtaagttagccatcgcgtcttcaaaatcagtagcgtccgctgtgacttttttctcgtttggatcaattaagactaagtcgtccgcaaatccttctgcaactatgtaatgagcaaccgttgagccaacatgacccattccaataacaccaatttttcttgtcataatatgcacctcacatcttcttgttagtattatccgtgttgataatcagtataacattagttctaatcatttcaacagtaaattttaatcttattaatattcttgtgaaacatttattagttgcatcaaaatcaaggatggcaggaagtactttgagatcgaccagctaaacacgagcaatgacaaatgagaggtgtggtgggattagctatataagaacattgctcacacatgcaaatctttgcattatggatattgctaaaacgtccgccaaaaaacgattttctttccattctacagaagatacggttataattaattgttaaagtaaacgttacggagggatattggtcatgaacaatttatttgacgtgttaaaaatggttagctttaatcacttggggtttgattcttcacaggttgtgattaccgatgttaatgggaagcctaatggattattaactgatttatttcgcgatgtcactaataaagtcaacttgttcattgacctgagaagtgcgtattctgccggggatgttttgtctgaattgcggaacacaacgccactaccggatgatgtactggacgaatacggtaaaatcttgaaggaaccgttgctgggaattaattttgcgccacaaaagggccagatggaattgctggtgaatggttaaagagtgctgcgacaagcgtttagctcccagaatataaggcacctaactcaatatcccaggtttgggggatattgagttaggtgccttatatggccgggagctgcttatcacagcacgtttcggcaaggtagcccaaaacaatcatcccagatttgagggatattgcgttaggtgccttatatggccgggagctgcttgtcacagcacgtttcggcaaagtagcccaaacaattactcctagttgatgaactcaagtttggatttcaaaaaaatatcttaaaatggaaagtctagatgattcacttatatctataaagcggctgataccaagacatcgtgtcctgttatcagccgcttcgtaaacatattgatgatttaacagttaattatttgaaattacttattttctttccagtatttagcttcagtcaacagttcctttgatcgttcatcagctggaacgtaacctattttaaacaaatgcttgaagtacatcatgttgtagatgaacatccaaataatatttaaactgtttgaggcaatggggaaggtgatatctaaaggttcgttgacctgcagtgcgattcccatcccaacaatgagttcaattccaaaaatacataaaaagttgtaccaatctgaacggaatatggggactagccaaccaaaaatcaacgccgtaaacgaaaaaccgacttttgcgattcggatttggcccgtttctttattgacgactgtcgcaaagttgggcggaattggaatcatattttgctgattattattgttgtcgttattatcatcgttattgccgtttccaaaaggattttgcatcgtcgactcctttcttcaataaatgattgaaatgttacttttttctgaatttaacaacgcattcacagcgtgcggtttgtggcattaaatcaactgattgaatgtattccacttgatatttctcactcaattttactaaatcttgagctaaagtcgaaggattacatgaaatataaacgaatttcttaggcgtaatgtccaaaatggtctcaattaaggagtcagctaaaccggttcggggtggatcaacaattaatgcagttggtttccaaccggcgtcaatccattccggaagtaatttctcagcttcaccgacttcgtaaattgcgttaacaatcccatttttgacagcattcatattggcatcatgaacggcatccgcaatggtgtccattccgcgaacctcacgaacttgattggcaacagaaagaccgattgtcccaacacctgaataggcatctaccagtttttccttaccacttagatcaagggccttgaaagcttccttatataatactgatgtcatttccgggttaacttgcaggaaagctcgggcagataagtcaaatttcagaccgtccaggacttcggtaattttttccttaccggccaagtgaatggtctcgttaccccagaccattggcgtcttgccaggattaatattttgcatgacagaaacgacttctggtagttcttgttgaattcgctctaataattgatgcttttttaataatttttgactttgtgtaacaaaggtgacctgtacttcgtccgttgcggtagccgctcgaacaatcactgttttaataattccggcatttttctcttcgtcataagctgggatttttaaatcttggatcatatcaacaattgcccgcatcactttcatcgttagcggatattggagcgcagaagttttcatgtcgacaactgtatggctgcgttccttatataaaccagcaattatctgatcaccatcttgacgaatttgaaaggtggctttgtttcggtaatgagtaggatcgtccatcccaatggttggtcgtaatttatactttcggtaaccggctggtttaaatttttcgagtgagtcacgaatcacgtcccgcttaaattccaactgggctggataagctaaattttcaagttcaaagcccccaacttcattggcataatcgtcgattggctcgatccggtccttacttttggttaatacttctactaatcgagcgcgaatgaagttttgctgatcaataatcacttcaacgcgaaccttctcggttggcagcgcaccaggcacaaagactagttttcgctcgtaatagccaattccttcgccgttgattcccattcgtttaatttgaatcgtaaattgttcaccttcgttaacgtgaacgtcatttttattattagtcattgaaccgtccttaatttagttagttattaagtatgatagcacagagtggcattggttagcatgtggactgactgaaaatgggatgtggtgggccataatctggtagcaatccaagaagaagcaggttggctgcgtttcactaaccaagttttaatttttttcaaattaatttaaatattttcgttaaaaatccaaccagtttacgtaattaatttatgtacgcgggttgggttttattttgattaagaaataaaaaattaagaaaggaaatttatcactcacttatttgttataccaggataaattcaaccgcctacaaataatttttttggaggactttttatgaataaatatgttttatctgcgttggttgttccagcgatgctatttggttcagtcaatgcccaagctaagacggctgccttgaaggcaaaggtcaatcgggttcaagaaggggcaaactatgtttctggtaaggcaacccgtggcgccaatattaagattaccagtcacggtgttacatacgtagccggtaaggctaacaagaaaggcaaattcgagatcaatgcgcatcattcgtttaaggtgggcaagtatcgagtaaccatttccaaacgtggatacaaggtgaaagcttttcaatttaagattaacgccgatgaaccgacccgggatgtggcggtaaccactaataccagccaagtggatggtttgaacaatgaaatttcaaagttggaccaacagatcgcttcattaactagtcaattaaatgaagctaaaagtgatcaaagcaaagttgatgccaagcaacagcaggctttaaagaatcaagttgccagtttgactagtcaattaggaacggttcgtggatacgcttctacagtttataatcaaagagctgtaagcaatagtgaattaactgcagcaaactccaagattgacgatttgcaaaaaaaggtaacggaattaagcaatgatccgcttatttatgatattccagctaaacccaatacaaatgcaccaactactgtcattgatattcccgttcaaaaaaaggttgatacagtaacgagtcaagtcatagaaattgtaccgaatacggggaaagacacagtaagtaatccacagcaaagttcccaagtcagttccaaggatgattcgaagaaggtgacaggtgagacaccaagtggcgaaaacgatccgcatgaagccgtaactgaaacattacaagattaaattgtaaaattgtgcgaaaaactaccgactgaatggatatgttagccactatctctaggaagctaataaatattttgaaggttcaacagcttaccgacttaatgttgaaaaagcaaattattatcgaaataaaattgcttacgatgatgaatttattcaggaatatactcacttacttaatactggcgaataaggtaaaaaccatcacgtcagcaaagtagtttagcctacaaggtgcatctgcaaaaactttatatgcagatgcgccttttgagtacctattttgattgaaaaatatatcatacgccatataatatggtcaacagatgactaccgaatctttcataaagaagattcagaaaacgttaaaaaattagataggttaagagtcgtagagggggatattacgatgagcgaaaccaccgacatgatcaatgaactaagcagagaggatccgcagtttgctaaaggaatccagcattatcgtcaacagtaccgatatgcggatgcaattgaaaagttacgaaagcgtgccaaattaacgcaaacacaacttggcgacttggtcggtgcttcccagtcagctgtcgctcgatgggagcgcggggatgccaacattactatgaagactctcgaaaaaattgcagaagctacccacacgcagttagatattaaatttgtaaaagatagcgagtaattatcctttttgattgtaagcaaaaaagctgattatcatgtgacatgttccgacagagttaaaataaaggctttagctctggaaagtgtcacatgacattcagctttttatattagttggaaaaatattctatcgattttaccacgtggccgtatctggatcagttgccaaaccagcttgaccatggaaaccatcaattgtcttcatatcttcatttaataaattgaaatcaaagatatcagcgttttccttgatgtatttttcatgaaccgacttgggtagtggcaagaatccatgttgtaatgaccaacgaaggaccacttgagccggtttcttaccgtactttttagcgatgggagccaattcaggaattttgaaaatgccacccgtaccaagtggactgtaagcttccgttaaaatatcgtggttattgttatattcaacaacgcctggttgcgtgtccgatggattaatgaacatttggttaaccattggttttaccttggcggtttcgagtagggcatccaagtgttttggtcgaaagttggaaactccaatcgcttttgcggtgccacgattataaaattcttccattgcccgccaggattcggcgttagcttcctgccaattatcccggaatttaatcggattgggccaatgaattaaatagaggttaacataatccaggcctaatttttccagtgaccgaccaaatgcttccttagtcgcttcataaccgtggtcagcgttccaaagtttagtggtcacaaataggtcatctcgactgacaccactatctttgatggctttaccaacgctttcttcattgccatatgccgcggctgtatcaatgtgtcgatagccggcgtttagagcagctaaaacggcatgataggcttcatcgccatcagctgactgccaagtaccaaatccaacttggggaattttgacaccattgtaaagtgtgtacgtatctgttaaggacattttgattcctcctatttcatattgtattttatgataaatgaaatttggttggtcaacaagcaatcacgcttttgaattattatgggctgatgcgtaatgaatttgctcaccgatttgaaacgtgttttggaaagtaactccgaccgtacaagggttacatacgtgccaaaagcaggaatgagataaactttccagcaaacatgtggctttaatcgtttattttgccgcgttgatttaaatatccaaagtaaagaataaatccatcgatgaatgctcgccattattgagcgggtggcctaaattggtaaagccatatcgctgatacaaatgaacagcggtctccaaattatggtgggtctccaaatagactgttttatagccggcttgtttcgcgaagtcaaccgctgcatccaataatttataacttaaatgatgcccctgagcctccttagccaaatacagtttctgtagctcagcgacaccgtgttctggatcgtactcagcaatcccatcaccacccaggacttcgccgctatcagtcaaggcaacaaagtactgacgcttaggcgaagcatcgtaataggaacttaaatgatcgagttcggcatcaaaataggcagttccggggatgtctagaccaaatgatttcaaggaatggcggatgattttagctagggctgcgtcatcggttttactaatcgttctgatttctgtcaaatgaaaaacctcttttcgtatgagctgtcaaacaggtgcttatgtattaatgagttgaccgctagtgatcaggtaatacagcgttctctggttcagttagggctggtcaacttattttgcttaccatcatacgctctcaaccagcttatgactactattaattcatcaacttaaagctgtgattagcaggcatgtaaacggtctacgtgatatactggacttaatttcacaataccttctaggagggattcttatgagtcgaaaagtagcgattgtcacaggggcatcatcagggattggtaagcagattgccaagaacctttatcgaaacgggatggacgtttatgcgctgtctcgcagagtctaccaaatgaatgagctggatgatttagggattcatacgttacatttggacgtcactgaccacgatgaaattgatcaagtagttagtgagattgttgcagaaaccggtcgaatcgatgtactggttaacaatgccggtttcggctcgtttggttcggttgaagaagttgaactatcggaaggcgaatacgagtttaaggttaatgtttttggtgtgatcaaaatgattcaagcggttttgccaacgatgcgtaaacaaaagagtggccggattattaatatgtcgtcaatggatggcaaggttgccagtttactaggaagttggtacgttggttccaagtttgcaatcgaaggaatgagtgacgccatgcgtttggaattgaagccatttggaattgacgttgtcgttgtcgaaccaggtgcgattcaatcatcttggaaggacattgcatctgaaaggatgttagacgtttccggaagtggtccatatgcgaatatggcacgccagtcggcagacttttttgccttcgcgtataaatttgcttcaacctcacgtcggatcgctagaatggttgatcgggcagcgttttcacggcgaccgaagacgcgctatgttggcggtgctggggcaaagccaatgcttttggcacgtaaagtgatgcccgatcgttgtttagacgccttgactttggcactgacaaaatatgcccagaaggtattgaataaacaaacagcgtttaatcgttaaaattcaattgacgtgaccgattgaatcatgtataaagaaagtagaaacactaggggtgccaccggtaagtggctgagatgagtctgatcgacttgatcccttagaacctgtaagtcaatgcttgcggaggaaagtgtgaatggataaccagggagaagtgtcatgggtgggccattttaatgtggccagctgaatgacgcctcattttgagaagcacggtcagttatccaattgttcaaagcacaatccaaatcagacatttaatagtgggactgcaggcaaatcggtgtatttgcggcggtccttttttgtagagtgtgaaaagaagcgtttagctcccagaatataagccctcccagccaatattctgggcttggaatattggctgggagggcttatatggccgggagctgcttctctttcacacgtttcggccaagtagccagtccaaaaaccaatattctggttctgaatattggctgggagggctaatatggccgggagctgcttctctttcacacgtttcagccaagtagccagtccaacacccaatattccgggttgggaatattggctggcggggcatatatggccgggatctgcttgctttgacacgtttcagccaagtagcaaccgttttgattttcaaaatttttaattaactaaccattccgcatactaaatttagagtacaacaagggagaaacaaacatgaaaattgatttattggatacgctacgggaaaagaatccgattgcttttaacatttcaaattttgtgacggttcaagatgttgccaatgggatcaacgctttgggcgcttcgccaattatgtccgaagagaagaatgaagccgaagcaatggttaaaatgtgtgattcagtgactgttaacttaggggcatttacggaatcacaactcgttcaaatcgatgccgtgacgacatttgcgaataagtatcgtaagccgattgttattgatccggttgctgttggtgcggttgactaccggaaagaacgatgtaacgaactgcttgatcaaattgatgttgccgttattcgtggaaacgctggtgaaattgcggcattggctgatgttgagtggaatgccaagggaattgatgccggtgaaggttcagctgatctggaagccatcgccaaaacattagctaagaagcgtgactgtgtggttgttgaaagtggtaagaccgatattattactgacggcaacgcggttgtccggatctttaacaattcggatctgttcaaactgcacgtcggttcaggtgacatgttatccagtacaattggttgtttctgtggcgttgatgatgattattttgaagcggcccagactgccacggcggtctttgatgttgccggtgaagtcgttgccaaatcaatgaaacaaccattagctggttcgtttggagttcaattgatcgatgagttacatttaattgatgtgaaaacagtcgaaaagaatgctaattttgcatagaaaggatttttaaagatgcctgatgaagcgattaatagtaccattcaaacgttaacaattgccggaaccgatagtggcggtggcgctggggtcatggccgatattaaaaccatgcaggaacgtcatgtgtttgctgccgcggttgtcgtggccgtgaccgcccaaaatacgattggcgtgcaggactttatggcaatgccgaaaaagatgattgacgagcagtttgcttcggttgcttcggatttgaaaattcgagcttgcaaaacagggatgttagcagatgttgccaccgttgaagcggttgttgaaaatttgaagaagtatgatctaggtacgttaacggttgatccggtcatgattgccaaaggtggtgctcgactgctttctgaagatgctattagtacggtccgagataaattattaccactggctgatattttgacgcctaatttgcccgaagctgaagaattgaccggaattaaaattgaagatcgggatcagatggttgttgcagccaaaaaattgcaggcaatgggtgttaagaatgtattaattaagggcggtcatcaaactgagtccgaacgatccgccgactttacacttttggaaaatggtcaatcgttttggatcagtgcgccgcgaattgatacggttcgaactcatgggaccggtgatacattgtcgtcgtgtatcaccgctgaaattgccaagggtgccgatgtacaaacggctattcgaacgggtaagaaatatgttcaggctacgattgcggatggtattcaggttggtcatggtcatggcccgttgaaccactgggcaaaaataactgatgaagaaggggttaaatgatggggttaccatttgaaagtgggatgctgcgcagctattttattgccggcacccaagatattaaggataagcataagacgctggaagaagttgttaaacaagctttggaagctggcattactgcctttcaatatcgtgaaaagggaccaacatcattaactggcgatgccaaagccaaaatggctcaaactttacgcgagttatgcgcagattaccaggtgccatttattgtcgatgacgatgttgccttagcagttcaaaccaatgctgatggtgttcacgttggtcaaaaggatgagcgggtgacccaagtcctcaaggaaattggcgaaacgatgtttgttggtctatcttgtgatactaaagcccaaattgaaatcgccaatcaaacagtcgggattagttacattggtagtggtcccgtctatccaacgggatccaaggcggatgcggatccggtgattggcgttgatagtctagcaaatcttgtcaaggccagccagttgccggttgtcgcgatcggtgggattacagaagaaaacatccaagaactacccaaaaccggggttgcgggaactgcggtaatttcgatgattgctcagagtgaggatgtctttcggacggttaaaaccatgaataccacgtttgaaaaatagttggatttaacttaaaccagagtgcgccagcaagcagatcccactcggtaacaatcgtgattacacaaaacgggactggacaaaattacttttgtctcagccccgttttcaagtaaaaaatggttactaaattagttatgggaattgattgctttacgtccccagtgctgcgccgtatcatggacgtagtgaactactcggtcataaatgaccgagcttctggatcaaagggctgctaagcgcctctcgatcttagaaaacgtttaagctatgcaacggccaacgccgctgagatcaattagatcttaatgactgtttcgcacccgttttgcacgctcagggtgatacgccaacagtaactcttggagccttaaggacggctaggttctgccccgcccgttgatcaaa

SEQ ID NO: 684 - DNA, 40785 bp, Unknown
  Metagenome-assembled genome
agacgcatcttggactacgccacgcccgccaagatctttagttcctatgatactttatatgattagacacctagaccactactaaacctgaggtcaaaagtgttgcacttgatttgacaattcgggaatcttttttaaccagagcaaaacgtctttcaacgccttaccatgaggggatcttttcgataccgtttgtttgtcgtataccgtcggccacttgataagatttaccagcaaactaatatcaccggtatacggttgaacgattttatcccaatcagttggtttaattaccatggataccacacccttcctgcaccagcgggtcttaggaaaacaacgactactaaatagaccgcaaaaacaatcaattgaatgatcacaatcaacctgaagaactgatcatttctagtcggcttcttgtaagaataataggaacgtttcttaccaattccgtacaatcgtaaatccattgcactggcaatcacatcaactcgttcaaacgttgacagtaaaagcggaatcaaaattgtgacactttgttttaaacgtttaaacaccgacactctctttttatccagttccaagccacgcatctgaagcgaattcttaatttcacgatagtttctggaaatgtccggaattgatcgtaaacccaatgaaaccaccgtacaaatcttataagggacgtggagccgataaagcccaacgccaagctcactgggggtgatacttaagacaaaccagagactggcaataaacatgctgaatattttgagcaatctgacgcttagataaaacagggtttcaggagtcaccacataccggccgataatcgaaaaccagacatcactatggccaatttcactaactccgattgttggtgaaaccaggtacatcaaaaggatattaaataagttcatgaaaacaatgaaataggtaatcccgcgaatctgccgccatttaggctttactgaaattaaaaaaatgatattcagtgcaaaagtggggatcaaaattctgatatcaaacgaaatcattattaaagaaagcgatgaaaccaaaagcaacagtttggtcgtgccattcagtttttgaatcaaatgttggcctggtaaataactaattacaaatgaattttccattttatttccctcgattaccttcagacgttaatacttgctcgagcaaggctttcaccgctgaccccaattctttcagccagtcgatagattgaagtctgccttaggccggcctgacgaacaatccacttatcatttaacactttaaacggatcatcatccgcaataacggcgccttgatcaataacaatcgcccgattagtatgttccaaagctaattgcatatcatgagtaatcacaattaacgtcatctgtttcttttcgatgacttgatcgacaaaggccatcattcgctgataatgctcaaagtcctgcccagccgttggttcatccataattaaacatgccggattcaataccaataatgacgcaaccgtcaaacgtttcttttgaccataactcaatgcgttaaccggccaatgacgcattgtgtataaatcagttactttcaaagattcagcaaccctgtcactaagttcactgcctgaaatcccacgcagctgtaacgctagtcccacttcatcctcgaccgtatccttcacgatcattttgtttggatcctgcatgttataagccatctgctggccaatttgttgaatagtttggtgtttaatcgatttccccaattccaaaatgtcaccggttgttggccgcaaaatcccggtaagcaacttggcaaacgttgatttaccagagccattcttcccaataatacttattttttcaccccgtttgatgtgtaaatgagccatattgatcacttgatgctgaccatcgtaactgtaccgaagatcagccacgtcaatgatgcctttagcatctttttgagtgagtctgttaggttgacttgaccggttattcaagaacttttgaaagtcactttgataatcactcggattgattaagtcaacattccacaggtcatggtcctgtttgaggttcccagaaacctttcttagggcgtcaagatacaatggatttctaattccgtatttctctaaaatgtcatccttcaaaaaatcatcaggttttccaatcttaacaatttggccttcattcaacagaacgattttatcaatttctttgtggagcacctcttcaaaccgatgttcaacgatcacaaccgttttatgttcctgatgatttaattgatcaatcaaatccacgatgctttcgctcatgctggggtttaaagcagccaagggctcatcgaacaagagaattggcgcgttgccatgcaggattccggcaattgacgtccgctgcttttgaccacctgataaatcaaacggcaaactactcaagaaagaatccaacccaacgatttcagcagctttcgttacctttgcctgcatatcatgaagcggcacattcttattttccaaataaaatgcaatgtcttctcccacactcaagccaacaaactgggcatccgagtcctgcaaaacagtcccaacatcgttgcctcgttgaaaaatactcgtgtggttgatctctttgccgttaatgacacattttccagaaatcattcccttatcctggttgggaattaacccattaatgcatttaaccaacgtggtttttccactcccactcggccccaagatcaataccttttcgccggggaaaatgtctaaatcaagatgttttaaagtggcttcctgctgagttttatacttgaacgaaaaatctttaaatgaaatgatcggctgactttggctcatagatctccactccccctcgttaccctattccttagttaaatttgaatttttcttataccttcgtgtcaatgcgtagagtaatggtaagccggcaacaaccgcaacaataccgtcggaaacaacggcgatccatccttgagcaaagttaattgccttttcacccccataaaagacagtgttaagaaatggtgaaatgaatccaaaggagattaataggccaataatcgtcgtaatggtgaaaatggttgcatgcttaacgttaaaaatgccgtccttaattcttgccccgtagagcggaagtaatccaattacaaaacttgcgataaagttgccaatccaccaatccggccaaaatccggaaccggcaagtaggtccgcaaagatatttccaaataatccaaccagcccagctggaagtgggccaaatagtgccccgacaaatactggaatcaaatacgctaccgataacttagtgttggtaaaaacagggatgctcacgaaatcaagcaatacaccaaacaatgcagccccaattgccactgacacaacggtttttgtatcccaactgccaagtaatttttttgaataactttctttcttttcaattaacatatcaatctctccattccgaatttcaaataaataatagccaacatcagcaaattaaaaagcgccctcgtatatttacgaggacgcttttcacgtggtaccaccttgttttgaacattactgttccttagagttggctttccggaaaaccaactacacatgctgataacgaagcgaaccgtctaaaatcaatttagcctttaacgcgaaacactcatgacccatattcgattatttggaaaggctgactctcacctgacacagctctcttgaacaatccgcattaatctactcagtcaatcaacgtgctttaatttgtatgcattaaactaacactcatttaatgtgaatgtcaagatatttttttaaattacttttaattttcgtcactgacatttgacatttttgcttgtcttttttaatgctatgcgtcttagaacaactgggctgataaaactgttgaatctaaagtagcaactaactggtaacttgaatcaccacataaaaattgcttgtttcccaacaatttaagtgattatttattctactcgttcccggtgaatggccatatacccagtacactttttcgcttaaagtttcctgcttcttccaaattgaatcatgtagatcactccaaacaacagccacgaccagttatttaattaatcaaattataaaaaatggatcagttgtgtgtgtttcaaaaaaagtgttgacaataataaatttctggattactattttcccaatcttttaattctattttaataatcctgtgagaagaagagtagctgaacagattagttaaagagagtccatgttaggtgaaattggatatcaatctcaaagtgaagatgaacttcaaaaaggagctatccggtatttgctggatagaccggtaggaaccgttaacttccctggtattatcaagtactgttggaggcattatgattttttgtaatgcgaatttagggtggtaaagcgattaaagtcgccccttgtttgtcattaaatgacagcaaggggcgacttttttattaacaacagaattcatcagattagagaaacagttttaggcattttattcattagagaattgattatatctttaggaggtattatttcatggcggaaaacataagcattgagagcggccttaaagtcagcctttcaacaagagatttattagtatatggcattacattcatgattccagtcgcaccattggctttttatggatcattcttagcaccggcaaacggaatggttgcgttggcatattttgtaggaatggttgcgatgctctttaccgggtttagctacgcaacaatgtccgctcagtatccgttttccggatcagtttatacgtatgtacagcaaggaaccaatgctggcctgggattcatcggcggctggggaattacgcttgattacttcctaattccaaccattacctacttaattagtcaatcgtttggtgaatcattattccccgcgattcctggttgggcgtggattgtcgtgttagtactattcaatacggttatcaatatcttgggagcaaacgttgtaacaaagattagctgggttttgttcgcactccaggggattgtccttgttgcattcatcattggcacaattcgtttgctcttatcaggcactatccaacctcaagcaatttctttctataatccacagcatttcaacattcaaggggttctccaagcaactggaattgtaatcgtcagctacctggggtttgatgcgatcagtaccctttctgaagaagccgaagatccacatcattcagttggaagagctattattctttcaattctgttaattggtattctgttcgtcgtgattactgtccttgcaggatttgttgcacctgactaccagagcttaaatccaaataccgcttttcttggcattctgcaacgagttgggggtacttggttggttaagctggcagacatcacaattattctttcatttggatttgcgagcggacaagaaggtcaaaccgctgtttcaagaattttatatgcaatgggtcgcgatggcattttgccatctgcatttgccaagcttcaccaaaaatatcggacaccgatttttgcaatcatcttagtgggagcagtttccctgattctttctttaaccctttcacaggatatcgtttcaaatcttgttagtttcggcgccctatttggatttattttgttgaatttatcagttatttggaaattcttcattaaaggtgatcatagctctgttttatcatttatcaaatacttcgtctcaccattcattggctttgctgtcagcacttggattttcgtgagcctatcaatcgaatcaaaaattgtcggcgtgatttgggtcttagttggcgttgcaattctaattgcaaaaacccgcttcttttcaaaaaagacaccaagtttagatttttctagcaaagattaggaggaattttattatgacaactactactgatacaagcatcaaatttacagaaaaggtttcaaaaccacaatctatcgaaaaagttgttgaacaattaaaatcatttaagtgggtggacctaacccattcatttggacccgagagcccacgtttcccttcatttgctcagccaaaattcaatacaatttttactcattccgatggcttcttcgtaaaagaatatacttttcccggccaattcgggacacatattgatcccccaattcactttgatgatcatcaggataaatatattgaagacttttctcttaaggaattggttcttcctctcgtggtaatcgatcattcaagcgctgcaaaaaaggatccggatgcttcactatctgtcaatgacattaaagaatgggaaaaggagcatggcaagattcccgaaaagtcgtttgtggctttacgtaccgattggtctaaacgctggccgagtcaggaaaaatttgaaaatttagatgataacaggcaagcccattatcccggttgggacttggacgccttaaaatttatttatgagaaacgtggtatcttagctaatggtcatgaaacctttgacactgataccgcaaccaaacaggaacatggcctgatcggtgagtactacgttctttctcatggtcattatcaggttgaattactggacaaccttgaccttgtacccgcaactggagcttatatctttatttcagtcccaaaagcagaaaaagcaccaggatttcctgtcagagcgtttgcggttattcctaattagatttgttgacaaaataaagaagagtcctaccaataattggcagagctcttttttactttgttcctataaatattgttcatttaaatcttaataattacccgcaataatcaacttcttgtttgcagtaataaatcgaccatcattcaactggtaacgagtagttaaattatgcttaaccaacttcttaactgttagacgaacgcctttcttgtaatgcttagttttaccagtcaagttagccgatttatatgcattgacacccttacgtgaaattactgtaactcgtttggattttggaacactagcataataaacgggtaccacatatttccggctggcagtaatgtaaccggtcttgccagctgtcttgcgaccatgattgacatcgcgaaccttatatcttaaaacgccattggttgtccgcttatatccagtgacgacaaacattggtcggttaactcgtttttgcttaggataccaaaccaaatgattcttgccagtgaagttaccccctctgtacatgccaatcttcttaatggcataaacagctgccccttttactacagcattttgcccacttggagttggaaccacaggtttaggagtaggcgtcggtgtcgtggtacctggactagctggtgttgaaggccctgttggtgtctgcggagttgttggtgaagttgcaggcggtagttgttgccctgcagaggagccacccgaaccacttgaactgccagtatattcaaacgtaacggcaattggtcgatcaccataagtgcctttcaaatctccggtagtcttgctgaaagagtatccaggaattgttaattgataatcatttccggaaacatcgtaacttgtgcccagataaccactgatcgtgcgtgggtcagcaatctttttaccattttgatcaacgtaatttaacgtaactgtttgcttagcagccggagcttgttgccaaacccaagtttcggtattctgtcgtggttgttcaaaatgtttgttcaagttggtaccactcaataacggccccgttgggttatggccgtcagtactggtaccggcctcctgccaatttggaccattattattaaaagtagctcctggaaaatctagatcagtgaattgagggttaccaggggcagcaggtagcccaatggcactcacctcttcttgaggccaaacatttttaataattgtattggggccaatttttattttccataaaccatgtagtaatgaatcaactgggatattagcaagattcgcagttatgccaagcattgcatctgttcccttgccaatatcggttaaattagcagcttttcgcgtatcaaaattagaaagatcaagtgactttaattcatcatttccgccaaacattccagccatatctgtaacattggatgtaacaaattttaatccaaacgttattttggccaatctactaccaccacctgaagaagaaaggatttgctgaaacatcccggtcatcttattaacattctttgtattaaagtctaccaagttaagtgattcaagatttggatccaatgagaacatgctttccatttccattacatttgatgtatcaatgccattttcgaatattatagatgaaacatctaaaattcccgcaaacagtccattacaattttctggaaaaataaccccttttgaaacatagattgtcttgacatttttggcaatagaaaatatgagcactgaaagaccatctgctggaaagctaactccatcttctataataattttgctcaccaggttactctgaaataatttgtaaacatcacttgaggttcctgcaaagaaattttccatcatacccgcatgaatcgtcaacgtcccattctccaaactcaaaggacaggttccccacttaaagtccaaatagccatcactattaacccggtcaacgttggccggcgtactattcgtagccgcctcctgattcaaaactttctctcgctgttcctgaagttctttaacaatatccggtggacccacatttaatggtgaattacttgtcgtcgcatccgccaatgccatcgtcgtacagaaaacaagtccaacagccagtcccatcaatccagcagctaaccaacgaaaatatcccttcatagatcggcctatctttgcgaaataatgacatctcatgataaatcccccttgtgtctttcaaaccttttgtgacaataatcacttttggcttaaaagagcctcaacaagtaaccattcaacgtttttccgaatattcatcgtgtgataacaaataccaactaaattatggctttattatatatacagaaggataatatgggaaataatatgcctttaaaatccataaaaatgcttgttcaaacattaacattcgcatgctgaattacgttctcgctcaaaaagttggctatcaaaagtggcttttcaatcgaagttcaaatttattgataaaaaagttcaattaaagttcaatggccttgacaatatgaattgcattaacgtctctatgaatgggatctactaaatattccggactaaaaaagtccaccaattgatatgacagactttctcaaaactatttaaatacacaaaaatacttagaattagcggaaacataaccaccagcacccgataacgcaacacatcaagttccgtatgatcattttcgtttgattaatcataccaataagctttcagcatctcattcttggcgcctccctcggcttttcttcaccgaattagcattccacatagtaattcgccgtcttgtcttaactgactttacttggttatagcggtccatcatgaccaacttccgtttagccgtgatatagcgatcattagttaacgcgtatccggtttaccgaactgaagtcaaccaatgattgccaaagacgaaaaagaatgttcggtaattatgataataacgatacttggatttaatcacccggccacccccggtactcatcaaataccgtgaaacaaaaacctttgatcctttgtgcaaataaccggcaaaatgaaatcggttgttggcttcactgtttccggttgttacccggtaaacccggactgtctttcttgcccgaactaaatgagtcgcctcacgggcatagccgtttccattcaaatacgcagcatttgtcccaatgggcattgcaaagaacagcagccccaacgccaacgttgtcagtaatattaaatattttttcacagtattatcccttactttctccaattgattctttaattacgattcaagtatagtataacgattgaaggatgatcgttcttattcgaaaaaaattagtaattttcaaagccgcaaaagtcctgatcattacgttgcgtgtgatcatccgccctgtaacggctaccccccccaatttttcagtccaatgattaataaattactatcactaatggaaattaattcaatattaaggccaaaatcattgctacaattttgtagcaatgatattctatatatataaatagccggagaaatcgaatggtaaaagcaagtactcaaaccatcacccgcttcttaattgatttcaaaaaagctttgtcgcatggtgattgggaaatcgttgaacgccgagcagattacgcacagatgaccgaaatgcccgcaaaagccattaaaattgttttgctggggctaacaccaaaggattatgtgcggggaccggaagctgaccgcaatggttcgggtgaatatgtttgggtgtttttaaaaaatggcgttattgaacgcaagttgtacataaaattaaaattaatcaacggtcacgcgaaagttctttctttccatgagtcgttatatgactaagcaggggagatgatttttatggaaacaacttatgtaaagtcaattgatgaaatttatacaattcggggtgaaaagattacagttaatgccccaacacgatttaatagcaaaaccaatgaacaagtttttgatgaagaactggacaatcgggctgtaaatcaggctttagatgtttaccgtgccaatcataacgtgattagtcccagccggattaaagctttgagacataaatttggtcttaatcagcgggactttgcatcctttctagcatggagtccaacgaccattgcaacttatgaaacgggcgcattgccatcaacggctaacgatcaattcctaaaaagcctagagtcggatgattcaagtttcgctaatcgtttgtataaaaacactaaaagcaagatgactgaacgaggcagaaaagccttcgaacaaagcatcaggaaatcaaacccaaataaggcttcagaccttattgacaaggggattaacgaatattttgctgatacaaattttactgagtattcaggctttagcaagtttgatttaaaaaaatttaccagcatggttcttttctttgtgaacaaggtaccgaagttaactaaaactaagctaaacaaattaatgttttattcggattttaaatactttaacgatcatactgtctctataagcggtgcttcgtatgctaaattaccgcatggcccagttcctaatcagtacagtttattgtatgcttccatggaaagcgccaatttaattgatgaagacgtaaccagttttcagcagtatcaatggaattattaccaagccaataaagatactgatcattccctttttaacgaggatgagctggctactttaaacgctgttgctgagaaattcggtaatttgtcaactaaatccgtttccgaaatttcacatgaagaaaaagcatggttggaaaatgagactgggcaattaatttcatatgaatatgccactgagttgtcgattcttaatgggtaaaattgtttatgcaggaatttcaataagatgatgcaagaaattagcaatgagcaatcacaaatgaaatatttctccttgaattaaaaatggagatgttttgcccaacatacaggaaaaggactctggtgaaattgccagaatcctttttttacttctaatccatatgaaagtcattcggctctaataattgccagcaatgattaacttcttcgtagtcacgaaccgatactcagctgataaaaggcttcagattatgtttaactggtaatggcaaataaacgcattaatagcatccaaattaaaaggtgttttttagtgcatttattcacaaatatgttatattgtaaacgcttcaagatgacgtatgacgcaattaacaatttcttagggggcctttatcatggaaaaagttaatcaacgatactcaagcacgcttattagatggttatccacaattttaatcgccgttgttgcagtcattgccgtattcgtggtaaatccaaacaaagtcgccgctcaatccgggccttccgattacagtatcgcgtacggccgctatagtccagagaacaccgtcgatgtgatcggatcgattctagatctcaacacaccagaaacggccgttgaatttacgacacccgcgaatgggttcctttatattgaggatatgaatcacgcggaagcaagttggtctgccaataacaccaacctcactgtcaccaaagacccggtcgaccttgggtacaaagttagcggtctgaccacaatcccttccggaacgattgtgatgctcaccgcccattatcgtgataattcgaccaatagcttttatttcaaaattgaacaatcggttagccaagttgttgccgccagctatggcttttataattctgaaggtctcgttgacggctttacgagcattaaacccaatacaagtcaaacagccattccactgaaatcgcctaacacaggtgaattctatttggaagacgtcaatgatttcaatggtacctggtccgccgataacaccaagcttcaggtcacaaaagatcctcgctttgagggctataaagttagtggtttaaattcactggctgccaatacagtcgttaaatttacgattcaacatagttatggctcaacaagcgatttctactttaaggttgaaccgacaaccccgacccatgatgccaatgttggttatggtttctatggtgctgatggatcgattggtggtctgacaaacattgatccaaacacaaatcaaaccccaattttactcactgcaccaaatgacggtcgtatttacttggaagatatgaatgattcaaaaaccacttggacttctgataattctaaactttcaattgtaaaagaccctcgtcgagatggtttccaaatcagcaaattaacttcacttacttcaggaactgtggttaaattcaccgctcatcatagtaacggtcagaccaatgacttttactttaaagttactgttaattcaactcccggtggcggatcaaccggtggtggcacaggtagtggaacctcacctaatccagtcacgccacctgcaaacactaccccaacccctggcagtccaacatcaccagtaaccccaccaaataatccaaccacaccaacaagcccaaccacgaccaatccggaaacaacaccttcaacaaccggtaacgtcacagccaagggtggcgtggtttacgcggtaaaaaaaattggtttgtacaagagtcccaatttcaaaaagtcacagcgaattgcttggtaccctaagcagaaacggattaaccgcccaatgtttgtcgtcaccggttatgctcgttcaactaatggctcttttagatacaaagttcgtgatgtcaaccatggtcgcaaaactgctggtaagacgggctacattactgttagtcgaaattatgtggcacccgtttattatgcaacattacccaagaataaaaaaataaccgtgattgccaaaaaaggcgttaatgcttataaatcagcaagcttaactggcaaaattaaacattataagaagaatgtccgattaaccgttaagaaactggttaaacacaacttgaccactcgttatcaattgagtaatggatcgtttgtgacggctaataagaaattggtcattcagggagcttactaacgaccaaaagaccaaactggttttattaatcggtaaaccaaatatatcacgctatcacaatcagaaagagacgccatcaaatcaccaacttttcgtaactggtgatttgatggcgcctttttaaattagacagtttaactttatcgcaagttgtgcaacatattgataaaatgttcatgacgctcgacagagtttctttggcaaaaaagattatcgcaaatagcaactaagtttaaataaacaccaatatttgatttaaaacgggttataatcaaaacgttaagtaaaaattacataagttgagggatgattttacaacgatacatcataaaatagttaagcattcagacgccattattagatcaactaaagcagcaaaaaaatcatatgtttatttgacaggtcttagacataagacattcaagctggccaatcattattttaatttgataagttaatttcaatttcagaactagtcttacttaaaagttcagaaaaatattaggaggattatgcttaatgaaaactaaaaacattctgatcacgacagttgcaactttactgttcgttccggcattcagtagtccagccaaagcctcaacatggcatcgctatacccctatcattctaagaggccattggtattctttgcgaaaatataacgtaatgggcactcgtttaagatatttttgtgttctgaaaaagaactatttcaatgccggcgggcttagcgaccctgtattaaataacagaattcaatatcagcatcaagcaaacagtcatagttacctgattaagtgccatgaaacattttactctcacggcgctcagacaaattattacaaatttattttacaaaaatcaaatgtaacaaacaaagcgtaccggttgaaattcaaatttttaggaagtcgaacgcttaactatcatcacaataagttctatcgaggtacaggttcatatggaaagtggctgtatcgataaactgtaaatcagccaagttaaaaaggattccggcaaaattttgtcagaaccctttttagtttgatctatgaagaagtcacagtaattctaatagttacccgcaataactaacttcttattggcggtaacaaagtgaccgttgcttaactgataacgagtagttaaattatgcttaaccaacttcttaactgttaaacgagtgcccttcttgtagtgcttagctttgccagttaaattagccgacttgtaagtgttgacacccttacgagaaatgaccgtaatcttcttcgactttggaacacttgcatagtaaacaggaaccacgtactttcgactagcggtgatatagcccttcttaccagcagtcttgcgaccatggttgacatcacgtactttgtatctcaaagcgccattggcagcacgcttataaccagtgaccacaaacattgggcggttaacccgcttttgcttaggataccaagcaacccgattagctttggtaaacttggtattcttatacaaaccgatcttctttgtagcataaacggcttcacctttaacggcaatattaggacctactgaagtggaaggtttggttgtcgtagttggtgtagaactgcttgaactaccagttgatgatgaagatccatttgtggtactactgctagaagaactagtagtatccgatggtgttgtggttgtaccaccaccagagttattcccgacaataacatgaatcgtcttcttaaatgtcattttattaccgtttgcataagaaaatggataactgtaagtgatatcaaatgagccggtttgactggtattcactgttccatcggcattcaaaggtcgggtgcttgtgatgtttggttttgcatcagttaagacctttgcttgggacatttgctgtggatcccaaatcttaacattatctgctggattccactttgcaccaggattaagaatcaattgatcttgatcattaattccattgacatcgataactttaacaatttgaatttgaagagcgccaattccgttctggttcatccattcgctcccaccagtagaacccgagtcatcctttttagtaggactccatacataccgtggtaaaaagtttccatttgcataagcaggcgcaccataaccattatcctgaagtgtctgaactaaattattaccgttgacatccttcaagtcttgataattaagatagaagtaaccgccagtataaaagtaaggaaaatcattctttgttggatcgtatgttgcatcgaagtcattgataaccgtatccttagcctggatgaccggcattaagttttggatatcagttgcatgaaaatatttgagatcaggagttcgatatgtgaccagatacttattagttccgttaattccgaattgtttatttgcatcagcgacacgggcaaatctcatattagcgttatgatattgaaagtcagaccaattagctgtcgttaatttgaatgacgaattattaccatacacatcaacattcttaggatccaatagctttaagggaacgtctaaacgatattgatctcccttgttcttcaaagtgccgctaacatggatcgcagtcactccctgccaatccgacgcggtccaactaccagtatttgctgccggggttgtatcggctgatttccgagcgtatagaaccgacactccctgagtagcactgtcgctggttggactcacaggaccctctttgccgtaaacgggcaaattagaatttggcgtttctgtgcttcgataaaattgtggcaatccaaacgaaatataaaagctcattggactatcagactcatttttaagcaaaatgtgttcatataatgagtcgggtttttgaatataactgtcaagattcagaattgagttagttccctgaactacattgcctgtgggacttacataattagaatcttgattatccagactaatccacgacgtaaagtactgattgggctgttcctgtccccctgaaacgttggtcacaaaatcccgctctggcggttgagttccattataaacagctctgttcatatcagccggttcatccgcgttagcagtagttgctatcgcagtcgctccaaacataaaaaaagttgcggataacaaagcaattttaaataaatgctttaatccgcgatgcgtatctatactcaaataaaccactcccccaataaaatttagcactttataactacagcactattacaatttcataatagcatatatatatatatatatatcaatgcatcaatacattaaaggtaattgtttacacctaaacaataacagtttatagtcacggtctacttagctgcaattaacttatgcgtttaccctactcgcaattgatcttttcaattacgaagattatcaatttctcgtaaattagattcaccgaacaataatggcatgcctttctggaaaataggcatgccattgttaataattatttattattttcgttacccttcaatcagtcgtcttaacaatctccttaatctgttctgccaatcccttcaaggtgttcgtcggttcgggcttaacatgctgattggtaaacagaatgaccccgttttgattatcctcatccatgtccataccattttcataactcgtatttgaaagtgttccccgaacccacttttgattatcatcctcatgatataagccaccatgataaccattattaccaagtgatgtgtgccctgaatacgctaaatagttgtaatcatctttaatcagaatttggccgtcttcaagtccctgctgaatttttagatagtcttcgggggtgctgtatagattgcctgcgccaaccaccgatgataacaaggcctgggatggaaatgccggatcttgattatcctgtttgccatctgaatgagcactttcagccacaaccgcattattaggtttctgatcccagaagaacgtatgcttcagacccaatttttggatgattcgggtgttcaccagttgctcgtagctctgattggtaattttctttaaaatacctgccaaaattgtatagttggcattggtataatcaaatttctgttccggctgtcctgacttcagattatcaatcgtatattgaatggcgtcatcttcactcaggacgtttgtcggtgttagttcatccatatcaattcctgaaacgtgatccaataaatcacgcatggtaattttatcggcattcggaatctttgggaaataatcacttagcatttctttctgatttaactttgaatgagtttcattcactaactgggtaaaaatcgccccagtaatcaccttttgcaacgaagccaacgggaaaacaacattctcattggcattttttacggcacttgttgcattgccgacattaatcgaatgtgactgcccgttcttaacaatagccactcggcctgaaatgtgttgtccttgcaagagttgagtcaccttactgtcgatggctgcccacttatcacccggttggccggaagaaggccctgccgactggctggttgaagtacttgaactcgtcgattgaacaactggctgattaactgtaacggttttcaccggggtctgaacagtgaccgtcttgggagcttcctgactttgattttgactttccagaattgtttggccaaccactcggccattgattaattgaaaatcactaccagacttcgtgatttttccagttgatgaggagctaattgctttcttttgggacaaaaacgcgttaaatagcctttgagccacaacttggggatcccctgataaatcagcatggtagccaatcgtttggacattgtttttcaaatcttcctgtgataactggtttcccagcaaactgtcataatgatcctcaagggcttggtaattcgactcggttggcttttggtaataaagcttgaaacttgccagcattttcttggctgcagttgaaatagcggagtcagattgtgaattagtggcattgttagtctttaaatcattttgaagtaactcgtcaaatgcttggccaacttttgaaagttgactatccgactcaggggtattcttcagtaatttgcgaatattatttggtaaggcacgcactgataaccaaccgctttcatgccgactacctttagaaatcgtcaaatagaccagtgaatgacgatcagttgtttgacctgctgaattgatcttcacatgatagctccctggattgactgtactaatctttttagttttagattgattccataaattctgtggccgagtcacttgaagaatagcttgaatggtattaggctttgaagaaactgcctcaatactcaattggtggctggggctgcttgttggagctgtggcgctgggaatggtgacctgtgtcggctcataagttgtgttggtggtggctaaactggaatcacttgatgacggaacagaattgccttcaccagtggcacttaaagtggtagctgatgttgttgccgctcgtgaggtgccaatatttgtgattaatggtaatgatccaccgataaccgttagtgagacgaaaaccagaaattgttgcttcgcttttcgaacccgcaaaacatgattgttttcccatttatgtaacattcaaaaaagtcctcctatccaagataacgtcataattactttgtacaggaggtattatattaggttggtgtaaatttgcggataatattgggatattaaagtgtaaaaaaattttctcttcttgaaataaatggtattgaatgattacccaacgtatcaccattcaaacatactcaatatcccaaccaattcttaataactttttcttatcagaatcgttaacttcattttccggcagagctaaacacaaaaatgccttaggccttgtcatagctacgtaatgagttttcatcaacattaaaaaaattttctgctttttttgtttgtcagttggtactccaccttctagaagtggaagtaatttttttaaacaataatcataataatggctttctaacactagtgtagcaaggtgcgtttgtccttttatcccgtgaatactgttcaaataaacatcaacttgtcgatgttttgtttcattacgataatggtatacgttggaatcattatcaaatgatctttttaagccaacgttatcctcctgccattcaataaagttgtgtgcagccttattgtcacccatttttttcataaaatatgtaaacttagtaagcaatttataccaatcttttttagtatcgatatcctggaataaagaagaaaaaacaacctctctaaatgaactcatttctttatcagataatgctttcttaaaaggtgaaaacggatattttcctccagattgataaacatttcctgctgctcgctgattagctacccgcctcagtccttcattaacctcaacaattgcccagtaagaggaatgtgttgtttgaagcaaaaactttgcatatctaaaataatcaattaagtatacaaaatctctttttaaagttgtagattgactcaacttaggcaaataatcatgataataattataaacaccacgagggaagaatttcgaatctgccttttcatctctatgatgaatgaatcctactgcaaagcatttcaaattcttattattctccaagacatcatctgaaaagttttttaatatcaaatcgccaaacttaggaagtacacgatcaatatgttgtttatcaaatagtaaaattttatttttgatatttgcataatttttttgtgatccagtcacacctttatcggtaatagctaatggacttgctaattttgcaatttgattggaaaatctttgactatcatttataacatatggttgaatttcattcgctgtcggaaaaaaagcagaatcattttctcttgtattttcaaatatttcttgattttggtcaccaaacgactgaactattgatgaattaaacgtaagcttaataagagttccttgtattaaacttgtatcttgggcttcatcaataaatacgagtggaaatctgcctgaaattattttagatatttcattatccgaccttaaagcatccagtgcatatagcaatacttctttataggtgtagattccattttcaattgaattttctatcgcattaatacacattttataggatgtcgttctagaactaataccatgcaatgaaatacgcccaatttggtttgcatattgaatgtcgtaacctgtattacctctcttactcaaagaatacaaatatttccttggaattttgctctttcgatatccagcagcaatatcgtcatcaattatagaaatctttttaccttgagatctaatccacggagaagcaataaactcagaaaaaaaagagtcaattgttccaatgaaatgcgggtactgaagcaactgttgaccagctgatgttttaccaagcttatttttcacttcatcttttgctacgttagtatgtgataatacgcataacccctggtacggtatttgccatttacttgctaatatcccaatcttggcaactagcattgtggttttccctgtccctggaaatgcttgaacatctttaccatcaaatgccttgattaccttacgacgttccctgtcaaaatgtattccattacccaataatctctgaatattatcaatatcattatccgtaattttaaagttatccactaaaatcaagtcctttcagtaacataggttattgcctttacaagatatgaagggagactacgttttaattcttcttggtcttcggcatctccttgattaaattcactttcaagttcaacagaaagatactgggcaaactctgctttagaattagatctaaactttcgataaaaataagtagcctgttcctgaatatcagttcctttatcaatttcatctatgatttttcttgtgtttttttccgagaattcgtcatatacggttctagttaaagcatgaatcagacattccctcatgcgcttcttttttagaccgtaaaatgccaactcgtactcgagcgtccagtgtccagataaaaatgttttaatctcctgtccactagcttttgacttaatattcgatatgtatgctgctaattccgcattatcataatcagattcaacatgccattttctattattgggataacttcccttaacataatccttatttttgtaataaattttaggagcacaatcaggcataatatcacgatcagtaatacaagcaacgtttacgcccaaaggctttccatcgcgccgattaaaaatattagcatatctacgtaaccctttactgcgaacatcaacaatagacactccgaaatcaacgaagtccattccaataagtttcgataacgttggaagtaatagctcttctcctggccctccacaataacaactcctctagcaaaaaagagattagattttgtagcatctaaatatttttctaaatattgataatcatcggggcttaagtttgtatagagaggtcccataggaaaggattcaccatctttgataattactatgttttttagtgttgctaccgatgcaagtagcgttgaatgagttgtaagtatgatttgatggtgaagattattggcctcgttctctaaggaacgcattagcttcatttgcctttgcggatgaatatgcgcctctggttcttcaattaatagaaatttactagcgtcttcaaaattcttttttaacagtagttcgcatgccatactcataatattactcgttcctaacccgggtaatcccctgaatacggaacttgattcatcaacagtcaagccaattttttccagcaaataagccttcttctgttcatcagatttggaagattgaggtacttgaaattttgttagtaagtcatcatttttcaaaagcatctcgttactcaaagtttgtgacatcatttcgctttcttttgccaagggcggatattttgctaatagatcatttgcaagattgaatataccgattaacgacaaattgcttaaatcttcaccactcttatactcgtcaattccttcatttaggttcggaactgctcgcataacttgtgcaagacgtgaacttctacctggctgcatgtcaaggtatgcatctcttagtgccttaagatatgtaaccctaaatctctccttcaccctttgtataaagggattaccattaccgtccttacctgatttttcttcaataattggtctgggcgttgaaaattcctcactgtaatgacagcgccaattaatatatacaacaggttcattcttctcataaaataaatattctgacatctcacttttctcatgattactaaggtcagaaaacttcacctgaatttcaatgtcttttgttgtatcttcattatgaaaatcagtcggaactaccctattccaatgcaaatccgtggtaccaagtacatacctcaatgcatcaataatcgccgattttccagagtcgttttcaccaactaagattgttactcccttgttaaaatggataatatgatctttatcatcaaatttccgaaagtttttaatttttaagttcgaaatatacacagaaaccactccaaatctaatttaataacataagttaaaaagtcaccaagttacattactatttttctcataaaaaaccatctcatagaaactaaaggtgcatttaattctacggatatacaaactatattaattgatttatagtactaatccgaactaactatctacgatctaccagaacattagatcagtgacgaactttttccatgctaaacttgtacgattagatagttattttttctaatttccagtctgtttctccaattttccttgctttatctaaggataactcatttaaattaaactgtcttctcgcttctttaatttcaaaaactcaataccgattttgcttgaaaaagaaagcaaagggtcttacccttcgttggcaggtaggactctgcatattcagctaattgcgttaggttacctgctaccgatactgattcgttaagtatcgttacttatgacgcttcatactgagacctttggctgataaaatcgtcccaataacagtaacgctaatcgatccgccaaggttacccaaagcgttaatatgtattgagagcatcatcaacaccttgttttatactgggttggttacctgcttctaggctggttacctagatgtttgtccatgatttcctttcttgacattgcaagattgggtttacatgcttgtaaagactacttctaattggaggccgcctttttttgagataaaagaaattgcaccaaacactttttgacatttattattgaaggcaaatatattttagatcagccataataagcagacacagcatactttgaaccagccataatgttttccggtcctgctcaccgtctttcaatcttagctcacatcaaaatcaatcataataaaaatacaattaacgccaccattttcgtcattatgagcaacatttttctcgtaacacaattgtttgtgattatcttaataatcggagtccaaaaacgccctgcttcttttcggggatgttaaaatacagatgaaagcggattcaaaaaacgtcgcttccagttctttacttgttatcgctgctttcaactcgaaagaagggaaaaattatggaaaatagttctaaaagaacaaccaaccgttggctaatcattttcggcacaattctcattcaagtgtccgctggttcattctatgcttggtcaatctttaacaatggatttatgttaaaatccggtggtgttgttcaaacggtcggtggggttaaaaagattgtcgggggactcccggcaggatcagtcagttttacatttactttaggaatgctttgtttgtcattggcaacgttagccgggattccactggctaaaaaatatggtatcaaaattattgctctttgtgcctctgttatttatggtcttgctatcttaggtttaatgatgattggtaaagggtcgtcaatttggatgctgtggctatttggtggcgttttgcttggcgcaatgaacggtgtcctttatttaacaacgcttacgaacgcgattaaatggttcccagagaaaaaagggctaatttcagggattagtgttgccagttatggtcttggttcatttatttttaaatatattgatatggcaattgccggtggtaatggtgccattacggctgaaaacattgatcgggtcttactttggtggggaattctggcattaatcctggcaggtattggatcattcttcctgaaggatgcacccgataatatggctgttccatcaagttcaaataataatttagatactgctgcagataaaaccaactttacaacttctgaaatgctacgcacctcgcaagcttatatgatgtttttttgcctgacaaccgctgttatgtttatgggactcttgggtgccgcggtaactaacatggctgctgccggaactcaggctccaagtgaagtctcggtttggggtggtaccagtgccgctgcaacctttgtggcaatcgttgccttggctaatacgattggccgatttatcatgggctggttatccgatatcacaggtcgaaagacggtatttctcatcaccttcaccatccaactcctcgcattaatcgcactattgctgacaaaaccgggcgctatgagtatggcaatgatgtatgttgttgttatcgcgatggccttttgttttggtggtaatattacggtatttccaacttttgtttccgattattttggactaaaaaatacgtcacgaaattattctatgatctatcaaggatttggaattggcgcaattatcgttggcttcttgatggcttccggtaaccctctaaatcctcaaaaggtcgttctttctgacggcgcagtcttaactcaaaactttaatttaacttactgggtacttctgattatggtcattatttcattagtcatttttgcatttattaaaaaaccagttaaaaagtaattaatctgataccatttttaacaagtccaaagaacaacttcataaataaatcaaaccaaagaggattccggcaatatttgtcagaatcctctttggtttgatttataaagatgtcttgttcaatctaatgattaccggcaataatcaacttcttattagcggtaataaagtgaccattacttaactgataacgagtggctaaatgatgtctaaccaatttcttaacggttaaacgaatccccttcttgtaatgcttaaccttaccagtcaaactggccgtcttataagcagtcacaccctttggcgagatgactgtcacttttttggacttcggaacgcttgcgtaataaacggatacaacgtacttgggactagcagtaatataaccagtcttgcccgccgtcttacgaccatggttaacgtcgcggaccttatatcttaaggccccgttagctgctcgtttatatcccgttaccctaaacatcggccggttagcccgattttgctttggataccaggcaagtcgcttggctgctgagaatcgcgttgattgatacaagccaatcttttttactgagtaaacgacagctcctttaactgcggcataagaaggctcagcaattgttgaaccaggctttgtcggtgtctttgatgcagctggcgcgtttggcctgatcggtgtgcttggattaattggtgttgctggtgttgaagacgtggtcgttgatcctgggtaactagttgagccagaaccgccatttctagcataaacaaacgttacagtttgaggatcttttccaaaaacaagcttatttggcagcttgctttgatccaatgtgtagttattaatagtcagtttgtatgctggcgcgttcacattaaacgtgtcgccaataaatcctggtacaatctgtggatcatgaatttgctgaccattttcatcaacatatttaaccgtcaccttgccagcatcaattcccttttgatcccaaacatacgttttatcagtcgtcggtttattagcatttgcgtacaaattaattaaatcaagtgctctgtattgggtcccggttggatggtgaacactgccattgccaacttctcgccagtcttgaccagtgttttggaacgccatattaggcatatcaatatcggaaaaagttgtcggattagtgcttgttccagttggatcttctaaataaacattggattgtaaatcagtatttggaccaagtttcagctcccaaagattatgaagtccttgtaacatgccatcaaaatcagttactttagcggtattaaatttcccggaaagatcaagcttttgtaaggcactgttagtaggcatgtagaacatcgagtccatgttagtcacctggctggtatcataattcgataaatccaacttagttaacttagaactgttactaaacatatcgcccatatcagtaactcaatcggcgactgtggtgttaggccatggccggtaggaataatagcagcgctcaattttccaggaccaactgttaaggtatctccagaaacagtacacttactggttccccaagaaaaactggtttcggcatcctttgaactggcacttgccaccctgacagcattattactaccaatctgacttgcgttaacgtttactgatgatgctgcaaccataccaccactaaatgctaataatcccacacaaacaaataaccatttgcgcttatgaacaactcgacaatttcccgtattcaacggaataagccccctctaatcatgattacaggttcaactaaacatttcataagcggtatcattaatgccgtttataaaatgttatttgttaataaaggttaatccctgtatcacttttagtgtaacagtcttacagtcgctttcaaccccgcgaaattgacattcttcataatcaccattgaattctaataatatgaaacctacaatttcttctaatgcgtattaagctatctcgtttttagaaaaggcaaaaaaattccccttcatttcacaatttggttaatgctccaaactgattataatgaagggaagtttttcacgttaaagcttttctctcacaagtaaaacttgtggttcatttcgcgacattaatgaaactaggcgacacagcgccgataaaatatcaactccgtgccgcctagaaaaaaggcaagcaaagattcattttaacttttgaaacccgcctcattttctgtcttttttgccccaatttataaggaaatattaataatgcctaactaccagcagtaattccagcaattacacattgtccattcaagaacttaaataaacgcctacacaattaattcattcgaatgataattaatgatatcagagtctaaaattaagccattatgtcctcttagttgcttagctatgaaccaaggcgtatcttttctatgggttaaattaaactccgggtttttagaattaccattagtccaaacttgattatagtaatcaccatatttattaacattgctttttattgtgtcgataatggccaccctatcatctcggttcattaaactacaatcaaatagggtatctttaacaagctcatctctatgatgtttattcaaggcataaacgttcttatcgaccggtcccgcatcataagcaataaattttgcttgaaaaagtcttgaatttttatttctaagccattcagcgtaaatgtaataaagcaccttttccaaagcaaagggtttaagttcaaaatttcttactaaataggacgcaacacttttggcaccaacttggttattatcatcaattttctttaagaaatcggaaaaattactgattacaaaagtatccttaaagtatggatccatattgcttacagaatcaaaacttttaccatccgcctttaagatgtgaaaactaaatgccgaggaatactttgtaaagagaggtgtattagcaagggattcctgtttatctaaaacatcgcttatttcgtttgatgaaaaatgataagcaacttttttcccatcaatcttagtaaaagctatcaaatgaatcatactaactacccgccttccctttcgtcttcatgtcggccatgctcgtaataattgtttgaagcatccagtgtatcccagatttgtaactcccacggaaagtacctattatcagtttggaaataacaatgaatcccaaaataccttccatcacgtctagtataataccttttaatcactttggagtgtttatagtcgtctaacaacgcgattacttcattaaaattttccctgaccctcggaacaataagtcttagaccacagagatcgttaatagtttttgagatatagacatcaccattatggtcatttttaacgttgtagtgtcgaagctttgcagtaacggtccctatgtacttaaatcgatacctgcaattataatcgttatattgaaataataataagcttcttttaagttgacgattattattcaatgatcctaaatagtcaggaacaactatcaataaaaaatctgtatcctctaaagcctttttaacacttagttttttaaaattatattgtttaacgtgacacttttcataatattctttagaaaacgaacaatacattgcataatactgttcaataactgctttgataatacgacagggatcatccaacatacacacctacatttaccttcagatgttgtaatcctatcatatcaaggttaaaagtcaataatgatttttctataataggaaccatattgtaatacataatttaaaattaattttactcggttcaccgtaactgaattagcttgctaaatgcaaaccacaaactctgattcggcaaaaatttggcaccattttatgacaaatttttccttcagaactactcagaagcgcctaattttaaaaaattcaacacccaagttctgtgaaataatgcaaacgacttgttaactttcaaaaaccaatattacctcgacaacacttaaactccaccatccctcaccaagccggaccaaatacccacacccaaaaattgttaaataacacaaaccaaatgtgtttttttaaacaaactctggttgattttttgtaaacgctttagtgtttaacccatttcataatcgcctaaagcccggtattctgtatacgtaagcgattacagaatatcaaaacgtcgattatcaatgaggaggttcacactaatgaaatccaattatttcactatccagcaaaatagccggggtgcaataaccgggttaaggttcaatgatgaccccaccaacatgaattgggtcattgatcccaactatctcaagtcacttaattatcaggatgaagacaaactatttggtgaatttcacatcacggttaatgatcacaaatatcgaagcattgatcaaacaccgatcattcacaaaaccgacgaccaaagtcagctcacctttgcctttgatgacgttaaagtttccgaaacattcgaactcgtcaatgatcgtctaaaatggcagattcagcttgaaaatactggttcaaatccgataacgatcaacgactttggcgtttggatcagcctagcctacgtgatgttccgggacaaagatgtgcatcgaaacgcaaatcaatcagccgctgtctttccgagcatctcgcccaactataccaagctggccgcagtaagacgtgataatatcgcgcccaacctgggtgtttatcaaattggcggcgaagtcctttctgtcggcacctacaacgaatacacgaaccgcttttttgaaaatgtttccccttcattagacgggatgctttttcatgaatttgttctggctggcggctattcagatgatcagcgcccccatcacgattggatttatccccaaacagcgattaacctgtccgctaaccaatcccgttcatgggacttcgtgctccaatcatatacggatcaagcagacttttaccacgttgcccaacaattgggtcatccccacattcaatttgaaccactcgtccaagccgatcaaaaacaaaccattcgcatctcaccagcggacaatcagcaagtcgccaccatcaaagttcggtcacaacagacgcttgaagaagacttaacagccaatttcaccaatggcagtttgaactaccaacccaaaggactcggcgaacatgaattgatcgtgacctttactgacggcaccaccgatatcggcgtcttcaacgtcatggcatcaatttcgaaattacttcgcgaccgtgcggactacttgtgtgatcattcctatactggaaaaaccggtaagatcccatatagttttagccccgtttccaaccaaggtgagtccattggcaagatgacgttcattcttcaggaatgcctactcgacgccagcatttcagactcatctcaaaagattcaagaagtcgaaaccagtgcggttaactatgtccggccaaaatggttcgtcgatggcgacttcaaacatccccgcaaattatacggtgacttttaccgcgtcatggacctggaatacattgcccatttattctatctcttatctaaatgtccggcagatgccctaaagcttcacacccccaaagaatatctcgcgtgggcggctgaagtcttcgatgttcgggtcaaccccgatttgcatgataaccaacggggtaaagaagaagctcaaatgttaggcgtttacttcatgtacattgaagacctcttgaaggacgttaaaatggcgggtctggacaaagaatattctgaaatctcccaggcttggcaaaccgctaccgaacgagttgaaaaaaacagcccccaactgctggccgccatgaccgaacacttctttgacaatgccggctttggccccgctgcggcggccttagcattaacccatcaccaatccggtgccaagatctatggtgaattattgaaagccaacatcggctttagtaatgatttcagatctcagagcccggatcgctggtgggaagccctctcctatatgattcactcactatggggtggtgtcactgccgccgcagctcagatcaccggcgaacagttaggtgatgtggccttggttcaagccgcctatcgagcaaccaacgcggtgctttatatgtatgatgccaacgcaaccgcgaccgaccggaaactccaacctggcgaagcagcttccacttacagcattgccggccctaatctgaaccgcccgaatttatcccgaaatcggtttggccaatccatctttgcttcggatggcggcatctttgcccgactatttccagatggctataccggcgaagatgactgggatatgggagaagaactcgtggcctacttaaacggctttggtcaaaccacctatctatacgcggatactgacggcaactaccaagcgattaacggagctgttaaaaagcatgccgataaccattatgaagtgaccagctttgccccttatattcatcggtatatcgatttagataccggtaagcaatttaattcaacgagtctcactgttaacttcgatgctaacaagcaattatttagtcaattgtaatttggagggattaacatgaaaagttctgttggaaacgcaatcaatagcaaagttaaaattccatttcatagaatgctggcctacgcaagtaccgatgcagctggtaacttactttacacaacggttacgacttttattttgtattactttaccgatgtttttggcctatccatcgccgcagccggaaccatcctgctggcagcccgaattttagatgcgtttgatgcgccaatttggggattcattattgaccatacccataccaaatgggggcaaagccgaccgtattggctttggatggcctttccattcgcaatcttctttgttttaatgttctggtcaccgaatttgagtacgaccggtaagttctggtgggccttaattacctacctgctgttcggaatctcatacactgggattggaacaccgattacgtcaattttgccgaacttaagtaatgattccgatcaacgaatcaaattgaacagtaccagaagtattggtggcatgatcggctacttcatcacggcaaccttcaccttaagcttcgtgtcgttctttggcagtaccccacaatccggctggcgaaataccgcgattgtgcttggcattattggatttgcactgttaatgtttgccttcgcagacacccgtgaaattaataagccaaaaaaggccgtttcaattcttagttcaattaaagcagctaaatcaaactggccttggttcattttagtgattgtctttatcttctactggttgggaaacgcatcacgaacatcagttgttgtttactatacccaatacaatttaggccaaaaaggctttgcctcaatcctaaacgcgttggtaatggtccaattagtcggaatgattgcgattccattcttagttaagaaattcagaaaaacctatgtgttaatggccggcatgttcttagccgctttcggtcaaattctaattgcgttcaccggtcagtcattgatcgccctgtcagttgcctggtcaattgcttcaatcggaaccgggatttccgttaccctaccattcgcaatgttagctgacaccgttgactacggcgaatggaaaaacggcatccgagccagtggtttcttaaccgccattggaagttccttcgccattaaaatgggatccggccttggtggctatgccccatccgttgttttggcacacgctggttataaagccggcgccgttcaaaacagccaggtcctgtcagccattaaattcagtatttcttatttacccgcaatcttctttatcatcggtggcctgctgattctgctctacatcaagtttgaaaaacaggaaaccggcattcgaacaaccttgttggaacgccgtggtagtttaaacgaagactaatcaaatcgaaaatgactactgctaacgtttgaggtcatcactaaacgacaattagccgttatcagtagctctatcaggaggaatttaaatgaaagctcttttaaaagttgatcccgcaaatcaaatttcaaccattgatgagcgcatttacggctcatttatcgaacaattaggccgagccgtttatgacggtatttaccagcctggtcaggcaactgccgataaggacggtctgcgtcaggatgtgatcgacgcggtgaaaaagttaaatgtcccgattgtccgttatccaggtggtaactttgtttcccagtataagtgggaagatggcattggccccaaggaagaccggccaactcgcttagatctggcttggcggtcaattgaaaccaatcaatttggcctgcatgaatttatgaattgggcagataaagtcggcacaaaagccaacatggcggtgaacttaggcacccggggcatcatggctgccgctaacctagtggaatactgtaactttccgaagggatcctattggagtgacttgcggcgccaaaatggtcaggagaaaccgtacaatatcaagacttggtgtctgggtaatgaaatggacggcccttgggaaattggtcaaaagaccgcttatgaatatggccacttagccaatgaagctgctaaagccatgcgggcggttgacgattccatcgagctggttgcctgtggcagttcttcaatggacaatcccacatttggtgattgggaaaagaccgtcttggatcaatgttatgataacgtggactacctgtcccttcaccgttactatggctactatggtgatgacgaccccaacgaactcgataattacttgggtaaaaatattgatttggatgacttcatcaagggcgttgtcgcaatttgtgacgcggtaaaggctcgcaaacgaacgaagaaaaccatcaacctttcactggacgaatggaatgtttggtatcattccaacgatcaggatgccaagacagccccatggcaaaaagcgcctcacctcttggaggatgtttataattttgaagatgccttattggtcggcagtttattaatcaccttgttgaaaaatagtgaccgggttaaaattgcctgtctcgcgcaactggtaaacgtgattgccccgatcatgactaacgatcagaaggtttggttccaatcaatcttctatccttacatgcaggtttcaaattatggcaaggggatcgctttaacccccaaagttgatgtgccaacttacaagtcacgtgagttcgatgccgtgccatatcttgacagcattgccacttatgacaaaccacagaaaacaatcaccatctttgcggagaacaagaatcaatctgagaagatcgactttaaaaccctcttcagagacttagacgttgaacaagtgattgaagcaacccaattctatggttacgatgtcaaagctgataaccgggacgggaaaatgaagcttcaaccattaagcgccacggttgacgatcatgaagttaaggcgcagttacagccgctttcttggaatatgatccgggttcgggttaaataaccagctaaatgccaacctatttttaattgaaagcaagccaatcacggatcttgtggttattgctacctagctaaaatgtgtgcaaccaagtagcccccggccatataagccccctaacgtgatattccaaattcaggaatatcacgttagggggcttatattctgggatctaatcgcttggcggcacactctggtttttaaacttctcccgatacgtaaccggcgaagcgccatagtatcgcttaaagacggttgaaaaatagtaaatattgttgtacccaacatcaagggcaatctggctgactgattcggtggtcattaacaagcgtttggcagcttcctcaagccggtacttggttaaaaaggcattaggggtcattccgaatgtctttttcatacttagcgcaattgaattaggatgaacatggaattgcttgcccaacgaggcgttcgtaattcgctcatcaaagtggtcacgcaaataacgttcgatattttcagccagttgggcatacgaagactcgccttttaccttgacctgaatgatttgcagtaagtcaatgaactgttgttgcgcctgccaaaagccaacgttgttctgcaacgcgctatttttaaaaatccggttaatcagtttaaaagtcacttctgaatctggaattcgctgcagtttttttaagcacaaagtgaccgacggcgtgaaatagtgcaatgtgggaatgttgatcttggaactgacatcgactggctcgggttcttgaacccaccggccgctaactgagaaatggacccagtaatattcggttcgagcttcaaccggtttccaggcatagtggtgatgttgcggtaatagaatgaaattatcacctggtttaagcgtatagttctgaccgtcctccgcgataaataaagtccctttaacgataaacatcaagacaaagtattgtaaatcattccgattgggatgcatttcaccgggatcaaaaatcgcatagccgccttgaataaatgttggtagcgggatgcaggaaattgagatgtattcgtcttccatagcttgttcctttcgaaatcgcttttatgtttctagtataagcgatttttgtggaatttacgaaagcggtttaatgaaatttttagaagtaaggaggggatcactctaactacttcaaaattgggttgatgactttctgggcaaaaaagatattttcaataccaacatcattggctcaattctcacttttatttcgtttaggatcttagcatcaataatcagtttgtttttccaatatgtgtacttaaaaaatatttattaatactattaatcacctctcgttacgttaaatcttttatgtttactaatcctattgaatcaacctttttccgagttgcgatgtctagtgatggtatagaaagaaataactctttttttgctcgactcatagcaacgtaataaaccctatcagtttcattagtactagcaagattaggctccagcataaacgaaagcaatttttctttcttggtactgtgatcacctattacaattaatactgcgtctgcttcatcacctttagactgatgaatagttctaaaagttgaatcagcaccttctaaaaccatctcagataataaatggccaatcttcatccctaaaaacaacttactcctcttagtaatttttaccatacattttgaaatgctcgtagaattcgcctttttaatgtttttgtccaacacatttctgttaaaccaactaccgacgtcttcattaatacattcactaaaactttggtatatactgacaaatctcgacataatataattttgtgtggcattagtccctacatatgcttgaaaaaacttatcaattcccacatctacttgtccatcaaatgttatcttcatagctttaataatacgaaaaataaatttcccccttttgtcaaataccatatctttaattctttcttttacattggaaggcggaattaatccagaagaaggtttaaattgctcaacgcattcattgctatagcttaaaactaacttagtttcttctttatttttggaatgagttttcaaaaaataactaatagcttcccttgtatctccaactaatataagtggtttaggtccagaaacttttggtagatcttgttgtgaatccgctgctgtgatactattcaaaagcatcacaatttggtcactacttctatgattttctccaataaaataattattcagattcggcaaactaaaattctcaaacgtttttctgcttgaatgtgcaaaaccataaatcgattgatttttatcaccaattatgccaactatgcttccataatgcgcgaatattttgataatatccgcttgaatttccgatgtatcttgaaattcatcaacaaaaataaatgggaaacatttagaaattattttcgcaataaatggatttttccttaaaattagtaaagataaaaacaggacatcctcataattaattatcccatttttccagcatatctgcttatactccataaaaaaatcactgtcgttctttatcctatttttagttttgtaaattccctcatccttaggtaaaatcgaaagtttataattatccccatctttttcaaaaaagatttttcttccaattttaatccgcgtcttgtcgttcaatagccaattatatttatactttttacacaacttttgaaaatcaggaaagctcacggattgatatggatcaatacgaatgtcagttgacagagaatatttaccatccaatgtccaagcatacggaaatagtacacagtcggccaaaaaactatgaatcgttgaaacataaatactatcagatgtattcttgattcttctagcaagattatttgcagcaatgttagtgtaagtgatggcaagaacttttcttaattcagaaactttagaggaattagttaatattttctcaatatgattagcgagaaagtgagttttacccgctccgggtcctgcggtgatcatgaaattttcatttatagttaatcctttagtggcgttcagcttttttatcataattcttgtctccaattatttatcaatccattttaagcatttctctacatacttgggaatatgaaaatctttaacaccgttttccaatttttcggcaagttcctgagaatataaacccttatccttaatagaccacaggaaaactgttgcgatgaattgacttatcaaacaatctttatcaagcgttttatctttatttttgttatcatctaataacttttccagtgtgttaattaatttctttacacgttcactttggaatgagttatgaaactgagaaaatgtaaaatctggatcctttttactctgaataagttcttctaaaccagaaatattctttaatgacgtataattttcatcaaataaattcgattgttcttggttctccagcattagttgatattcaaatgtccatcctgcatttggatcttgagtaaatacttcaatgttactagaatttagtttacgaatgtcggcaatattgttatttccagatttacacttagctagtgtctccgaatccagtgtatgtcttaaaataggtggaaatgtttttttatttaaaattgggtcaaagtctgtcacacacgcaaccttcttatatattgcattagttgggttgccaaatgtatcaaacatgtgtaaaaaaggtataaaataacgccccgacaaattgatcaccgtaacatgttgattttgaatatgttttttattcatttttataaattgtggaaaaagcatctgctcagctaatccttcaacaaaaatgatcttatctgtaaagaacaagttagatctggtaacgtccaaaaaccgttcgacaaattttttatccttcttattactaaacgttttccctggataaccaattttaacttttccattatatttactgagaacaatcagatcatctagatttgctgcggctgtgatgtttggtgaatgagtggttataattacctgcctagctgtttcactattttccccatcttgaatattttctctcaaaaattttagaaaatcatattgcatatctggatgaagatgtgcctctggctcttctattagcaagaagggaaaaatacttgcattatcaccaaaatacgaagttgatcgactttgttgaagttctgctagaaccagtgaaatatagagtaaattattatagcctaatccatttaaatttatgggtatatcaaaccctctgtttttcacaactaaatttacttcttttaaaatattgcgatcatttaatgcttcgctaaagtcaggttcctcaccatcgaacgcagctccagtttgctctgaatattttagcatttgtttttttccttcatcaaaccgttgctttaatgcttccaataaaggcttggataatttcgaaaaacattgatgacgctcttgtattttttggtcaattgtttctttttttaatttactactacttttcaaatcataatcaagaaaaaagtttaaaagctcattcaataaatagctgtttccagaatgcattctcttttctgcattccgaattgcgggcaaatattgacaattaaatcgcttaagtgaatcatccattaacggccgttgagattctccaacaaaatatcttttttgatacttgggaaggaacccaccctgcaattccgaccatatagcatcaacactgttcagatctttaactgcatcaatataagcttttctatacttatcaggaagctgaaactgcattgtaatttcacactgatacaaatcaggctcgaatttagtcaaccatctttttattgctaaaagatcatcactattgctaccttcatcagttgacttttgaagcttaacttttataacaattttaggagcatctttttttagctcttcttttgaagatagcttactaaaatcatctatcgtcaacggcgctatctttctatcaaagattaatcttatcgcggatattacggttgttttcccaacgttgttaggtccgaccaaaatatttacaccttccgtaaaattaacaaccgtcgtttctttaaacgtcctaaaattagtgatttcaatatttgatataaacacacttacatccccatagtttcttccaattcacttatctctattaatcaacaattattaagctaatcataccacagaaagttacccatctcgttcaacttttcggggtcatcacacaaagaaatcattatttgtaggcttggcagctttaggcttcgttgccgttgctggttcagctaacgctcaaaccgcttcagcaaaaagctatgctaaggttacatcaaacaaagccttaaccggcgacg

SEQ ID NO: 685 - DNA, 94977 bp, Unknown
  Metagenome-assembled genome
aattttgaccattatcgaactaggattcaaatggaattatttgcttaattcaattaatgcaaaagaaaaagcaaatcctttcggatttgctatataagctgatatcaacctcagttgacaaagagtcaattacttttgttccagccccgttttgtgtaatcacgattattaccgagcaaaaacgtgagataaaaggcaacttcctgccgtacaaccgaattatcccactattctacccgaagcatattcggataatccagttgtactctggaagttaaccgccttttgtctcactctatttttttcttgcaaaaaaatgattaataaacttattttattagaagggttgacatttaattaaagaatatctatacttctagtcaatcaataaattcttggcaaggaggttgtcacaatggaaaagtttaattcagattgttacatgttcgtggcaactctcacgaaccaagatttagccttattattaaagatgaaggacccgacgttgatctggtagtttgtgataactactcatttcagatcaaaaaagttgagcccttatttcatttttaatgatgagggcttgataaaacaagatttcaaacctcattcattaaagaatgaggtttttttattgcattgggaggcgattgggtttggagaaatacttaaggcaaagcggttaagccgtatttgggtttagcggatccatgatcgggaattgacgtgtacatataaattgaaagtgggtattggatatgaaaaagagtgcgattaaaaaagtggttagttttgctgcaattgtgatgacagcaggaatttttgcgggatgtagtactgctaaaacgcaaaccaaggggaacacgcaaactgggaatacagttaaaatcggggtcaacatggagctttcaggtgcagcagcaggctatgggaactcacaaaagcaaggtattcaattagctgcccagcaaattaataaaaatggtggaattaatgttaatggtaagaagaaaaagatcaagctgatcattcgggataataaaacttctacgaccacatcagcttctgttgcggctcagctgactaacaacgataaagtttcagccattgttggcccagcaactacaaatgccggaactgcagaaattccaaatatcactaaagcggccgtaccaagtgtcagtccatcggcgactgatccaaattacaccaagcaaaagaatggtaaagttcaaccgtatgttttccgggcttgctaccaaaataatttccaagggggaactgccgctaaatttatgacaaataatttaaaagcaaaacgagttgcagtatacgccgataattcaagtgattatggaactggtttggcaaaagcctttaagaaatcgttcaaaggaaccattgttgacagtcagtacttctcagaaggcgataaggatttcaatgctgtgttgacatcatttaaatcaaagaagattgacgcaatctatgttcctgggtattacacagaggttggattgattgttaagcaggcgcgtcaaaatggcatcaacgtcccaattgttggtagtgatggtatggctgatccaaaattggctcagattgctggcgataagaatgcttcaaaggtctattacacaacaccgttctctgatgacgttgctaaaagtaatccaacagccgttaaatttatgaacgaatataaggctaaatatcatgctgatgccccaacattttcagctttggcctatgattctgtttacatgattaaatcagcaattgaaagtgaaaaatcggccgattcagtcaaaattgcccaaggattggctaagattaaagatttcgatggtgtgacaggcaagattacgatcaataaaaatcatgatcctgagaagccgattgcgattgaacaactgacaaatggtaaggtaagcaattcgttcaatatcaaataatataataagcgtaaaatctttgaacaatcgtttaagaacgcactttgcctcagctaaagggaggatttaaaattgcaaacagtttttcaacaaattattaatgggctttcattaggaagtatttatgctctgctggctctggggtacacaatggtttacggcatcattaagttaatcaactttgcccatggtgatatttatatgcttggcgcgttctggggatactacgtgataaatgtttggcattttaactttattagcgcgctactttcagcaatgcttgttggtgcggctagtggtgtgattattgagtatttcgcttatcgaccgttgcggcattcgccacggattaccgcattaattactgcaattggcgtgtcattctttttggaaaatgggatgtcttatctgtttagttcgaatactcgggattttccacaaattatcaaacaggttaattacaatcttggcggcgttttaatttcaaacattcaaattttgatattagtaacggcttgcatcttgatggtcttattgcagctcatcattaagaagacaaagatgggacgcgcaatgcgggcggtttctgttgatccggatgcagctgaacttgttggcattaatattaattggacaatttcatttacgtttgcactgggatcagctttggccggcgccgctggagtattaattggattgtattacaactcaattgacccattgatgggaatgacgcctggtattaaagcatttgttgcagcggttcttgggggcattggttcggttcccggtgcttcggttggtggctttttgattggtatcttggaaacgttcttccagtcgatcggactttctgcatacaaagatgccgttgtttacttcgttctgattgttattttgctaatcatgccggcaggaatttttggcaaaaataccaaagaaaaggtttaggtgatcaattttgaaaacaaattttaaatacaatattatttggttcatcattatggtcgctggcttttatctgatgaatacgttaatcctagttggcgttattaacacgtttatcgaaaacatgctggtcacaattgggatcaatattatcttggcaaccggtctgaacctgattattgggtttgcaggacagttttcacttggtcatgctggttttatggcaattggtgcttacgcaacggcaatcattacgcaaactgccacgacgccggttggcttttacctttctgtttttgcaggaattgttgtttcaattattgcagccctgattgttggtatcccaacactaagattacgtggtgattatttagcaatcgcgacaatgggtgccgctgaaattattcggattatcattaataacatgaaaattacgggtggtgccgcaggaatttttaatattccgcagttagcatcgtggccaacagtttacattatggtttgtgttaccaccattattattgtgaactttattcacagtcgtggtggccgtgccgtgacctcggttcgtgaggatgagattgcggctgaggcgatggggattaatatttttaagtggaagttagcggcttttgttctcggagctgctacagctgccgttgcaggatcgttgcatgcgtcattcttgcaaaccatttccccaaatgatttcggaatcatggaatcaatttcaattctaatcatcgtggttcttggtggcgttgggagtattaccggaacctttgttgccgcaattgtccttggtgtgttggataccgtattgcaagactttggggccttaagaatggtgatttacgctgtggcgctggtcttgattatgatctttaaaccatcagggattttaggaacttgggaattttcaatcaaacgaatttttaatcgatttaaaagaaaggaacgggtggagcaatgacgagtttactgcaagttgataatttggtaaaaaactttggtggcttaacggctgtttcaaacgtttccatgcatttagataataatgaactggtcgcgttaattggacccaatggtgctgggaaaacaacgttatttaacttactaacgggggttattccggtgtcttcaggctcaattgttctcaaaggcgatgacggcaccttcgctttaaatggtaagccggcttatcgaattgccaaactgggcctctcacgaacctttcaaaacattcggttatttaagaatttgtcggttcttgacaatgttctaattgccatgacgagtcgatccaaagaaggatttattgccagcatttttagattaccaagttactataaaacggaaaaacaattagttgaagaagctactaaattgttgactatttttgaactggaagatgacatggatgtgttggcaaaaaacctaccttacgggactcagcgccgattggaaattgttcgcgcactagcgactaaaccgcaaattttatttttggatgaaccggcggctggaatgaaccctgaagaaacggccaatttgacacagttgattctgaaagttcaacatcggtttcacatcacagttttgttgattgaacacgacatgtcattagttatgaatttggcagaacgaatctacgtgttggatcatggttcattgttggcggaaggaacgccggatgaaattaaagctaatcataaagtgattaaggcctatctgggagaaggagagtgatgacgcgatgatgttacaagttgagaaattagttgttaactatggtgtcattaatgccgtcaaaggggtcagctttaatattaaccagggcgaaatcgtgtcactgattggtgctaatggtgctgggaagacaacggtattaaagacaatttcgggtttgttaaagcccaagagtggcaaaatcgtttatgaaaatcaagaaattcagcgacaaaaagcaccaaaagttgtcgccgaagggatttcccaagttccggaaggtcggcacatttttccggggctatcagtgatggagaaccttcagatgggtgctttcttgattaaggatcgtcaaaaggttaaacaaagttttgatgaagttttcgaacggtttccgattttaaaacaacgaaaaaatcaggatgcggcaacattgtcaggtggcgagcagcaaatgttagcgatgggaagagccttaatggccaggccaaaactaatattattggatgagccctcgatgggattggcaccaattttcattaacgaaatttttgatattatcaaagaaattaacaatcatgggacaactgttttactaattgaacaaaatgctaaaaaggccctttcaatttcggatcgagggtatgttctttcgactggcaacgttcagttaacgggtagtggtgaagagctgctggccaatgaagaagttcaaaaagcatatttgggaggttagcagaaatgagtgtaagagattttatgtccaccaatgtgatcaccgtaacacctgaaactaaaattagcattgccgttaacattatgaaggaaaatgatattcatcgactaccggtaattgacgacgggcaattggtcggtttagtcactgaagggattattcaagcggcatcgccttcaaaggcaaccagcctatcgatttatgagtataattatctgcttaacaaaatgacagttaaggaagtcatgacaacgactgtccgaacgattgatgctgatgattttttggaggatgcgattcatgaaatgcggaaatatcaaattggtgttttaccggttatgagtgacggtgagacgattggtattatcacaaataatgatattttggatgcctttttggatgtgacggactataacgaaccaggaactgtggttcaagtcttcatccgtaaagatcgcaccggagttatttacgagattggtaaaataatggctgagaatggattaaacattcaaacattaatggtcacgcaccaagggaccacgaaagtcgttgaaattcacgttgataaaaaggatggcttctctgttgccagcaaattgagtgatgctgggttcgatgccaaagaatctgaacgttataaacggccaatgtaaattgaaagaatatttttggtgtacattgacaaagtgattgaatgagattatagtatccttaaaattcaatgataaataaatgataatagcatttgatgagaagagtagttaagttgacggccagcagagatcccggatgatgggaaagggagtccgaatgtttaatgaagatgagctctgaaaacaaactatttggttcacgccaaataatcggttgcaaccgttaccttgcacggtatcaataggtactggtaagtggctgttattatgacagcaataagggtggtaacacgatgaattcgccccttagtcgatgttgagtcgactgaggggcgaatttttttgaatttatttattaattgatatctcgggaggaattctatgaagcgatcattattattgagtcttggtatcctaacggcaggaacactgttattgagcggctgcggtcaaaataaggctgatagcaataaaaataaaacattcaagacaactgcacaaacgaatgttattacggttgatcccaaccgggcaacagacattggcagtaatttagcgattaatcaggttctcgaagggctgtacaaacagaacaatcagggcaagattgttccgtctattgcaacaaaaattgtgaaacccaccagtcatggtacggtttacacgtttaatttaagaaaaaatgctaaatggaatgacggcagtcgcgtaactgcccaggattttgcagcttcctttagacgacaagttgatcccaagactaaatcacaacgggcgcagcatttggcagattttgctggctaccaacaggtttcgactggtaaggccccaactagtcaactaggagttaaggtacttggaaaatataaattacagattcgtttgagtcatgccgtcccatattataattatgtgattgcaacgcagctatatccaatcaatcgaaaagatttggcgaagtggggcagtcagtatggccaaaattctgctcatgcttcgtcagacggtgcctatgaaattaaaaattggaattcatcatccgatacttggaaccttgttaaaaataaggattactacaatgctggtaaggtatcgataagaaagatcaacttccaggttgtcaaaacaccgcaaactagtttgcagttgtttaaatccggcgatctcgatgaaactcaaatttccggcagtttagtttcagatgccaaaaggcaatttaagaaggaagtcgtggttaataaatatgggcaggtcgcctttattccatggaacaactatcacaaaacaacccggaatcttaatctaaggcgggcaattagttactcacttgatcgccagtcgctggccaaaaacgtgcttaaggatggttcaattgcagcccaatcggttgtgccggaaggtgaagttaaggatgccggcggcaaggactttaatgcgggtgtgacgcctaaattggcgtataatctgactaaggcacgccattactttgcgttggcccagcagcagcttggtaaaaagaaaattagttttcaattactaacagcagacaccgacgcttataaggcagttgcggagtatattcaggcccaagctaagaaggtgtcacctgatcttaatgtgtctgttcgatccattccgcttgaacaggaaatctctgattttaccaatcacaagtttgaagctggcacacttgggtggtcaactgattttccagatcccattgattatcttaatttggctgccaaagatgggacaattaactttaccgaatggactaacgcaaagtatcaatcgttaattaataagattaatgatacggctgatcaaaagccggcgcaacgagttaaactacagcaacaagccgcttcgttattgaaccaactccagggtgtaacgccactgtatcagtatgcatcggttcatttgcgaacaaataaggtaactggtctggactatccattgattggttatcaaaagtacgagtatgcaaagtggaaataagctggttaacttgattgcgggttattcgtgtgacaggttggtgtaaatgaaacaagaagtttttgataacgggtgatataaaaggagactttatctttatgacagtaaaagttggtgtggcaagtaatcatttgattcatccaattccccggtttgacgttaattttgttgattatattcaacgggactatattgacggacttcggcaggctgacgctttaccacttgtcctaccgttaggtgatcctaaagacgccaaagcctatattgagcaggttgacgctttagtcctatctggcggccaaggcgttacacctgtgttgtatggggatgaacccattaaagaagttgctgagacagatatctatcgtgatcagtttgaaattgcgttggttaaagccgctgtcaaagctcacaaaccggtactaggaatttgccgtggcgagcaaattattaacgttgccttgggtggcacgctttttcaagatatctataaacaaatgggcgctgttggaaagcataatcagtttccaacttcttgggaaattccaacgcaacatgtgacgactaccgacggctcttggttgaatcaaattcttggtgaacgttttttggttaatacctttcatcaccaggccattcatcaattgggtgagaatttaaagtcagtcgccgaaagtgatgatcatgttgtggaggcgattgagtcccaggacggcaacatcattggggtccaatttcatcccgaaatgatgtttaaaacccatcctgagtttgcaaaagttttcgattattttgtggatcgggttcgggcgggaagttaaccgctttttgtatcaagtttccatttggtaatgaccatgattacaacacaaaacaaggccgggacaaattcattttgtcccggccttgttttgttgtacctaatataaaacccgcttaagttgtcggttttttgtacaaataattcagagacctgtcacctatgaaatagggatgttactactatgaacagcagcccatgattgaacaaagacggtgccaagaatcaagacagcacctgttgtttcaaagagtccaaagtgggtacctaaaaatgtaattgacaggaatgttgctgataatggttcaaaggaacccagtacactggcagttgttggttgaataaaagttaagctttgtaggaagaacaagtaagcgaacattgtgccaaaaatcaccacaaaagagacgccgccatacgttgaccatttgaaaggtggcatatgatcccagatcctataaaataagctgaaggccaccccgccaatcagcattgaccagccgacaattggaatcgacccataagttcgcaataaggttcgcggtaacatcgtgtaaagggatgcgctaacagccgtcccgagaccccagagaaagcctcccattggaatggttaatgttgttaaactaccatgggtaacaagtagaattgttccggtgagtgccattaagagagaaagaacatcaactctgcggggtaagtgtttggtacttaatgctagataaataataattaatgctggtgataggaattgtaaaatggttgccgtggcagcgtttccctcctcgattgccttaaaatatgtatattgggaagcggccatcccgataaaactgaagaaaataaggtagactgcatcgtgaaaatgatgccagacggccaaattttgtttgcgatcggtgaccagcccaaagaaaactaataaaattcctgagataagcattcggactgataccaaccaatttgaactgatattaacatcggcgaacaaaaattgggcggttgtcccagagatgccccatagtaatggcccaaggatggccagactaattcctttaattttggggttttgcatgatggttcctccatataaacaacgggttttaagaaacaatttttaagatatcattaacaagcgtcacggggactggctgattgaagtcaatattcagccgtttttgacccgttacataacccaactgtttagcatgttcaatgacatcatcagtcaagtcagcagagatggctaagcttacgtgtgattgataggcagcaatgctaatctttttgtgatcaaagatgtaaaatggctgcatgtaactgatcttttcttcggcatcgggaaaggtgtgccggattatttctcttaacttgattagaagaggttgcgcatttggtgaagcagttgaaatgtagtcgtcaatatccgtaactttttgtttttttggcaaattagattcctccattaatatcattgaaattattatagcgcttttctttttatgacaaatgcaaaaaagagtcgggataggtcagaaatgtctttttttaaaataaatactcccgatattccgattgttttggaaaatcaggagcatttatttatctgattcagttcttatattttgtttggatattggtcatagcaataaaaaaggcaaagtaaacttatcctctgatcacgatagttattgcaaggtttgtaggatttggataacactatcttgataacccgatccaaattgcgataaatgaaacatcaaataatatagttggtaaaatgggatgcgctgttcatagcccttactcagtggatattcatcttgataacctttgtaaaaatcttgattaaaaccgccaaaaacgtgagtgattcccaaatcgaattcgcgatcaccgtagaagacagcgggatcgattaaaaccgggttaccagttaagtcaaacataaagttacctgaccataagtcaccatgaagtagggatggcgatgcttggtgagtggtcattaatttcttgaatcgtttaattgaccttgcatacatattttccatgtcgtgagtccataagtcccgattttcaataattttctttaagtcgttaagccgttgatcaataaaaaaagatttccaatccggccgccattgattattggcagtgtaagtccccattgtaaaatcttccttaaagccaaattgacgattaggactttttcgtttgtggagttgagccagctgctttcccagcttatattgatcgcctgatccttggtggtcgacataggttaataacaggtaggcgtcattttcaaattctccccaatcaagcactttgggaacggaaactgtttctgataataactgcaaaccagtaacctcatgtttgaaaaattccttagtgttgttagattggatgagtaaaaagtattttgtttgatcagccgttaagagcgcgtaggcatcgttaatgtctccaccaccgacggattgataatcgacaactttattaattggtagttgagtgaataaagttggattcattgatagtcacttctttcgtcacaaggataatcattcgctttcattctaacattaaatggcttaaagacagaggaacaaccattaaactgatgaccattgatttacggcttataataatattgcgggacaagtgataaagcctttgaaaaacagctcaaagtgcgttagagttacgttaacattttttaagattataggggggattacatatgctatttgatgagattgggcaaattatttttaataacgaaattgttgccaacgcaagtgattttaatatggggattgaagttgaaacaattcgaattgattcagctggtcggttaacgaatgagccatatcccaaagcgcttggaaatcaacgaaaaaatcattttattaagacggatgtttatcaaattcaaagtgaagtcatcacgcccacagcacgaaagtcattagacgccatgcactatttgatggcgttaaatgatacgttacgaaatgctttggaaccaaatgaattattgtggccgctaagtatgccaccaattttaccaaaggataaaaagagtattcccattgccaatgtcgagccgaaacaaaaagcctattatgaaaagtggattgagacccgtagcgatactcaaggaattccggttggtgtgcatttgaatgtcagcattaatgatgatgtcttgaaaacagtttgggagtcggagaaggataaattcggatcgtatgccgactttgttaattatatttatattaaaatctcccaaggatttgtttattatcggtggttgattacgtatttgtttggtaatagtccaattgctgaaaagaacttttttgagtcggatcaagatcagccacaacgtcccgttcgaagtattcgttcttctaactacggattaacctcagatgtcaaaaaagattatcgatcagttaaggattacgtcaataacttggaaaccaatattaaagaaggccatttgtttagcgaggctgaatatcatgctagtgtccgaattaaatctgtccatggtgatttgaccaacatggttaaaaacggggctgactatattgaattgcgaatgctggatcttgacccaacgactgcgctaggtgtgcgaacttccgcaatccgctttttccggattctattaagttatttcatgatgacaccaatgatgacaacacctgataaaattaatttgaagttagctcaaggaattgcgatgaatgaagtagtttcattggaaagcccaactcagcaaacgatttatcatcacgaagcacaaacgtttcttgatcaattacaaatgtttggcgctacgattcagtggggaccagagtatcaagaaatactggataccatgcaagaccggttggataatcctagattaacaccggcggcaacactttgtgatcatgaagtggatgggtctttgatgtcgtatggactggcagtggcaaatcgttatcagaatcgggctcatgaaaatcctaatccgtttacgggatttgaggaaaaacctgatatgaatgcggatgagctgcgacaacggttatttggtgttatggggaaacctgaaaattacaaaggacagtgattcgcgatggcagcagctgataaggggttgaataagcaactaattgcggacttggtgaatgccaaagttggccttgaagtggagactcatcgaattaatcatgatgggcaaataagccagtttgattatccgcatgatttattggatcaaaagcggcaccactttattaaaaatgattttttacaaactcagtctgaactaattacgccacccgcgttgtcgactcaaaagggattgcaatacctgggcgtctaccatcaagcactccgtggtgcgcttgcgagtggcgagcttctttggccgtatagcatgccaccacatatgaaggctgatcattcggatatcaaaattgctgaggtagattctgatagttatgtttatcgtcaaagagttgctaagatcagagatattcagcgaacatctgaaactggcgttcacgtcaacattgggttaaccggggatgtgattaacaccttgcaatcattgaatcccagcgattcgattgataatgtttatttgcaagccgcagttggttttatgcagtatcactggttgctgacctatctttttggggcgacaccgtatgcctttaaaaactatttttccgaaaagacccatgaacctgatcatccagttcgttcgatacgaaattcgaatctgggatatggtaatggctttctttcgagttatcaaagtgtcgcagaatatgtcaaacagatccatgtggctgttaataagcatcaaattattgctgagcgtgagtattacgggacagttcggttaaaacagagcgataaggtttctgacttgctttccaagggaattgcttacatcgagttgcgaatatacgatttggatccatttgaaccgacttttgtttcagctgatgcgattgatctgattcgcttaatgtttgcctacttcatatcccgaaattcttttaatcttagggttgctgatcaggaaattgcggttgcggttaagaaaaataaccaggttgctttggaaagtccattagcggttacgcgctatcaaacggaagcgatcaaatttattgcgagactcagcaagttttgtcagcatattacgctacctttcaacgccgaacagctttgccttaaaatgattgagcgaattgagaatccattagtaacgccaagtgcgcgactggttgaatgggcaaaatctgatcgaggggatttatttaacttacttttgaaacttgccaaagggtatcaaaatgatttagttaatcggccggttattgggtttgaatcgcgaaccagggaatcgcaaactgaaattttaaatcaattgcagcaagggaaaagtattctgatcaaatgaaaccattttggataatctgcttaaatgtttaaaaccctcgtcaccatcatgcttttggaggacaacaatcgagttgacaccaagaagagatggacaaaataatgtttttccaacctactgttttggttgagagattatcatagttagaggattgattcaggtgggttcagaattactttaaaatccgagtaatttttaataaaataagcggtcaagactaacattcctaatttgggaatatcaagcttggccgcttatattttttgaaagttaacaaacgataatacatggctatttgttcttctatcgcgttttttcagctaccttttggcttctttcaacaaagtccttaaacaatttttttgaatcttcaaaatgtttataaatattttccggatgccactgaactgccaaaatctggtcattattgatggattcaacactttcaataacttgatcgtctgctcgagctgttactttgaggtatggtgcgacatctttaacggcttgatgatggcgtgagttaacgtaaggccgttcaccaattaattggtttagtcggctggttggatcaacggtaatgtgatgtgaaggcatattaccaggtgcttcctgtgaatgtttcaatgtcgcgtgaagatcctgcgagagatcttgatataacgtgccgcctagtccaacgttaattaactgcattccgcggcaaatgccgaaaatagctttcccggctgtaacggattgttttaacagctcaatttcaaataggtcgcgttttaagtaggtcattcccaatttctgaaatggttcttcgccatagaaggtaggatcaacatccgccccacctaagaaacaaactccgtcaaataaggtcatataatcacgaacatcttcgggattgacactaggaaaaatgacggggaccccacctgatttaacgattgcttcaatggctggtcgaggagcaaacgcagcgtttcgttcattaataacgttggtagcttcggccagtgtatcagcaggtaatgcgattcttgggcgcataaaatccctccctggataaattaataatctgaaaaacttctaataaatctacgcccattagtgtacctcaaactaattaaaaaaggcaaaatttgacttatttaaaaaagaatgttaattactcttggtctttatcgttatcgggttcccaacttcccttgaataattgatgttttaactgacttggtgatagcttttgattattttcaaaccccttgaatggccgaatactttgtaaggctgattgctgataacgcatggctctacgtagcgcgtattcggttagtgaaccgttctttaagtgggtgattagtttagcgcttggagtcgttagtgggttttccacgcggtccattaaatcttcgagctcttcttgatattcggggccaagttgaattcgatcagcgtacatttctaatcgttgtaaaaacgcacgggcactggcttgataagctgagatgtcattaggatgctccgtggagatttcttcgttcatgtcatcagcgcgggcgacgactttgttaacctcttctggttttaatgcgggcgacatgataaagtagcttgccattagtctaaagaagcgtagcgtattggtccgaattccaactgagctgctgggatcgaggtcgagcattcggagttccaaatattcaacacctgttttaggtaattgctttaaatttgtatttcctttaaatcgaacggcaccgtgaaattcatagtcggagataagtttgccttcagagacgccttgttcgattcgatcaacgtatctctgaacggttgtatagtcaccatgaaatttatttccaaacccatgggaactttggcggatacttcgaattggcgctttaggtccttcaccaggtttgaaatagttttcttcggcaattgggctggcgccgaagaggtaggtaatgacccagcgataacgtaaaaatccttgggcaattttagcatagagatagttttgcagttcgacttttgattggaaacggtcatgcatgttatcgtaaaccaaattaaagacgtgagggtcaatacttaaattgatgtgagcaccgcagggggttccttcagaaaaaccgtgacgttttagccattcttttaaataggcttcttttttaggtcccattttagctaacggaattttactggtgtcttttggcagtcggggtggcattgataatggccacaacaattcaccgggtgataaagcagttcgaagcgcgttgttgatactgaacaggtaatgcatggcgtccaaagcatgggcagcaggtggcgtaacgacctcagacattgtttccaaaaagtcgttagtgatccatgggttgatccgttcatcaccagcggccgcgggatagggttcttgacttaattgtccggtttcatcaacccgttgcatttcgatttcgagtcccatggtaaaatcggaggtcttcgcaacggcttcgttatcaaagattaattggccaatttcactaaacatagcagcacctccatataaacaagaatattaaaatttaatgataattgatgagaaaagtgtaacacgagtgtgtcagctatacaatggcagagtgcgccagcagacggttagctcccagagtataagcttccccatcgaatattccggttttgaatatttgatggggaagcttatatggccgggagctgtctgctgagggataactttaatctggaaatttgatttacgtattaaaaagggactgggataatagtcaattgtcccagcctctaatcgtgtaaacacgaatgctactaagtggaaacgtgcgctaaaaggcaatttcctgccgcatagccgaattatccaaatattcaggcccgcaacattcggacgatccaattacgctctggaagttaaccgcctttcgtcccactctgtggagatggcgacgacccttttatattacggactcgaagttcctcagagtatggacggccgttagcttcatctccagtgtaacgaaaaagatccagtcagaagctgatttttatcagtttctaactggatctaatcttagattgtttatttttacagatttagtctgaccaaataattacagtagtggcttttgccagaaatgtttaaagaaactgccgtttttttctggcttaggaataatgccttctgtttgttttttctgctcatttttttctttcgttgctgttccggttgcgccatttgcttcggccgcttgcgctttatcaaaataatccgggtctaaataattgtgactttcgttgtctaaatcagccgaatcgatacttctctcactagacgtagtcaaattgccggagttgggtgctgaaattaaagccatttgtttttgaagtaccccaatttttttttcggcctcagaagttcgtttttcagcgaccaattgaagtcgctgtgattggtcgagtagtttcgtaaggttctcgatttggtcttgttggctcttgatgcggtcgtttaaggattcagcgaattcatttgcgattgaagactgcgaacctgtggctgattggttactggtagtcgtgccagtctgcctgatcgcgttttcaattgccgtttttgcagtgacatcaaaatacagagcctgtccctttttatatgcttctttaaggtttaatcgagagattgttcgatagactcgcattttattaaccccgagttcatcggcgatctgtttcattgtccatccttgttgttcatttttatccaacggaatcaccaccattatgcgttatgttatgtatcgatacacttcatcattcttattatacattaaatgacagatttacaataccaaatgtaatggttttaattgaaagccaaagcataagttaccttttattttacgttttggctcggtaacaatcgtgcttacacgaacagagactgggataaatgactattgtcccagcctcattatccaaatcccaaattctcttttattgattgggtcaaatccctataaaacagacgaatatgtgctattattatttctgtctaattaaattctaatgtttagaggtggaattatgagcatctttatcaagctgggatggtatttcaagcaagagtggaaaatctacctggttggactttgtggtttgctattaaccgcgttattggcaatcatcccgccacgcattattggagttttagttgatgcaattcataatggaaagttatcagctaaatacttgctaatcatgctggtggtattaacagtcgttgcctttggtcaatatggtgccaggtatatgtggcgaacagctatttggggagaagcagccaaacttgaaaaggttttgagaaaccgcctgttttggcattatacccaaatggatcatgagttttttcaacattatcgaaccggtgatttaatggcccatgcgaccaatgatttatctgccattcaacgggttgccggtggtggtattttgcagtttgccgactcaatgattactggtgggacaactttaattgctatggtcagtttaattgactggcgattgacgataatcgctgtcttaccgattcctttgcttgccgtgatggcacgttatctgggatcaaaaatccacattgctttccgtgattcacaggctgctttttctcgattaaacaataaggcggaggaaagtattaccggaataaaagtgattaaagggcttggtcaacagcaggaagatattaaggactttgatgaccaggttgcaacaacaattaatatcaatcgtcgtgttaacacattggattcattatttgatccgatgaccacgatgatcatttccctgtcatatgtcattacaattgtatatggtggttacttggttacttcaaatcagattaccatcggttcgctggtctcgtttgtatcgtatttggcaatgatgatctggccaatgttcgcggttggaatgttatttaatactttggaacgtggtaatgccagttatgaccgagtaatggatttattaaaccaacaaagtcacgttatcgatgatccccatggagtcgatcagaagccaaagggagaagttgattatgatattgagcaattttcatatccagatgataaacgatctgctttgaaaaatattcattttgaggttccagccggcaaaacagttgggttagtaggtcgagttggttctggtaagagcacaattttgcggttgatcttacgtcagtttgataattatcaaggcacaatcaaattcggtggaattgatattaaacattataaaatggacgacttgattccagcaattggatacgttccccaagatacgtttttgttttctgatacgattcgggaaaatattcggtttgcccaacctgaggcaagccaagaaaaggttgaaaaagccgctcaaaaaagtgacttatttaatcaaattaaagacttacccgagggatacgaaacggaagtcggcgaggaagggatttcattatcaggtggtcaacgacaacgattatcaattgccagggcactcttgattaatccagagttattaattcttgatgatgctttatcggctgttgatgctgaaacggaaacccagattcttgaaaacttacgggctgagcgccaagacaaaacgacgatcatttcggcgcaccgtttaagctcggttatgaacgctgatgaaatcctggttattaatgatgggaaaattaccgaacgtgggacccatgatgaactaatgcagcgtggtggctggtacaaagaaatgttcgaacgtcaagaactggaaaccaaagttaaagggggaaacagctgatggctgatcaaagttcaaagcatcaatccgcttgggctaaaagcatccctattaaacaacagcttcgtattattaagcgactgtttctgtacgcagcaccttataaatggtatttttatggctcactgattttagccgttgcggttgccattattaatattctgttacccagaattattcaaacgtatatggatagtcatctgatagtgggacataccaactttgcaatgatgtggttttttgcgggactttatctgttcggaatgattgtaaaagcattaatgcaatttgcccaatcatacacctatgaaatgggtgccgagtacatgctcgaaaacaccagacggaaactattcacaaaacttcacacgttaggtatgcggtattttgaccaaactccgagtggttcgatcctttcgcgattaacaaacgatacaatggcgtttgcaaacttctgggcattgtttaatagtctggttgtaacaatttccgcaatgatttcttcatttattgcgatgtattttgcggatgcagcaatcgcgctatggttacttgtttttatgccgtttttggcagtcaccgtgtggtattatcagcgatacagtacccgagtttatcggcgaatgcgtgagcgattgagtttattaaatgccaaactggccgagggaattactgggattagtgtgattcagcaattccgccaagagaagcgaattaatcatgaatttaacgataccaatgatcaatattacaacacgcggcgagcaatgattcgaattaattcgctactgttaaacccaatgattaatttgttctatgcactaggaagtgtattggttttagggatgtttggaattcgtggtctccatgggtacgttgcagccggaattatttatgcatttacaacttatctttccaacttttacaatccaatgtctgaaatgatggatcgcctaagtgattttcaggatggtgttgttgccggttcgcgagtgtttaaaataatggatgatcaaacacttgaaccacagcagcatccggttgctgatgcaaaaatcactcacggtaagattgaattcaagcatgtctcgttttcgtatgatggcgacaatgaagtgcttcatgatatttcatttgtggctgagccgggacaaacggtggcattggttggcgaaaccggtagtgggaaaacgtcaatgatcaatattttgatgcgtttttatgagtttggtcatggtgaaattcttattgatgatcgtgatattcgtgattatacaattgaagaattacgaaataaaatgggcttggttttgcaggaaccattcatgttttatgggacaattgcttcaaacataagaatgtttaatgagatgattactgatcaagaggttcacgacgcggctcatttcgtacaagccgataaatttattgaaaacttgccaaaacagtatgatgcgcgggtgatcgaacggggagccagctattcaagcggtcagcgacagttaatttcgtttgcccgtactttggttaccgatcccaagattttaatcttggatgaggcaactgcaaacattgacacggaaactgaacagatgattcagcaggggttaactaaactacaagagggtcgaacgaccattgcaattgctcatcgactatcaaccattcaaaacgctgacctaattttagttcttgaaaatggtcgaattgtggaaagaggtaataatgatcaattgttgaaaaaacgtggttattattatgatatgatccaattgcaaaattcagctcatttagattaacacttgaatgaggcgactgttaaattgtcttttaaaataaattgaattaaaaaaacgcacacttcggaaactgaattcgaagtgcgcgtttttttaattcacatatggcaattgattattgaatctcgatattgctgccaccgtcttcactttcggcaacctttgggcaagtgatactcaaaacaccgtcagtaatttcagcagtgatgtggtcacggtcgataccaggtaattcatagctgcgtgacataatcccgtggcttcgttcactggcaatgactcgacctttttcatcttttttttcggttgattgatcttggctgatattaattgccaaatcgccgttcttgtaagcaagatgaatgttcttcttatcaattccaggaacatcaactttcaagatatagttcttgtcggtttcgtggatatcggtcttcaaattgttttgacccatataatcattatcccagtctgttggattgaacattcggcgagtcataccatcaaagaaaggatccaatgcaaaacgattcattaattcattagccataataacaatctcctttgtagtttgaattaacaagcgtcaaaggcggtgaaacgggatgttgaaaccgttcccccaaacttttaattctttaattaattgttgaaatgaaatatttttgatctaaagttttaatcaaaatcattgaatttcaatgtgaccatctttatcttcagtttcagttactttaggtagggtgacactcaaaacaccatcactaacttgagctgaaatattatctttgtcaacacttggtagttcatagctgcgtgacattacaccatggctacgttcacttgcaataacacgtccctgttcatctttttgttcggtggcgtgttgctggctaatatttaaagataagataccattttgataggccaagtgaatgttctttttatcaacgcctgggacatcgatttttaatgaataatctttatcgctttctttgatatctgtctttaagttgccaaagtcagcgtaatcattatcagaatcacttggactgaaaagacgacgagccattcgatcaaaaataggatcaaatccgaaacgattcattaattcattagccataataccaatctccttattatcaatttttaaaagcgtcaatcagtggtgaaacggagacgatcatttttccgttcccccgttacctttcactatctataataatcactttgaatcagaatgccagaatttagcactctacaactcagagtgctaaaaatgggcctgagccgcgatctaacacgcactttagtttggaaatgtgcctgattgatcaaaaattagtggacaaaagtggactggatttcatcaaataaaaagattgtttggatattttacgtcattgaaagtgatcttcatttccggtgaaacgaaaaggaaccggttaggcatgattcgcctttaactggctcctttgttaggtgtttattaagataaaagaatcatccgaaaatttttacaatttgtttgacggtcttattaacctgggtattaacggttgaagtgactttggcttgaagatcggaatctgtggtcgggtcttggacgtttttacctgctgcctttgcttttttatattgttcctgcagattcttttccatttgggctttatattgctttgaaagagttggacgagcaaacttatttgcaagcgattttgccggtgacttcttggttaatgtaaaagtatatgttttcccggagttacttggaatatatccgtgttggtactttgttagtttaactcgatacttcgttgcgcttaatttgagtaacttgaaatgagcattctttttgctgagtttactattatttatcattttataggaagcgttaaacgttcgcttattcttactgagggtattgtttacaggttggccaattttaaattgtggcgttttaaaatcaccaaaaactaaaatggttcgaacgccactactggtacgcatatttttccagtgaaaggcaacacccaactttgaatttgaaaaatagccacttgggccgctgatatctttgcttgaaaaagttgatgctgcatgcgtgtttgaaagcgtaccagtcgcagtaaacgccaatcctgtcgaaagggtggcaagaactaatgatttggtaataagcgatgttgttagtttcattaatttttatcttctttccaatttgtgttttaaaatttatttatcactctgatcaaaataactactataacattactatacaacacaaccgaataaatggtgaagatcatttaatcaatgatcttcaatatgaaaacatttttgtcatcaccatagaaatttcgactggtaaatggtattctataagttagttatagtgtaacggtagtggctttgtagatgttacaagttaaggaaaggaactttttgatgactcatttgagcaaacaacttaataagtttattttggcgatggtggcgattattttatttgtcccattatttgctaattcttctgtccacggtttgtttggtcaggactctgaggcggctagtgcctctcaaaaaaagacaccaaagagtagcaccaaggttaacaaagttgttaaagctcaggttgtctatgcaaaacatgtgccaattcttaaagtaacaattaagcctaccgaaaaaaatcaatttaagaaaaatgatcagttaaagtttcaatttgataaaaagaatgttgacttaaagaacatgaaagcaagtgttgaaaaacacctgccgtttaagtatgccgataaaaagcatactcagttggttttaacctttaaaaaggatgttaagtcaggtacatataaacaggcatatgccatttccactaagaaagttaaacagacgacaaaggttaaagggacgtttgacggtcaaaagattaagatcaaaaataatcagattaagtcggtaaaatctattaaaaccgagactaataaagataaaaacagtcaatcaagcaaagacaacgatacaatcaatcagtcagataatcgtaataaggcttcacaaaatagcagtacagaaaattcagataatgatactagtcagactccagtacgccaaaatccgcaacaggctccaactcagcgctatgctgcaggaaacaataatgcacaatcgcaagccacccaagctcaggcaacggtgttctccagatcatattacggtgcggttaatcatcaagagcagaccagtaagacaacattaggaactactaataatagagttggtactccgtattcaaccagtggatcagtatccgtcccagcaggcgtaaatcgccaaacgactgtcagaaaggttacgacgacaagtcaacctgtatatggtcgcaggggaactccaaataccggcaaggcaacagtatctcctcaacgagtcaacaataatggtggtcgtactattaaggcttcgggtcagtctaaacagaccaatacaacaaagctaaaccgacaaccaagataaataagactactaagcagactgttaatagtaagcaaaatggtagttcttcaaagactaataattcgactaaatcgactggcaagaagggaaacaatgcttcaaaacctggtaatacaaccaaaccagtcaagcctgtggacaataccaacaatactaattcaacggataaatctgatactgacagtaacaacgacacaactactaatgcaaatgataacaataatcaaaacaatatcaccacaacacaaccaacggagacgactacggataacgcagcggccactggtacggctaacagtaatgacgctggcagttcaacagtgaacgcggctactgggacaaacgttggatcaggatctgatgatagcactgggacagcttcttccagcgagaccgtgacatctactacgaacactgatcaggcaaataatcaagagtcagatggtggaacagttacttcaagtaatgcctcaacgggtacagtagcaacttcagcaaacagtactagtacttcagtagcagcataaaagggcccacgaaatttaactattcaaatagaaataattttaaaaagacaaaacacatatcataattaatatcagtttaattaaggcttattttagtgtgagctaatcggagaagggtgttgacggtctgtaagaagtagtgtctcttagcttgaatttaaggcgaatgttaagaataactagaaattggtcattggtactttttactattcaaagatatacagactcactttaaataaatcatttgaagctgaggtttatttggtttaccatcaagctaaaatttagttagtggttttgaacttagtattaatggctactggttataaagtaagttattgccagtgttagatgcaaaatggttcaaagcaaagtgactatgtttggtaattaaagttgatgagagcttaattgtaattcgaaaggcaaatgtctagttgggcttagctggtcagtaaggggtctgcaataagataactggctgacaaagagttaaagtttgggtaacttggtatattttgacaaagggctttttgatgaggattgcgccagatatatgtgggaatttggaacaaatcgcacgtataaggtttggcttatacaccgagttggaagcatgcaaacaaatttatccagctattgatatgaaaatattttacaaaaggcacagctactctttataaccggaaaccgaaaactagtttggtttccgattcgttttaagttgtgaacagaatttcaccttagtcgtttgttccgggcggagttaactttcggcaatactgtttattttcagcacgataattaacttgaggttgacattatctagaaataatggttaatataaatgcaatttattgaataattcaataaaaaaagcccgattgccgggcttcaattgataatggggataactagaaaactatccttaaatcattgctaaggttttcggtttccgaagagggttagatatcatgattaagaagacaataatcagctttttagtagtcacgttgctattggtcattccggctcatgcggatatgcataaagtaaaacatgttgaaaatggttcttggtcagctagttttgtcgtgaagtcatctaagaatacaattaagtcggttaaagatattcactatcacgcgacactcggcaaaattatctcttataaggtttcccaccctaataaggctacagttgttttaaagctaaagcgccaaattggccttgttacctatcgtgttgggctaaaggcacatgttaataataataaattatctgtttcaccggtctgattttgtgataatcgtagctgtcgggtgaaagacggtatcttttaaaatgataaacgaactatacccgctcgttaacatgactgcaacgctcacacaaatgattgttttgtggaggagattgctttttttatttaaagctaagatgatgaagggcaggataattccaagaaacggaatcattgtactcgtaaacgacacaataataattgcagcaagaaggattaacgaacggtcgaactgacccaatttctttctagaatggtcaatctgcgactgatcttctatttgatctttcttttgaattggactctccctggttgaaccaccacattcaagaagttcggaaacgggaacatggtatagctttccaagtgaggctagggtgtcaatatcaggataaccatgatcgttttcccagcggctgactgtctgtctcgttaaatataattgttttgacacttggctttgggataagccggcatttaaacgcgcttctcgtaattgttgtcctaatttcataacctaacctccttggaaagtaattattggtggacatgcgtagtttgttatatctagcattactgtacatcatgtacttttcagtttgataccagataagttgcaatgacgttacagatccaaaaaacatgttcaatataaaagccgcgaaacaagggacaacctcgtttcgcgacattaagtcatacaggtatcttaagatttacttcatctaaattggtacgtagatgtttaagcttgtagtagcatccccaaagaatagtgaataatcattgtgataataccgacaataacgtttcgaataatagctgttttgactaacccattccccaaccgagcactgagataaccagtcaatgcaacggacaggcagacggctaagattgttgccggccactggtaggcaactggcgttagtgtcatggcagctagtgggaaaataccaccagctgaggcagaaaataatgatgaaaatgcggcatcccacggactcatatagtgacctaattgaaggtcatatttaacattgacaatggtttccaacgcttttttactcattaaatccttggcaatcttttgagcagtccctttggtgacaccctgatcaacgtaataatcggcaacaacgtttagttgcttttgataatctgtttttaaaagtttttcttctctggcaacaacagatttttcggtatctttttgtgtgctaacagaagcatattctccggatgccattgaaaacgcgcaggctagcagatcagatagtccggcaataaagatggtaaattgatttgttgtggcaacggcgacactgaacagtaccccgacaacggttagaataccatcatttgaacccaataccccggcacgaagtgtatttaatctttcgtccatagtctgtgaactcttcttctttttggaacgaatatttagcattcaggattcccccaatctcttttaagtaattaactaccaattaacgttccaattgtgtaagtaacaatcatagttaaaacgcctgagacaacgtttctgaaaacaccatgagctggactggcatttccaagccgagcagcggtataaccggtaattgccaaagcaatgacgacagctaaaaaggttgcaaaaattctgattgaacttggaaacattgtgatagcaactagtggtagaattgagccagttggaaatgaaatcatagaggcaattgccgctgaaagtggattggtgtattgaccaacgttaaacccatatttttgacgaacggtcgtcttaattggatcttgggtcatcatttctttagttgcctgttcggccaaatccggtgaaatcccgtcggtcactaatttattcttgacggtgttatattcatgatcataggaattagctaaagcttttttttgaatgctaatggcgtttcgttgtgaatctttttgggtattgactgaaacgaattcacccatggccatggaaactgtaccagcaagcattccggaaattccagaaataaagattgcgaaattattcgatgttgcacctgcaacaccgataacaattccggcaacggataaaatgccatcgttcgctcccataactgaggctcgcataacattaatttgttgggaaagcgatttcttctttaccatttcagtaccaacctttctagtttgtaatgattattatctaacaaagattattgtataccaacacttgccgaatgtaaatgacaaatgcctatattttcaccatttcaatagtgacacaatcagctctataaataaatacgtaatttagaatcaatattaattttttactttttaataaaagtgacttaaaaattcaattattactttggaggttattatgttgcacaatgagattttagacctattaagtcatcaccgaagtattcgccactttcgcaaccagcagcttaccagagaacaggtagataccttgattcaagcagctcaacatgcttcaacaagcactttttcccaacaatattcaataattagtcttactcaacctgatacaaaaaaggagttggctgaaattacgggtcaccattggttgcagaacagtggtcattattttgttgttgtggctgatcagtaccgtaatctccaaattgctcaggccaacgatgccgacccatatattttacggacagctgataagttttttgccggtgtttttgatgccgcaattgcaaccgaaaatattatggttgcagctgagagcatgggattaggctgcacaattatggggagtattttaaacgataccagccgattgattaaaatgctgaagctacctgaattaacttttccggttcttggaattgcattgggatatccagtgagtcaaccagagttaaagccacgattaccgatgtctgaaattcattttgaagatacctatcaattatcgtcaaatttcaaagcagatctttccagatatgatcaattggtttctaattattatcaagagcgcggtcaaaacaatcgaatagaaacatttagtcatcatattatttcagaactgggaaggaatcgggaacaacgagcagatttaattaaaaatattagagaacaaggttttattattaaatgaagctgatacttttgcacatcaaatggttgacattttcttttagaaaccttacattaggtagtaattgattgacagttttgaagagcttcaatgttgacgagaagagtagactaatgatttataaatagcgaccactgatggtgcgagagtggatgaatttagttgaaagtgcgctccgagttgaaagagacgattaggatcgtcagtaattttcatataattctaatgaggtactcatttagctttgagtatgaaaaagggtggaaccacgataaaacgtccctgttaatttggctgcggccacattagcagggacgttttattaattagcaggtaacatctgaatgtcaattaacaataaattgatatttttagaaatcattagtagggagatgatgtttaatgagtagtagctggaacattatccaacaaagtttgccgatgtttgaaaagggatttgtcttaacgctttggctttcctttgtcgggataattggttccattattgttgggctaatttgtagtcttgttcagtattttaaagtaccggtgttacatcaaattgcctcgatttacattgaaatttcacggaacacaccacttttgattcagctattctttctttattatgcgtttccagtaattggcattaagtttggtgctcaattatgtggcattattggtctgatctttttaggtgggagttacatggcagaaggatttacaggtggctttaatggtgttactaaaagccaagtcgaatctggaaaggcaattggtctcagtcggtggcagcttgcgaagtacgtcgtttttccacaaggattttcattgagtgttccggcaatggcagcaaatgtgatttttttgattaaggaaacttcaatttttactgtgattgcgattccggaattgaccaatacagcattggacctcattggcatgtattatcgttccaatgaatatttgtttgtgctggttgttggttatgccattattttgataccattatcaattattttaacgttactggaaaagagggttcgttatggctcattcgggaattagtgtgctattggaaggcacaaactttacgcggctgcttggcggactctgggtaaccgttaaaatcgcggcaattgccttaattgtcggcattgtcctcggtattattttaggagtcctgcgaacgtttaagaatcggctgttgcggctgattttacggctatatctggaattctttcgaatcgtgccaaccgtcgttttactttttttgttctattatatattgccaaggcagatgaattttaatttacctgcagaccagttggcaacgctggtgtttgcgttatgggttgctgctgaaatgagtgatattgttcgtggggcgttaatttctgttcccaagcatcaacgggagtctggaatggcaattggccttaatcgttatcaactttatcgatatgtattgatcccacaagcaatcagtttggaaattccagcaacaatcaatttagcaacccgggtcattaaaacgacttcattgctaatgctgatttcagttatggacgtgattaatattggtcagcaaattattgaggctaataatcatagccacccaaccggtgtgttttgggtttatggattgatctttttattctattttctaattgattatccactgtcatggtgggcaaaacggttggagaaaaagagattggagcgagcaaatggctgacaaagttttagaagttgaacatttggaaaagtattatcaaaagaagcatgttttatttgatattaatctttcaattcaacagggcgaggtcgtcactttacttggtccgtcgggatcagggaaaagcacgctgatccgttgcttgaatgggttggaagaataccaaaaagggacgattatatttgaaggcaaaaaaatcgttccaactgaaaaaaattggcaacaaattcgtcagaaaattgggatggtttttcaaagctatgatttgtttccgaacttaacggtaattgataatatcctattgggaccgataaaggttcagaagcaagacaaaagcgctgcgcgtgtggaagcaaagaaacttttgaaaagtgttgatcttgaggattacgcagatgtttatccgcgtgaactttctggtggtcaaaaacaacgagttgcgatcgtacgagccttggcacttcatcctgactttatgttatttgatgaggtcacggcctcgttagaccctgagatggttcgtgggattttaaacattattaaaggtctggctaatatggataacatgacaatgattgttgtgactcatgaaatgaattttgctcaggagattgcagatcgcgttgtctttcttgaaaatggccatattttagagcaaaccccatcgaaacaattttttagcaaaccgaaaactgatcgcgcacaggcatttttagacagtatggatttttaaatagggaaaacattagacttataaatgatggcattactgagcaaagaaacttgaggaggaatcatcatgaagaaacactggttatcaaaattaattacggttgtgagcgtcttagcgacattattgttggtattagcgggctgtgggaacagcaaaaaatcggattcggggagtaataatcctagttctgttcagcaacttaagaaaaaaggaaccatccgaattgcagtttttggggacttaccaccttatggttgggtaaataaagatggtaaacgagtgggttacgatgtcacactcgcgcatcaagttgctaaggatttgggagttaaggttaagtttgttcaagttaatgccaacaatcgggttgatgcactgaactctaataaagtcgatttagtattggctaatttcaccgttacaccagaacgaaaacaagttatcgattttgccaaaccatatatgaaagtttccgttggtgtcgtttcacctaagagtaagccagtgactaaggtaagccagcttaaaggcaaaaatgtgattgttactaaggggacaactgctgagaattactttactaccagccagaagaatgttaatttgttaaaatttgattctaagacgcagcaattcaatgctttgaagaatggtcgaggagctgctttggcagatgataactcatacttatacgcatggtcaaaggataatcctaagtatacagttggtattaagagtattggtcctaagtcatatattgcaccagctgtaaagaaggggaataagtccttattgaactggacaaataaggaaattaccaaattaactaaaaagggtttctttgtgactgattacaataaacaattgaaaccatattttggtaaggaagttaagccatcggatattgtattaccaacgaagtgattggatcgacaattaaagcttgaaggattggaacgggcgttatgttgttccaattctttttttcttgataaaatttctaaaagatcacgataaacataagtccgtttgtaacatttggtttaaaattaaaaattgattagattaaaattagtgttgacgaatcatttctaatatgttttaattaactcaacatttcaggaaaggaaattagcccatgacaaatcaaattcaacaactcaatgcctattattacggctatgcatggtttaagtagcgcccgttcagatgcgggcgcacaacgcgttcgcgtctaacctgggcaaagtcgtaactttgttgttgccagctagacgctagagtctagctggatgataagtcttaatttcttttacgcgagtagagaataagccagctggagtctaaatccggctggcttttattgtatctacatacaggagtgtgattaggatgaccaattcattaactaaatcaaataaacgacgactttcaatcagcttgtatctcaactatcttgttcatggaatcggactcattattttgacccaaaatatgcaggctttaggaaaattttggaatgtacccattgcaacggtttcttacgttatttcaggcgttggaattggtagattattagcctatttcttattcggctatttatctgataaatttggcaggcgacgactggtttacattggaatctttagctatatggcgttttttatcgggattccatttacgcaaagcatttcgattgcctacctatttgcgattttagcgggagtggcaaactcagcacttgattcaggaacctatccaacttttgtcgagatgggcggtaactccagcgcgtcaaacgtgtttattaaagcctttgcgtctttgggagaatttattttgccgttgttaattgcaacgttggaagcccgagcattgtggtatggctggtcatttatgctggcagtcctattattaatcgttaacctattcttacttcaaggaattaaatttccagctaagaatcaagacctgaccagctcggctgatgatcggggacaggcaacaagaggcaaacgactattagcaacgatttcacttgcggtctacggttacacgacgatggcgttgatgattttgtttacccaatggattacgttatttgcaaaacaagaacttgggtatagttcgttgatggcccatgcgttgttatcgttgtacagcatcggttcgatcagcggtgttttagtgatctttgtgctattaaaagttcgaattgcagaaacccgaatcttagtgattatgaatgttctatccctgattgcagttttgacaattagcaattcatcagtattgtgggtatcatcgattgcagcatttgttttcggattttccgctgcgggtggtgttttacaagtggcactgaatttactgcttaagatgttcccacggcataagggtgttatcactggaacatattttacgtttggcagcattgccacctttactgttccgattgttacgggatggttatctaaaattgaccttcacgcggtcatgaactttgatgtgttaattggattggctggaaccgggttggttatcataacggccgcagcacttggatctgggaaagtgatgaacgcaatcacatccgccctgcatattggtatttcaacgactgacgggaaatgaaatatcatataaacggaaaccaatcggaaaccgattaggagggtcagcaagcatgcaaagtcaaaccgggcaacaggaagtaaaagtgaaaggaattgtttttaaatcgggcagcacaaagattgccgttccaatcactggtgacacaaccgaaaagattattcaagaggctcatgcggcggtagccgttaagccggatgtgatcgaatggcgaattgatttttatcaggatgtttttaatccgagtgattatttagcaacggttaatgcgcttcgaaaaatattaggaaaaattgttttattaacaacgtttaggacaagtagtgagggcggccataggagcaggaaggacgaccaaaagtatgtttctttaattagtcggattttgagaggccggctaactgacgtagttgatattgaacttaacagagatcaatatcaagtcgctcatctggttcagcttgcgcatgatcagagaattgcagtaattatgagtaatcatgagttcgagcaaacgccgcctgaggttgaaataagatcacgactggaaaaaatgaagcgtgctggagctgacattgcaaaaatcgcggtgatgcctcagacgcctgctgatgttttaaccttactcaatgcgacttacaaggctcatcagcagttgaaactgccgttgatcacaatggcgatgggtgacttgggaaaagtgaccagaatttcaggatcaatttttgggtcagtattgtcgtttgccgcggtcgggaacgcttcagcccctggtcagttatcagttagcgaattgcgtggggatttagaatcgcttaagttctagtcagttaaaatatttaatgccggatcataagtttgcaaattcggacagaaagaagaatgaattaatgaaagacagaattgatgggcatacgatattaattgggttaatggcatatccaattcgccattcaatgtcaccaacgatgcataatagtgcatttgccaaattagggttaaacaatgcctatttagcttttgaaattgataacaaaaaattaccgggtgccatcaatgcaattaggacgcttggaatgcgaggatcaaatatttcgatgcctaacaagcaaaaggtgatcccactgttggacaaattggatcccgttgctgagttgattggcgcagttaatacggttgttaatgatgacggtgtgttgaccggatacacgactgatgggacaggttttatgaaatccttggccgatgagggagtggatattggcggtcagaagatgacccttgccggtgctggtggtgcgggaacggctattggcattcaagcggcattggatggtgttaaagatatctctgtttttaatattcatgaccaaacatgggaaaatgcagagcgaatggtgaagataattaatgataaaactaactgtcaagcaaaattgtttgatttggcagaaaagaagacatttaaggctgaaattgccggttcaatgatttattgtgatgcaacaggagttggtatgaagccgctggccgataagacgttggttagcgatccaagttggtttcggccggagatgattgtgtttgatacggtatatgcgccaagaacaacgaaattaatgagagttgctcaacaagctggcgttaaacacgttctaaatggtttagggatgatgttggagcagggggcagaggcatttaagctctggaccggtaaggatatgccgattgattatattcgggaattgttgtttaaagaataaacatgcggtaaaaagtgattaacttccggagtatcggcaggttaatctatttatatagaaaaagaggctgggacaatagtcatttatcccaacctcttttcgtgtaaacacgattgttaccgagcgaaaacgcgggacaaaaggcaacttccggccatgtaaccgaattatccaaatattcaagttcagaatatttggataattcaattacactctggaagttaaacgccttttgtcccgctctgttttaatctggaagttcgtgcttaattgtttaccaggtgattttagttagtatctaaaaacctctaaaatcatttctgccaaaatattggaaaccggaaagcaatggtttctggtttaatgttggcagggagacaaatgtgtaaccgcgttttttcaacgttcgaataattgttggaacagcggcaatagaggttgggtggatatcatgcatcaaaataatagaaccattccgagttgtggataatacatggctttcggttttcttggcattcaaatatgaccaatcacgtgaatcaacagaccactggataatcggacgatcgaataagttggcaactctcgaattaattgcgccatatggtggccgaatataagcggggatagtgcctgttgccttataaactgctgcatccgttaacgcaatttggcgttgtgctttcgcagttgttaaggttgttagttgtgggtgattccatgaatgattaccgatttggtttccatatttaagaacatcacgactaatgcttggatatttgatgacactgctgccaacttcaaagaatgttgcatgaacgttgtatcgcttaagaatcttaagtaactttggcgttaatgttgggtcaggtccgtcgtcgaaagtaagcgaaacaacttttcggttagttgttttcggtttaacatagtcatattttttaggcatataacggtttaagataatgcccgttaacttgctcagtggaatggctacatctttaacgttatatgcgttttttgtcagatgaatggttaaatacgcttgacttaaggtgaagtttttggctgttagtcgtttaggtaagggtaaattgattaactgttgaacttgcttacccgtaagtttgttagattcggcgagttgactgcgggttaattgacggattgtcccaaggcggtgcaaattatgatttgtgatatccccataggttagccgtttagccgctttcttggttgctttagtgacagtaggtgttgatgaatcagctgctaagacttgataattagtgcgagtggaaaaagctaagaatgataaaatcgctattcctgcgatgatgaaagatttctttcgattcattttgatgcccccaatacaaaagtttatggttaagatgtcatttacattttcacattctcacataaacgtgtcaatgaaatgacaattgatcaaattattctgctgaacttaagtaaatcatgagagctcgttaaatcacggcttctaagatcctaatttttaatttgagaggctgtttgaataaattataataaagttggtgttgacaaatggctatattcgatttaatgtacttaacattagatattgatgagattgtactgagagaaatcgaagagtcaacattaagaggtttcaagagagtgttgctatctgcgaagacacaacgtcttaatgtcaaaagtcgattttgagtacagtaattcgtaaagagttactagggtgcgcccattatagcgccaacgttataccgagtcgaccggtcgtacgtgagagatggaattttagatttcataactaaggtggtaccgcgcaaaagcgtccttttggaagtttatcttctgattgggcgctttttgtatttcctggccagaaaagcccaaatcaattcaaaaataaaagggaggaattgcgatgtttaaggagaaccgattggcagttattattacgtttgttactggggttatggctgtcttattattaagtggttgtacatcaactgctgttaatggtggcgccggtattagtaagaccttaaagataacaattccgggtgagccaatgacggtcgatccaactaagtccattgaaactaatggcggtgcggttattgatcaaattagtgagggaatttatcggcgaaatgcaaataataaaattgctgccggtgttgtagagcgactggttagaccaactgataacgggactaaatatacatttacgattcgtcaaaatgcaaagtggcagactggtcagccaattacttcccgggacttcgtgaatgccattgaacgacaagcaaatccgaaaaccaagtcacaacaaaccacttcaatttcatacctaaagaattttcaagctgtaaatagtggtaaagtgtcaccaaataaactgggaatccacgcgattaataagcgaacattttatattaagctaaccaaaccagtaccgtttatgaactatgagttcactaatttttatccacttaatacagaagctgtaaaaaaatatggtggtcaatatggttcaaccggtgataaaacggttgccaatggcgcctatgttttgaaaggatggaacggcaccaatgattcttggcattacgaaaaaaatcaacattactgggatgccaaaaatgttaaaatccctcaaattgatgttgctgttattaaagacgataacactgctcaaaacatgtttacttcaggtcagattgatctaacgactttaactggtcaatatgtgaaggctaatcagaacaataaaaatttggttgtaactgaaaccggacgaaataattatatttactttaataataaaaagaaagcaacagcaaatgaaaacttacgacatgcgattagtttggttattgatcgtcagtcgctggctaaaaacgttttgcaggatgggtcaataggagcaaccaacattgttcctaagaactatgccaaagatcctagcaacggaaaagactttacttctgaagttggtaaccaggcgccgacgaattctacaaaagcaaaaagctattggaaaaaagcccaaaaggaaattggatcaaaaaaagtgtcacttgattttcttgttgacgacacagatacagaaaagaaacttgctgaatatgtccaaggggctgtctcaaaaaatttaaagggcttatcaattaatattgtttcggtaccgcacgcgactcacgttactcgtgattttcaaactgaatttgatatttgcacagtcggatggggaccggattatccagatgctcaaaacttcttggatggcctgcgccatcgtaatgcgatcaatttttcacactttagtgatcggaaatatgatcgcttgatgaataaagtcgataacactaccaagtatgatgccaagcaacggtggaattttgaaaaacaagcagataaacggcttatgaaaattgctgcagttgccccaacgtatcaagcctcacaggctcatttaattaatagtaaactaggcggtttgaaatgggatgcaatgtcaggacaatctggtaagctgcagtacgcttactggaaataatcttcgggaaattcaatcgagttaatactcattggcggcaaagtgactgaacaaattttaaaacgatttgcaaatatctttaaggaggtggttgcggtggcatatcagttagcgggtacagatgatgctccgtcacagttagtcagtaggcaaagggtttatattgaaaggaagatatattatgacaaaaatcaattatacgaatgtcgcaatttacaaccatgaggaacaaagctttatcaataaccaacacatagtggtagatactgattctggtaaaattgttgaggttggtgccggaaactcaactgacgaggtttgcgatcaggttattgatatgaaaaatgaatatgtcatgccggggataatgaatgcccatactcatattacaagtattccaacatactggtggaatgatggcaaggaacagcgccattcagattcacgtgaatttaatacaatgtttgcgattcaaaatatggctgatgcaatcaatcacggtattacgtatattcgtaatgtgggggcagcgtttgatattgatattgaaattaaaaagatgcagcaacatggctggatcaagggtcctaaagtaatgacctctggtaaggcattttcgattactggtggtcatggatctgctggcggttacgaagttgatggtgtcgatgaggttcgtaaaggcgttcgccaagcaatgaaaaatggtgtcgataatattaaaatgatggtaacaggcggcgttcttaaaaacggtgagacaccggatgatattcagttcacccctgaggaagttagagtagctgtcacggaagctcatcataaaggaaagacaattgctgcccatgcacaaggaaacgctggcgttaaagaagccgttgaggcaggctttgacacaattgaacatgcttttgatattgatgatcaaacaattactatgatgaaagcgcaccatactgtgatcgttcccacgatgaatgcgatgtacgcgatttataagtatggaaaaaatacggttccggattgggcgcgtgaaaaagttattattaatattgaaaaacattttgcaagtattacaaaagccgttcagtcaggcattccaattgcaatgggaacagacgccgggacgccttataatggtttccgaaatgagagtgcatatgagatgcaattatacgttgaaaaagctggaatgactccagctcaggcaattgattcagcaacgattaattgtgctcgtgccatgcatattgacgatgaatatggccaaattgtggcaggaaactatgctgattttatcgcgatgactgaaaatccaatcgatgatatttcagtgattcaacacgatagggatgttttccaaaacgggattcgggttcatgcccaaagagttaatcaagaatcgagcaacccacaaaaggtcagttccgttgggtaatctgcttgttcttatttatagtagaggatgacattaatctatactcggatcacgttatacgccattcaattagctgattggtttattaaaatgaaatgagtaacagattagggttgacggataattcctaatgtgttttaataataacaacattatgagagggattgataaatatgacgaagcttactcaacttacaagtacttattattttggctatgcctactttaggtagtgtccgcagcgatgcggacgcacattacgcgttcgcgtccaagtggagcaaagtcaaagctttgttgttgcccgctagacgcaatggtctggctgggtcaattaccaattctttacgagtttagtaaaccagctggattaaacatctagctggctttttttataccaaattagttaagccgtttaaatgataagaatccttaactaaatggtcaatactaggaggaatcgatttatgaataataatcagcggagttcagtttgtgaccataatgaagaaattcaatcagctcgtgagcaaattaaccaactcgatcagtcaattgttgaactactggttaaacgttttgaaacgtctgcgcgaattagtcgaattaagcgaatgagaaatttaccggtgctggatagtgaccgggaagcacaggttcttaagcgagttgcctcgtcagattctgatccggacacgagggcgtatattcaagatgtttatcgggcagtgatggaaaattctcggaagtatcaacatcaactaatgaatcatcatgaaagtaaaaaataatagactgagcagattaaaggagaataacgatgaattacttaacagcaggtgaatcccatgggccacaactaacaggaattattgaaggcattccttctggcctccatttggatattgatcacattaatgaacagttaaaaaagcgtcaaggtggttacgggcgaggcaatcgacaaaagattgaacatgatcaggtaacggtggttggtggtgttcgccacggaatcacgctaggctcaccgattgcccttgtggtaaataatcgggatcatgcccactggaatgagattatgaacccggttagcccggagactcctgaaaatacgttacgcaaggttgaaagacccagaccgggtcatgcggatttagttggtggtatgaaataccgtcacgaggatttacgaaacgttttagagagatcatcggcaagagaaactgcaattcgagtagcggtcggtgcagtttgcaagcaattgttagcgcaattgggtatcgaaattgttggttatgtttctcaaattggtcaaattgctactgaagatcaacctgaactggatgttgacaggattgaatctgaaattgaacaaaacgatttgcgggttgttgatcaatcgaaggttacggagatccataacctaattgatcaagttaaacgggatggcgatacgctcggtggcatcattcgggtggttgcaaccaatgtgccagctgggctgggtagttacattagttgggatacgaagctggatggtaaattagcagctgctgtcatgggggttaatgctatgaaaggtgttgaaattggtgatgggtttaaagccgctactagtctgggaagccaagtcatggatgaaattgactgggataagcaagccggctttacgcgaaacactgaccatctaggtggttttgaaggcggaatgactaatggcatgccaattatcattaaagccgcaatgaaaccaattccaacgttatataagccacttcaaagtgttgatattcaaactaaagaggttaaaaaagccagcgttgaacgctcagacacaactgccattgttccggcttcgattgtgattgaaagtgttgtagcaattgagttggcaaaagcaatcactgataaatttgatggtgataatcttcagcgacttcaggagcaactggcggattatcgagatgaattaaaaaatttttaggaggtcggccaatgaaaaaattacaaattaaaccggaaactggtttgcatgggacattgtcaattccaggcgataagagtatttctcatcgaggcatcatgtttggggcaatcagtcaaggaacaacggttctccaccactttttaacggcggaagattgtttatcaacgttacaagcttttcgaagccttggcgttcccattgagcgaaacggtgaaacggtgactattcaaggcgtgggacttaatggtttagaaaagccgacagaagccttggatatgggaaactccggaacaacaacccgattaataatgggcttattggccggtcaacaatttacaacccagttgaagggagatgtatcgttatctaaacgaccgatgaggcgtgtaagtgctcctttagcatcgatgggcgccaaagttcaggtaactgatggtcatttacctgcgacaattattggtcaacacttgcatgcaaccgactaccatttaaaggttgcgagtgctcaagtaaagagttctctgattttggcagccattcaggcagacaagtcttcgatcttggttgaaaagttaccaactagaaaccacaccgaaattatgttaaatgcgtttggggctgatattgagaccgcaatagatgatgtgacaattacgattcatcccagaccggaattacatggaattgaaatgacagttcccggagatatgtcatcggcagcattttttctagcggcagcaagtctagttccggattctcaagtaaagttgttaaatgttgggatgaacgaaacccgaacaggcttattgtcaattttgaaacggatgggtggcaatgttaaattgtctaatcagcatattgattgtgaaccaacggccgatttaaccgttacttcggctgagttaaaagctattgaagttggcgccgatgaaattccagatgtcattgatgaattaccattggttgcacttctagcagctaaagcgaatggaatcagcaagattactggtgccggtgagttacgcgttaaggagactgatcggattgccgcaattgtgacggaatttagcaagctgggcattgcaattactgagttgcctgatggtttcattattgatggcactaagccttggcaagttaaggatcctcatctaagtagtcatggagatcatcgcattggcatggtgatggcgattgctgcgttgttgatttcacagcctttgacactcgatggtgctgacagtattaatatttcctatccagagttctttgatgatttaaataggatggtgccacaagcaaaagaggtggattagtatgataaccgttttaatcagtggtttgggattaattggaagttcgattgccagagtgattcatcggcaaaatcctgctaatgaaatgattggtgttgatcccgatgatgattcatcccagtttatgttgcaacagcacattattaatcgaattgatacatttaatcatgcggcccagaaagctgatgtgattattctggctggaccggtttccgttattattagtcaaattaaagagttggctaatatcaaattaaagcctaatgtgttgatcactgatactggtagtactaaggccagtgtgatgaaagcggcacagtcattgattaaaaagggagttggctttctaggtggccatcccatggcggggtcacatttaacgggtagccggtcgggaagcctgaaattattaacccattcaacttattttttagtgaatggttcgcaaacccagcgacaacttgatcagtttaaagccttaatgaagccggcgaaaattaattggacattaatcggcgctaaagatcacgatcaattagttagcgaactaagtcacgttccccatgttgtagcaacgacattagtgaacgcagctgtggcacaattgcaggataatccaactggcctttctgcggcggctggtgggtttaaagatactactcggattgccgctgccgatccaactatgtggacggcaatcatgttaaacaacgctgatgcaatcgatgaggggattgaggcttttaaaactcagttaacgaaactgcagacagcaattcataatcaagacgaacagacaattctaaggacgtttcagcaggcacaggcgattcgagagtcgcttgataagtaaggagaatgcttatgaaagctatacttgtaggatttatgggaagcggaaaaacgacggttggcaatttgttagcgcagcgtttgggaatgccatatcatgatctggatgatattattattcaacgagcgggtaagtcgattcagcaaatctttgatgataacggtgaagctgcctttcgacagttagagcatgaagctttagtagattcaatggcagacaatggtattttagggacgggtggtggcaccccaattcagttaacgaactttgaaattttacgtcaaagtcagatcccggtggtcctgttggatgtgctgccacaaaccattatggatcgactaaaagatgatacacaacgaccgctagctcgcgaacttggattaactggtttggttgatttaaagggacaacgggatgataagtatgaggctgtgagcgattttcggattgccactgatcggttaacaccacttgaagtcgttgatgaaattaccaaaaaactatttgtgaaccagcagaatgtgatctaaggagatgagaaaatgattgatggacataccaaattatttggcttcttggcacaccctgctgctcacagcttatcgccattgattcataacactagttttaaggttaccggcattaacgggacctatttggcgtttgatgtcacttcagacggccttgagaataccatcacggcgttacggtccatgcatattggtggggtaaacttatcgatgccgttaaaaacagaggttatcccattattagatgaaatgacgccacgtgctaagcgattgcaagctgttaatacgattgtcaatcaaaacggtaagctgattggtgacacaacggatgggcaagggtttgtggatgcattagcccagcaggggatcagtgttgcggggaaacaactaatagtacttggtgctggtggtgccggcagatcgattatagcggcactaattgacgcgggagcaagacaaattaacgtgtttaagcggcaaaatgagacttttgaaaaacgcaaacagcagcttgaatcttggtcagatgtagtttccgttatcccttatgagaatttggaaaagatggcagcatcaattgaggctagtcaaattattgttaatacgacgaatgtggggatgagtcatgatcatgcattaccaatttcaaaaacgatgattgatttattgaattctcagcagatcgtggttgatgtcatctattttccattgacaacgccctttcttgaggcggcaaagaaacagggctgccagacttttaacggcgttggcatgttggttcatcaagcggccgggtcgttcttagagtggacgggtaagcaaatgccggttaaagaagttattgcggctgttagacaagaagtcatgcgtcgtcaggacgttgtgaaatctgttgtataatgagtagttccgaaccgtaagcatgaatttaatcatttaagattggaatacatggttggattatcatggattcgagtctgggattaagtaaatgtggtatagtaaatgagaactaaatatgatttgataacattaggggagccatgtggctgagacgtgaatttcacggacccttgaacctgatctggttaacgccagcgtaggaaaaatgtatcagctaaaagtgccctccctttgttatcaaaacaagtggagggcttttgagtatgaaaaaatcggttacatataagatgattttaacagcaattttagccgcgattggtgttgtcggcggtagtttatttgaatttccagtattgggtgcacgagtcgccccgatgcaacatttgattaatttgatttcgggagttctggttggcccctggtgggcagtcactcaagcatttattacatcgttaattcgcaatattctgggaaccggaacggttttggcgtttccaggtagtatgattggggcgttttgcgtgggctggctgtttcaaaaaacgcaaagtctcattgtggcagccatgggtgaattaattgggaccggtgtaattggcgcaattgtagcttatccattggcagcctggttaatgggcactaccggcgccgtttttctgttcatcccaagtttcttcctgagtgcgctggttggtgtcattgttggttatctcattttgaagagtatttggaaccgagtgattgtcccacagcaaaagaagctgggaatgaaaaagtagttgggatggtttaactgaaccaagtgccccagaggaactctgatagaccaatcaattatcttggtatcaattaacagtgtcgcagaggagttaactttcaatgtaatcgggttggcatagtgggataattcgaatacgcggcacgaagttgcctttcgtctcatgtttccggtcgagaataatcgtgattacgcaaaaagagactgggaaaaataattattgcccgtctccaattgacgtggttttcgtttcggcttctgatcttattgtggtaaaaatgtctcacggtatttaaagctaccgggaataatcgttcggactgaccaatttcgctttgtttttgcaaacatctcggcctgtaacagtgccgtataaccaagctcactttttggtaaccagatacttgttagcgaaggcgtgaggtaagaagtaaattccaaatcatcgaaactgattaaagcaatgtctttgccggcaatcagatggttttgactcattgctttcattgcaccgattgctagtgggtctgaagcaaccaaaatggcacggagtttgttgccgtattcagtaattaattccatcgtggcttgcatggcatctttggtggtccaatcgatttctttgaacgcagtttgacggtgatgggctttggtccagttttcgtaggccattgtccggacatcggtaattcctttgctcaaactaccatctaagcccatttcttttcgattaccaccaataaaagcaatgagttcgtcatcgttggctactatacttaactggtttaatgcagttgttgttagctcagcgagattactatcgactacatcaacaaggttatgatagtgggtgccggcatctactaaaataatgtgttgattatacttttttaatgatttgacagctgattcactgacagtgccggtgataataatggcatcgtaatttgctaaatcctgagggtgcaatccagcctgcattcgaataatctttgaaatattaatttcctcagtccgagctgcttcataaataccatgtctgacaaatcgccaatattcgtccctggtttcttcttccagggtaagagtcgtaattacggcaaaatttagggtgtcttttgactgctttgctcgatcagagtagtgatagccgagctgatcagcaatttgtttaactctatttcgagtttcgttggcgacaaattcacgtttatccggatttaatgctcttgagactgtacccggtgatacgttagctaattttgaaatatctttgatcgttgccaaggtggcgtttcctccaataaaattaaatgatcggttgttaaatggacatctgaattaaatatttgatacaaggttgtatgtatttaaaccatgctttgcattcttaataacccttagactagcatattttgaagggaagcgacaaattaattcacaatcttaggactgtttaagtgcaaagccattaaaagtcttctaaaattaaattgaatgtttagtgaaagttttagtgtttttaataaaattattgacattcttactgtaaacgtttacattcatggtagcaattattttatttattttttataaccgttaggagggttatatatggcagaaaagtcgcataagttggtttcaaggctgtcgtattcgttcggtgcctttggccacgatatgttttacgctacgttatcaacgtactttattatgtttgttacctcacatctgtttagtaaagatagtggtggtcaaagtgcgaagatgattgcttatattggtatcatgattatggtgcttcgatttgttgaattagcgattgatccctttattggaaatacgatcgataacaccaacacaaaatgggggcattttaaaccttggattattgcaggtggaactgttggatcaattacgttgaccattctattcaccgatatgggtggtttaaatgtttccagtccatggttatacttggttattttcatgctgctatatatcacaatggatattttctattcatttaaggacgttggtttctggtcaatgattcctgcaatttcgttttcatcaaaagaacgtgaaaaaaccgctgcctatgcccgggttggttctaacattggtgccaacattgttggggttatcgttatgccactggttgttttcttctccgttaatacaaataacggccaaggtgataaccgtggatggttaggatttgcagcagttattgctttaatctcttgggtatcggcaattattgttggtatgggaactaaagaagttgattctgatttacggaaaaatgttgaaaaaacgacctttaaagatgttttaaaagttttggctcggaatgatcagttaatgtggctttcgttaatgtatgcgctttatactgccggcatgcaattaactaatgcgttggagctttattacttcacgtatattcttggtaagccaggcgaatttagtattttagctggaattaatacagttattggtgttattactgtgctgcttttcccaccaatggcacaaaagttcagtcgtcgaaaagtcttcttcgctgcaattgcaattatgatcgttgcgctattcgtcttcctaattgctgggcaatcattgccacttgttcttttggcagcggctttgttctatattccacaaccacttgttttcttggttgttttgatgattttaagtgactcggttgaatatggacagttgaagtttggtcatcgtgatgaatcgctaacactttcggttcgaccgctacttgataaatttggtggtgcactttcaaatggtgtcgttattgtcacggctgcctgggctgggatgacgtctggaaaaactgccagtgatatttcaacgagtggtcagtttatctttaagggcatgatgttcggtgttccagccattcttatcttattggggacatttgttttctataagaaagtgacattggatgaaaaagaacacgcacggattgttaatgagttggaaaaaacatggcataagcgtcttgatacagaaggtaaagaatctatgcaggacattgagaaagaagttgctcaagcaacaacaactttccaatcaccaattaccggaacaatggagaatttggcagatgtttctgatgaaaactttgcttctggaaaaatggggaaagggtttgcgattaagccaacagacggcaaagtctttgcaccgtttgatggaaccattgaagcaaccttcccaactcgccatgcaattggaatcaagtctgatgaaggtatcttaacactcattcatattggaattggtaccgttaaaatggatgggaccgggtttgttcagtatgttgagcaaggacaatacgttaaacaaggtgaccaattaattgaattctggcagcctgccattaaaaaagctaacttagatgatactgtaatggtggttgttcctaattacaaagacatccaagatttcaattatttgaaagactctggtgaggtaacgcacggggatcaaatcttggatctatctaagccaacaaaacggccagtaggaaacgaaagcgattctaaaaaataaggcatttagaaactagaaaaggatggataaaatggcgattcatattaacgaacaggatcagttatttcatttgcaaacggatcatacgagttatgtttttcaagtgatggaaaatggcgaactgggtcaattatattatggcaagcgaatgcatgtccgttcggcatattcgaatttagcaacccgtgaacaacatgatgccacacctgcttggaaacttgataagcctgattttcaaccagagttactaaagcaggaatatgccagttttggtaaaggtgatttccgttacccggcttttcaagttgaacaggaaaatgggagtcgggtcactgaatttgtttatgagggttatcaactaaccgatggtaagaagcgattggatgatttaccatcaacttttgatgacaataatgatgattctcagacgctaacagttcaattaagagaccggctgcttgatttaaaattagagctaaattacaccatttttccacatcaagatgtcatcgttagaagtgcgacctttattaattcaggatcagaagaaacggttcttaatcgagcattaagtgcggaattggatcttccagatccagattacgatttaatccaattctcagggacttgggcaagggaacgtcatttgattcgcacaccactacgctcaggtgttcagagtatcagcagcttgcgtgccgcttccagtgcgcaacaaaatcccttctttatgattgcccggccacaaacgaccgatgagcatggtggggtgtttggatttaatctggtctattccgggaactttttagatcaggttgaagttgatcaatttaataccagccgcattttggttggaattaacccaagtgaatttgcctggaaattggcacctggtgataccttccagacaccagaagcaattattagttatacagacgaaggtatgaatcaattgagccagcagatgagtgcctgctatatgaagcatctagtcagtccccgttttgcgacgcaagaacgaccaattctgattaataattgggaagccacttactttgattttgatgaagataaaatatttaaaattgcgaaaaaagctaagaccctgggaattgaaatgtttgttcttgacgatggttggtttggccatcgggatgatgacacaacctcattgggagattggttcattgacaaaaagaaattgccgagtggcttaggaaacctcgtcgaaaaaattcacaaacttggacttaaatttggtttgtggtttgaaccggaaatgatctcgatggatagtgagttatatcagaatcatccagactggttaattaaagcacctggtcgacaggtcacgcctggtagaaatcagtttgttcttgacatgacaagggccgacgtcattgattatcttgttgacgtgatgagtcaaattattaaagagagtcaacttgactacatcaaatgggatatgaaccgcaacatcaccgagatgtttgggaatcaattggcgccagatcagcaattggagtttgctcaccgttacattctaggtgtctatcagttatatgccagattgaccaaagcctatccagatgttttatttgaatcttgtgcgtccggtggtggtcggtttgaccttggcatgatgtattatgcgcctcaggcttggaccagtgacgatacggatgctgtggaaagaatgaagattcagtttggcacgtcctatggttatccccaatcaatgatgggggctcatgtgtcagcagttcctaatgaccaaactggtcggattacaccgttacaaacccgggcagatgtcgcttatttcggcgaccttggctatgaattagatgtcaccaaaatgtctgcagaagagcaggcgcaggttcaacaacaaacggcattttataaacagcatcggcgtcttttccaattcggaaaattttatcggattgaaagtccgtttgaaaatgatggtaatgttattagttgggaagtcgtgagcgaggataaatcgcacgcaattggttgtcgttatcagattttaaatcagcctaatccgtcatacttacgtttgtactttaaagggctggatcctgatcgaaagtatacgatcaatggtggttcggaagtattttatggagacgaattgatgaatgcgggattattcattaaccggttacttggccgaacaatgggagttgattcatcagccgacttcagttcgcgattgtttttgatcgatgctgttgaataatgaaatttaatgttagattaatcgtgagtaaaataagttatctatttccataattgggtatcttaagtcgtcatgattcttgactaaagaaacagagctgagacaaacataaatttgtcttagctctgtttttgtagtttatgactgttacttgttcgtaacgtgtggcagccagtagcccctcggctatataggtatcataaccggatgctctaaaaccaggatgtcgattacttttctgaaacgtgtggcagccagcagcccccggccatataagcaccatcatcagatactccaaaatcaggagtatctgatgatggtgcttatattctgggggctaaacgctggctgccacactctttgttaattacaccaatagttgtaatatagaatggtaccctaatttgaggaaagaagagaatactttgtcaaaacgcgatatcgtgatcgttacttttgccttgctattatccaacgcaatgagtgggatcgacaatacgatcattaatactgcattaccagcaattatttcagatttacatgggattgaatttatggggtggattgttgccgtctttcttttgggaacagcggttagcacaccattatggagtaaacttggggaacatattggtaataagcgaagttatcaactcgcagcaatgttctttgtcattggttcgctgttggaagggatgtcatcaaatattgttttcttgattatttcaagaaccatcgccggaatcggaaatggtggcgtggtttctctgccttacatcatttatgcaaggatgtatgcgaatccacgaaaacggatgcaggtgttgggatttgtatcagctagttatagtatggcaaccatcattgggccaattgtgggtgggtacatcgttgatacctttagttggcattgggtattttatttgaatgttccaattggtttggtttcagcaattttagttcagatttattatcgggtggaaaaagaaactcgcaaaaccagcgctgttgattatcttggagccacgttaatgacccttggcttgatcagtctactttccgcaattgaaatgattggaaataccaaattaatatttatagctgctgggtttgtggtttcagcgattctattagggctgatgtttcgtcacgaagaacgggttgaggatcccatcattccaagccgattatttagaaatcgaccattgatgatagattttgcgctatttacattaatttggggtgcttttatcgggtttctaatttatagtccgatgtgggcccagggattgctgggaacttctgctttaattggtggtgcaacccagattccaagctcaattactgattttattggttctggttcagtggcacccttacggaaatactttacacctcaaaaagttgtcgcattgggaattattacgttaacgatttcctttgtattgttggttgtgatgggggtgaaaactccttattgggtcttgttgcttgccgcagcattcgaagggtttggcaatggtgcctgtttcaacgagttacaagtaaaagtccaacaggatgcagaaatgaaagatgtaccaattgccacgtcctttagttttttgatccgcatgctgagtcaaaccttcacggcatcaatatttgggattatcatgaatcatgcactcaagaatggtgtaattcagtctggtggccgaattaccatgcgaatgatgaataagctgagcgatgcgtcaaatatcgggtcgttacctaagcgattaattccccaaatgcgaatcattctacataatgggttgcataatattatgattttagcgttaattttaatgttagttgccttgggaataaacatctgggctcagcagttggaaaagcaaaaaatgttaaggtcccagcatgcttccgaaattaaggggaccaattaacagattagtgattcttgaataaatcgatgtgaaaacagtcataaaaaagattccagtccatgaactcgctcagttttgagaggtcatggactggaatcttttttattgagataaagtggcaatgatcaggcaaaatagacgtgataatttctcttatcggctagtgattttagtttgcctaatcgtcttatttactttgttgaagtgattgatccttaaacgttgataatgagacgtttgcggttgccaatccggtttgactggttgcctctgctttaaagctgactttatcaccttcagaaatgaattgatagattggcttaaagttcttggcactggtgtcaagcttataaacttgattgttgttcttcatgataaacagtaatttgttatcgctggttcgaacaattcgataaattgtgccagaaattgttttaccagttggttgagctggagcaacgccagttttggattctaatcgttgctcgaagatagcgagcgtactctgcgcatcgtcaccgatggcatacgtaccactttggttatttccatcggctaacagatagacaaatttcataaatgaattgttgtctcgatccaacattgaaacaacccagcttggttcaccgttaatccggtaaagtagcggtaacgttcccttgtagttttgagggttgatatcttgttgcgcatatgaaattgcccgttcaggtgtcataacattgccatgttcacggtaatagtgaagggtgttggttcgcgcgtcaacgaaagtatatcctaagattgagctctgatgctcgttcacactggtcataccagtaaagtagtaaacacgacctttgtaggcgtagggggttaaatgatcaccgccttcagttccggcagttgttggcttcataacgccactgtgaccaccaaagctggttgcgttccagaaaccttttcggtaacggccaaacaggttaacttcttgagatacaaattcgggtgcaacggcaatgtccacaaacttaggaaccttatttggtgagtaaacgttgacttttcctgtaattgtatttaagacggcaactttgtaatcacgataattataattacggttgatgtaggagatcggcttggctaacgttctgacataataaggggttccgttgtcgtcaatttccaattgtgaggttgaaccaaccattgaataacctagactatgggcactgattcgtcgatcagcatctcgattaaagtaggcacttggtgtataacgcattggtttgctgacaaattttggatccgcgttcttatctgtcgcgttggttctgaagtatccaggaaccttttgataatggatgtaacgccagaaaccaccggaaaattcaacgggtgcaacataaaccatctttttgcgatacatttgaacccgcatatgatttagatcgtagacgtttgagtttttaaagctgttcagcgagttgttcatatccgttgaaacagtttgtggggcgttgacaacgggtgtttcagcactgttcttgataacgggcattggtgcatttttagtatcatcgttcatgtccgtcttgatggactcaacggccggccgtgggttcatcttggttactaaactagaaacgcttcctagaataacgaaaacgacaatggctaaaatgaaaaccaaggcgagttttcctaaccagccaaaggcacccgttaatcgttgaataccttggctgataatgccatcaccggcttcggtttgtgatgaccgtgccggggttgcgcttgttgagtaaacgaaccgttttaaaacggcaactaaaattaatccgccaataaaccacattaaccaaccatcaattagtgatggataagctaaatccggcagattgaagtaagtgttgatgtaactgatgataaatagaacgacaattgcccctgtcgcaagtagtcgtcctctgcgatcagcgataattaagaaccagatatacgggatgagtagacctgatagcttaaccagcgtgatcaacgcaaaataactaagcataagatgttctcccttcaaataaataccaacgattgatatatcaagaccattataccgtagccattagctaatacctaaataaacaggtgctaaattggatttttctaaaccatttatattagttgaaagataaacaagtggaatatagatgcgtatgcttaacgatgttcttgctaatacgctgtgtgttacgtatttcactaaagaagtgttgaaaagaagccaaattaaaaattggcaacctaaggatggataattaatgaatttttatttcataacaaaagtaaagaatgggctcaggttaacagggtgttaaacaatgtatcaacgtgaaataaacgaggataagtggtgattgataatctattgcctgtggatcatttgtgatagattgctcaactacgtgaaacacttttatatatattagtttctcaaccggtatcaggtaaaatatgatgctataaaatgagaaataaagagtgcatatctaattaagtggcattaatattattcttcttgcaaaattattagttgacatgattgtcactattgatggtatttatttaaaaagaaaaaaatattttttgaaatatggtattagtaacctcgtctatattttattagggttttaacatgatattataatattggtgtatgttaaaagtgaagtttttactaaaattctttaaaaacgatattgacatgtcaacgttaaggtggttagattatatcaatttcatttttatcattattttctcatattattataaaataaagaattgaggttttgccaatggatacagctgttgataagccaactgaaaagttgactgttaaagattatgtatacttagtttctgccggtgtttctaatgccgtcttggttatgttggggattggattattaacacaagccattgcaaactttattaactggccgcaacttcatcaagtcggttcaattgctcaatggttgttggcaccagcgtttggagctgctgttgcatcacaattaaagacaaatactttggtattattcagttccatgatttctgcaaccgtcggtgccaatgcggtctatttcatttcatcaggcgttcacgctgccactgcaactggtaaccagatggctcaagctgctcagtcgggtgtctttaccactggccaaccaattagtgccgttgcagctgggttagttgccgcactggttgggaaatacttaaccggtaaaacaccgcttgatatgatgttagtaccacttgctgccactttagttggttcaattgccgggttgggacttgcaagtgtcacgacaccggctcttaactggctgagtgccttcatcgcacaatcaatgcaaatcaacccattgctcggatcgatgtgtgtgtcgcttgcttggtcaatctttttgatgactcctgcctcatcagctgcattagcagtggccgttatgctggatccactggcttctggagcagcactaattggaaccacagctcaatttgttggcttcacgatcatttcatggaaacaaaatgaattaggagctaatattgctcagggaattattacgcctaaggttcaattccccaatctgttagccaatcctcggctggctttaccatctatgaccgctgcggttgttgccgcaccgattgcaacactgttctttggctttaaagtgccatatacattaggtggtttagggcttaactcattaatcgccccaatcactttagcatcgaccagcaccaatatgctgattgcatacttagtaatgggaatcgttattcctggtattatttcagttgttatctatcgagttttactcggccttcactgggttaaggatcaacaactacatcttgaaatcgtttaacgaattaaacaaataaactaaaaaacaataacaataaagaacgggctgtgacaagtataaaacttggtgcagcccgttcttctttatactgattagtgaaagcattcctactctgaataactaagattaggacaggggaatcagatgacttgctggttactcgagttcacgaacttggtcaattagacctaatagtttgtcagaggctgctcggtaatcttcaattttatcaccgtacttttcattaaacccctctagtccgcctgccacaaatgcatattcatagttataaacgtcatcgtaagcagctgtgaacttagcgaggaggtcatggtggttaccatcgagttgtaaggccatttgaacaacgcgaaaatcagtgtagcccatttcaaattggatggcccaagctcgaatgaaatcgtgttgagcttcaatatgagcaaaatgatgttgtgtattccaggttaagcgatctaatgctttaacgatatctaacataataattcctcccgataatttttagtgtaggccaacttcattagttccccgttaaaattggactatttacacttacattcaactccatttggtaatgaatcacaattataatgactttcttttcattgttgagcattaatttgagtttgatttgcttactttttttatgatttgctagctatttaaatattaagcgacttattgatggcaaaaacaatgacaaatcggatgatttttttgaaaaagggagcgttaaaactttgtgttgtgtttcacaacacggcgtcatataatcattgccataagatgttatcaaattcacaagagagttaatggaggattatcagtatgtcaaacaaagttgcgttagtgaccggtgccggtcaaggaattggtgaaggaattgctcgtcaactcgcaaaggatggctttgctgttgcattatccggtcgtcatttggataaggttcaacgagtagcagatgatattaataaagatggcggtgatgccttcgcaattaagtcggatgttcaatatcgagaccaggtttttggttctgttaagcaaacggcagatcatttcggccatttggatgtatttgttaataacgctggcgttgcccacgttgctcagatttgcaatacaaaggaagaagatcttgaccgtttactagatattaacgtaaaaggaactttcttcggtattcaagctgctgcgcaacaattcaagaagcaaaagacgcctggtaagattattaatgcttcatcgattgccggacatgaaggatttgaattacttggcgcgtattcagcaaccaagtttgcgattcgcggattaacccaggcagctgctaaagaacttgcccgcgatcaaattactgttaatgcttattgcccaggaattgtgttaacaccaatgtgggatcaaatcgatgaagaaatgggtcaagtaaaccatgttgctaaaggcgaatcattgaagcaatatctatcgggcattgcgctgggacgcggtgaagaacctcaagatgttgctaatttggtgtcatttttggcaagtgacaaatcaagctatattaccggccaagcaattatggttgatggtggtattaaatacgtttaatttaatgatgaaatgttaataataaaaacgtcttcgagaatttttttctcgaagacgtttttatttaggaaatttattaagttgattcggatatgtgaaccattatgacaactacttgatcaattgtggttgaaagattcctagtacggtatcttgggccgtaaagactgggacttggtgacttaaggctttcgccacgagctgcttttcgtcgtcggtttcgtctgatgatgaaagggcgaatgccaacttgtcaggccatggcatatccttcttataaggaacaacgttaaagccactgctctggagcttatccttcaaatcatcgtcattggcatcaaattgcgaaattaagacggttccactgattgtatcggtattgatgtggtaactgtcaaagagggcgttatgcaaagcctcatgaagcgtatcgccatcgccaatatcttcgccggttgatttcatttcagggcttaatgcagttggggcacccggtaatttggcgaatgagaagactggtgcttttacgtaaactttggttggttcgggatataggccgggttttaagccaatttcagtcaatgatttaccaaggataagttgagtcgcaagttgagccaggtgcatcttggtaatcttgctcatgaatggaactgttcgggaagcccgtggattaacttcgatgacgtatacagtattattggcaacaatgaattgaatattcatcatcccaacagcatggacctttttaccaattttggtggcaattgccacaatccgatctttttgactgtcagttaatgtctgtggcggatacattgcgattgaatcccctgaatgaataccggcaccttcgagatgttccataatgcccggaacaaaaacttcttggccgtcgctaagaatatcaacttcacattcagttcctgggatatattggtcgattaagattggttggccggcacttgcttttaatgctggaatcagatattcatctaattcgttatcgttatggacgattgccattcctttaccaccgaggacaaaacttggccgaacaagaactgggaagccaagtttgttagcaatcttgtgtgcttcttgcgcgttcattgcagtgtcacccttaggatgatcaatttcttgatcaattaagagatcttcgaaatcatgacggttttcagtttgctcgatgccgtgcatggacgtcccaagaattgcgacaccgcgttcagttaatttttcagtcaggttgatggctgtttgaccaccaaattcaacaatgacaccaattggattttccaagttgataacgttcataacgctatcgatatccagtggttcgaaataaagtttatcggaaatcgagaagtcggttgaaaccgtttcaggattattattgatgatgatggcgttgtagccagctgcttgaatcgctttaacacagtgaacagtagcataatcaaattcaaccccttggccgattctgattggaccggcaccgataacaacgatactatttccgagtggtttgctttcgttctcattaccaatcgtgctatagaaataaggcgttgtgctttcgaattcagcggcgcaagtatcaaccattttatatactaaatgttgatcttccatgttatcgaatttctctagatcatggtcggaaattggatgaacagttttgatcatggtgttgttgaagcccattttacgagccttcaaaatgagatctgcattaacaatgccactcatcaatttctgttgcatatgcatgatgttttccaatttggataagaagtaaagatcaattttagttgattgatgaatttgttgaatggttgctcctttaccgagtgcagcaaagagttcaaaaattcggtaatcagttggtgttttaatcttctccagtaaatcgcccattgacatgttttttgtataggctggaattaagttgttttgagcctgtttatcaagttcaagtgattgaaccgcttttaataaggcttcctcaattgtgccgccaattgccatcacttcaccggtggctttcatttgagttcccagtttgcgatctgcgttcgtgaacttatcaaacgcgaaacgtgggattttggcaaccacataatccagagcaggttcaaacatcgcgaaggtagtttgggtaattgggttgataatttcatccaggtttaaaccgactgcaatttttgctgcaatttttgcaattgggtaaccagtcgctttagaagccaatgctgatgaccgactaacccgtggattaacttcgatcacgtcgtacttttcgctgttgggatcttgagcaagctgaacattacagccaccctcgattttaagggcatctacgattgtaagtgatgcgtcccgtaaccgttgatattctttgtccgttaaggtctgagtcggggtgaacacaattgaatcaccggtgtggacaccaactggatcaaagttttccataccagcgacaataattgaattgccatggtgatcacgcatgacttcaaattcaatttctttaaagccggcgatactcttttcaaccaaacattcggttgaaggagacattgttaatccccgactaaggacagttttcatttcatcgtcatcatgcgcgataccgccaccagtccccccaagggtataagctggtcgaatgataaccggatagtcaatttgatgggcaaattggaggccggcttccaagtcgtaaaccgtttttgattccggaattggctgatggagttcttccattaaatctttaaattgttcgcgatcttcggcttgattgatcgtttttaggtttgtccctaatagttcaatatgcagtttgtcgaggatgccatctttacttaattcaacagccaggtttaaccctgtttggccacccaaagtaggtagaattgcgtctggatgttccttttcaaggattttctttaaactaggaacagttaatggatccatataaacgcgatccgcaatttcatcgtcagtcatgattgtggctggattagaattgacaaggatgacttcataaccttcttcacgtaaactaaggcaagcctgactaccggaatagtcgaactctgcggcctgaccaatgacaattggaccagaaccgataatcaaaatcttcttaatatcttttcgttttggcattagtgaacccctccgttaacgtgcattaaatcaataaagtcgtcgaataattttgtggcatcatgtggccctggcgcggcctcgggatggtattgaaccgagaagattgggcggccaggataacgcagcccctcacaggttttgtcgttaacttcaaccgcagtcacttccaatggagttggttttacagaatcaatgtcaaccgcataaccgtggttttgagatgtaatgaaaacgtcttgggtcattaaatttttaacaggatgattaataccacgatgaccaaatgtcattttgtaagtcttagcaccgtttgcaagtgcaagtagctgatgtcctaagcaaatgcccatcaatggatagttgtcttgtaatttttgaatggtaggtagaaatgcggaataggcttgcggatcaccgggtccgttggataaaagaataccagttggatgcaggttttcgatatcttcaaacgttgaatcaggtgtaacaactgtaacatctacccctgggcgttgtagtgattttacgatgttatctttaacaccaaaatcaacaaccacaacgtgttcaacatctttgtcgtctgtaacagaaagagttgctgacttaacaaatgaaggtttgctttgcgcctcaaccgaagtttgattaattggttgattagttaagcttgccttcatcgttccgtactgacgaataatcttcgttaactgtcgtgtatcgataccactgatgcctggtactttggcttgttttaaaaacgcatcaagtgacatgacgctttgataatgaaaaacttgatcggtcatctcgcgaacaacaaccgctgctgctttaactgaatccgactggttggttccgagtgaaatcccgtaattaccaattaacggatacgtaaacgtgataatctggttttcgtaggatggatcagtcaaggtttcctgatagccggtcatactggtagtgaaaactaattcaccatcaatttcggcagctaagtccccacaggcttcaccaacgaagacgtctccattctccaaagttaaatactttttcatttccgaacctcctaataatttcctaacatcgacatgatattagcagttaacgcttttgataaattaagatagaagtattttcagcaaatgtcaagtcgttttatacagaaaaagacgatatatggatttttatgtacaataaattttaaaaatgaatatttattaaaataagaaatgtccttccaagtacgtcttgtatacatagttaaggcatctaattctgacactgcaaaaatttggataaataatcatttccaaaattattttttaaaagaggcttgtttttttgaggaaaaaggcatatgattcaaataacaaaaaaagaacctttaagattaaccccgtgaggttaagaaggaatcgttgaacctgggatattctcaggaataactacaacctctttacccaacggcggtaaagaggttttttcatgcagatattgatttgattgacgatttaattgttcccgtgagagcaaaacgtcccctaaacactgtggcaaaagaccacttaatcaaggagcgctttgcgaacatggcaaagcgcttttatttatatttaggaggaattgacaatgatgcagatcactaaaccagcaagctttgaaaacgtagtaagtatggaagacctttcagttgaggatgttttatcatttgtccatgacgccaccgagtttaaagctggcaaacaaattgaattaaagcgaccagtctatgccgcaaaccttttctttgagaatagcacccgaacccatactagttttgaaatggctgaacgtaaattaggattacaagttgttaactttgacccagcctgcagctcggttaataaaggtgaaacaatgggggatacaatcaaaacccttcaagcaatcggggttgatgtgatggccattcgtcataagaagaacgagtattataaagatttggtctcagatcctaatattcatgttggaattgccaatgctggtgatggatcgggtcaacatccatcacaatcattacttgatttgatgacaatttacgaagagtttggtcattttgaaggattaaaaattgcgatcgttggtgatttaactcattcccgggtcgctcattcaaacatggaagctctgactatgctgggtgcccacgtttactttggtgggccaaaaaagtggtataccgatgagtttgccaactacggcgaatggttaccaatggatgaattagtatcgcaaatggatgttatgatgctgcttcgggttcaacatgaacggatcgatgcaaatgaaaatggggccttctcagcagcagattatcacgaaaagtatggtttgacgcttaaacgtgaagcaatgatgcctgatcaatcaattattatgcatccggctccggttaaccgcggcgttgagattgcggatgaattggttgaatgtgacaaatcacggatcttccgtcaaatggaaaatggtgtttttgtccgcatggcaattatgaccagtatgctgcgtaaccgtgatcttgtgaaagcagaatattaataccagacgaggagaatttacccgatgaaacgtgtaattgtgaatggccgcctgttggaaaatggaaaattagtgagtcgagatatcttaattgatgatggcacagtaattgcgattgagcctaaagttaacactgaagatgctgatgatgtggttgacgcaaaggggaattttgttagtccgggattgattgacgttcacgttcattatcgacaaccagggcaagaagaaaaagaaacaatcaagacgggcagtttggcagcggctcatggtggctttacaactgtttgtgcaatgcccaatgtcaccccggcaccggatagcccccataatatggaaagtttaattaaattaaaccgagaaaatggagttgttcatattaaacaatatgccacgattacaacgaatcgtggtggtgatcaattagttgattttcctgctttaaagagcgccggtgcctttgcatttagtaatgacggtaacggtatccaaaaaagtagtacgatgtatgaagcaatgaatcaggctgctgacttggacatggcgattgttgaacacgttcaagatgatgaccttacatatcatggcgtgcttaatgacggggctgctaagcgacttaacatgaaggcaatgccatgggttagtgaaactgctcaagctgctcgggatgttatcttagcagaagcaacgggtgttcactatcacgtttgccacgtttcatccaagcatacggttaatgtgatccgagctgctaaaaaagccggcattcacgtgactgctgaggtaacgcctcatcatttattattgtcagatgaagatatcaaggaagacaattcttactataaaatgaacccacctttacgtgggaaagatgaccaacaggctttaatcgaaggattgcttgatgggacgattgatatgattgcaactgatcatgcaccccatacaaaggaagaaaaaaatcaatcaattcggacggcaccgtttgggattactggtagtgaaacggcctttagtatgctctataccaagttcgtcaaaactgggcgttttactttggatcagttaatcaattggatggttcgcaaacctgctgctgtttttaatatgtcgaatgctggttctcttgagacggggcaacccgctgacatcgcaatttttgatattgatgagcaaaatataatccaagaaagtgattatttgtctaagggaaagaactctccattcactggcgaaacagtctatggggatacggttatgacacttgtgagtggaaagattgtgtatcaaagaaaatagagtggcacaacaagcggttagcctccagaatataagtaacttcagccgatatccctggtttttagggatatcggctgaagttatttatatggcaggaggctgcttgttgtgccacgttttggcatggtagaaaggaacgtctatcctgtttttagggatatcggctgaagttatttatatggcaggaggctgcttgttgtgccacgttttggcatggtagaaagggaacgtccatcctgtttttagggatatcggctgaagttatttatatggcaggaggctgcttgttgagccacgttttacatggtagaaaagaaaatttgcattctcagttttggggaatatgagccagggtgatttatatggccgaggacttttacatatcctgacgtggtagttttaagcttgggtctctatacgaggtgttaactaaaccttctttgaaaaagttgctgatcagtgtaaaataccattaatagttttagaagggatagattgtcgttgagaattaaagtgaaacattttgttttcgttgtaattttgttggttgccgtttcactaccaagtccaattcaagcaaaatcaattaaaaaagaagttcaggggaatacaactacaacaattgttaccagtaatatcattcatacatccaatgttggcaaacgggtctttttaacccggatacccgttaaacttcatgctattacaaacgaggaacctgatccacaaaaaattgtagcagtacctaaaaatacaccattaattgtgcaaaaaaagttggcggaagataaaggctatttggtttcgatgccacattcgaaggcaaaactggtgattagtcacccggcaaaattaatttattcgactaagacagccaaacttaattctaaggaaatgaaagcacttcgattatccgctgataggtgggctaaaaagctaactaatcgggaaattaaggcaattcgttactatacaaacaatggttatggaaagattaatgacacacttcgtaatcctcataaaagggctactagtaaagtaaaaacaagtattaaacaaattaatcgggcgatcgaccaatatcaacttaaacaaccattaactgtttttcgagggacaactccgctcgggttaaccaaatcacttggtagtcagtctgtaaaagtcggcggtcagtatcatgaccccgcttattcatcaacgacgttgagtcagatgattgcactgggattctcaagatcaaaacaacatgtcgtcctaaagattaatttgcctaagggccgctatggtgcctatattgatccaatttcaactaatgtcggcgagagggaatatttgttacatcatggtacaaaattgatcgtaaccaaaattcaaaaagtccatttaacggtccacacggtaacaaccgttgaacagaaggggaaaaagccggttaggaaagtaaccaatgcgccaatcaattatcgattagtaacgcttagcctgatgaaatagtgcttactgtggtggatcttatatcagtaataattatttgaaaaacgagtgactgggctgggacaaaagtaattttatcccagtcctgttttttgtgtaatcaagattgttaccaagcgaaaacgtgagataaagggcaactttcagagcgtagccgcctttcgtgccactcttttgttttttgaataattaaaggattaggttaaggataatgtaaacaagagattgtttgttagcgcttgttttcagtttgcgatttttggttcatgtttaatggtgactgtttatctgaaggtttgctaagtgctttttcatagtcggaaaccttaatgattgtcgatgtggtaaattgatggtttctaaacttctttagtatcttataactttgaaaaccgctcatcgcaataatagccaaacaagttaacacaactaacttataggcgcagtgcgacttgttgcatttgaacaagataattagtggtagtaaacagccaattagtggtatgacggcactaacgtaagcaacgagaactaggattaccagcaaattaatatcttctgattgaccttgaatccggtgctgggtgaactctaccacccgttgctttcgagtgatatgatctttgaccagctgattctttagttctggatcatccatcaagaaatcctccatcgatcgtttataagtaacacaaagcagaactaagttatcaatatctggataccctctattattttcccaacgactgattgcttgacgtgaaattttcaactttcgggcaacatattcttgtgaaaagctgttttcaattcgagcgtcccttaatttttctcctaatgccattactaatcacacgcctttattagtgagttggttgatagatgtatcacaactaaattctcatattaattggctcatcgcaaggtgtttgaagataacatgctatggttgcgacagaaaagttgcaactattacaacaataaatactgatatcactgagttttatcgaaaacattagaaatcaaatgtctaattttgactattctcattattttttaatttcgaaaaaatgtcatcatttacagagatgttacaaattaaccaattagcaatttttttagaatgtaacccaatgtaaaacaatcgttgcttttttgccaacgaatttattggtacattaaccctatggctttgaaatcgataaatgtgggagggcaatcatgatgaaaaagcgagatacacaagttagccatggtttagagatcaaagggcggttggcggcaattaaatttggtgttgtgactgcactggctacattattaattgcgtttctaataattggtggcattagtgtgtatcaggggcagttggtaatgagttatcagtttctaattggcatgacggcagttggctttttcgaaggcgaatattttaaaacatcctgtatttggtggctggttattggttcgttgctgtgtggcattagcagcttatttctataacggctaatattttgttggagtggtgggtgaagctaatgaagaagctgaagaaaaggccgaggatgttcttttggttaatgattgtcttgttgaccatctgggaagtcttacttatcggttatttattgtggattgatcgagaagaattgatgtaccgcaaactacaaatatttgtggttttcactacaagtgttgtatttggctggttaattgtaaaaagctggcgatctgatcgataaccatgaaaaaactattttcaattgaagctcgttgatgattctcctggttaggcaaaagccactatttttttgaggcgcaaactattctaccagacctgaaaggaagcttaaaagcaaatgaaatcaaataacaatcaagatatcacccaatatccaaagtggtttcaacggttcatgaaaatcaataatagttggacattacttaccgttgccatcatttctggagcgatcggctatgtttttaacaatgcttatttctatattattgcgtttattgccggaatggttgattttgttacgggagttgtaatactggttgaaatgccagtccacattttcagaaaccgcaatcggaaacataggtaaataaattgggtctaataattagacgcgtggattacaagtgtttgtaataaaaaacgagactgggacaactctttaatccccgtctcgtatatggttaacttgtcattttaatgccgacgatgcttaccagaagcaatatcacgaatagccaagttactagtgataatttatcaccaaataatataatcccggcaatcactgttcccacagccccaatgccagtccaaaccgggtacgcgatcccaattggcaaagttttcgttgcatgggccagcaacaggaaactaatgatcatgcccacaattgtgacaatggtagcgctgggttgtgtgaatccatgactgaatttcatggcgatggcccaaacaacctcaaataatcctgcaataattaaatatatccaattcataaaaaaatcctcctagtacgcaaaaagagtacccccaacaatcccttctaagacctaacggaattgtcaaaagtactcaaagtttctacccggtggcagttgtattaatttcaatttatcatagcacatttgggagagaaaacaaattagtgtgaactgattggggtaggcttgactgtccataagcaccattaagattgattttttaattttcgattaattgatttaacttcgtttttggcaattagcatgttaattgaaaatacaatagcgtaaacgactaaaaatgttcctgtaaatccgataatttgaccgatatttagtggaaaccagccgcttaggattgccaagggaagaaacccaaagtatgagattgttaaatgaacaattgtcattttggcaatactccaatcagttcgtgtgaagactaaggcacctacagagaaaacaatcccaattagtgaccaaatgaacacagaaatacaggttgcacttaatgttccgctaaattgtgctgtccatgccggtgaagaagggtagtaattctttgcaccgtttaagtatgaaaatactaatgatagaattaatccaataaatgtgccaagaatgatgccaattagtgcttgaatgctaattcgtttcattgcaatcgctcctttacttttttgagataccttctagaagagctggtttgataaccattcttaaaatatattatgataatgccggtcttgttaatttgaaattctttaacaaagttgagattaatgatttcagtgttggaaatcctgataaaagcttctggcaatgtttcttccaactcgtatagtcgtttactaactaatagttctttttgatcttgtgtcagcgtgtaaaccttctttttagctgtgtaaaatgtaatgcaggttccaagtgagatcatgtagtgtcgccggttatggtttgcaataatggtttcttcgtcttgtccccgaatgaaatcaataattttgttaatcagcgttgttcgtttgtttattccaagtagaagggtgttgtcatctagtgtgtgaataattttaacttcaatcttcatgtggtcgggcctcctctcttcactttcattttatgggtttttattaataaaggatatgtctaagagataagtggtcgttatttgtgataagtggttaaaataatttcctttcataggtgatggttggcacaaaaaagatgacctctagcaattattctttgcttcagtcacctttttatcaaatgttggataaaataaaaattattttttcaaaactcgcacacggaatactgcatctattttgcttaatcgggcgatcaacgcattgtcttcctcatttttcaaattctctaagtcaataatggtataagccacgttttcacgagcagcgttactcattccctcaatgttgattccggcatttgcaagggcagtcgcaatttgacccaccatattagggatgtttttatgaattaaagttacacgatagggtgtttgaaacggtacttgaagattgggcaaattgactgagttcgtaatattcccagtttctaaataggtcataattgtccgagcaccctgagtcgcaccattgacctcagcttcttgagtagaacccccaatgtgtggtgtgacaataacgtcatcacgattgaggaggatgttatcgccaaagtcagtcatataggtttgcacacgatgggcgtctaaagctttgatgacggcttggttgtcaacaatgccgccacgcgagtaattaaatagccgaacgccatccttcataatcgcaagttgttctttgccaattagaccggttgtttcctcgttcttagggacatgaacagtaacgtaatcggcgttgctgatagcttcagccaaagttcgcgctctggtaattgttgttgagatatgccaggcagcatcagctgatagatagggatcgtaaccaataacattcatgccaagtgcactagctgcattggcgacaagcgaaccaacgtgaccaacgccaatgactgctaaggttcggcccgttagctcggtgcccttaaatttggtcttatcatgttctgttcgtaacgaaatgtctgccccgctattttgagcagcataagcagccgccgcaaatagatttcgtgacgacgcaaccaagagtgaaacgattaattctttaacagcgttggcattactccctggggtgttgaaaacggctgttccattttcagttgcccggtctaatggaatattgttgaagccagcgccagcccgtgcaatgactttcaaagttttcggtaaggtttccttgtgtaaatttacggaacgaatcagataggcatcagcatcatctgtttggttaatttgatactgatcagtaaattgatctaatccggcttgagcgattgcgttatatgtttttacttgatacatcttatttccccctctaatgttgtctttcaaaattgtgcaagaaatcgaccagtgcttgaacacctgctaatggcattgcattatataaactggctcgcagaccaccaacactacgatgtccctttaagttcattaagccggcatcggttgttgcttggatgacttgtttgtccagatcggcatcaccagttgtgaacgggatgtttgtaagcgaacggtcagttttcttaatgtgattgctaaacaatttggagtcgtctaagaaatcatatagtaatgctgatttttgacgattgattctttcaatttcggtgataccgccttgctgttttaaccacttgaggactaatcctgatgcgtaaattgcgaagacgggtggcgtattgaacatcgagttctttttaacaaataagttgtaattaagaatgctggggatgtgttcaactggtttaaccagatcatcccggacgatggcaattgtgacaccggctgggccgacattcttttgaacacctgcaaaaataaggccaaaatcagtaacattgtattcctcagctaaaaagtttgaggatagatcaccgaccaacgtgacattcccgtgttctggaagttgatggtaagctgttccttcaatggtattattcgttgtaatgtgcaggtaatcataatccttgttggaaatgggattaggcatctgcggcaatttttgataatggtcatctctagttgaagccaaaacatcaacttgaacgcctaagttggctgcttcgtcgccagcccgggttgcccaatgaccactgtctaggagtgcaatccgtttgtgattggtggcaagatttagaggagcagctgcaaactgaccggtaccgccaccttggaagaagagaatatggtaattatcaggaatatgcataaggtctctcagatcttgttcagcagtgttgatgatattatcgaaaagtgaagaccgatgtgagatctccagaatgctcattcccgtgccatcaagcgatggtagttcttcttggatctgtttgatgaccggatcaggaagggttgccggaccagctgcaaaattataaactgtcataaataaaaactcccttatcaaaaattaaaagctctcacggatttaataatcaccatgagagcttgttcgctacgttattagcggtctcacagtgatgaaaagttcatccatgtcaggccttttgtttaataattcacaccaaaagatggcctacacagatgtcaccgtagaccaggaggaagatgtagttgttagcttgattaaattaacgttcatcattctgacctccattcttataactaaaatctaacagaactctcagagaaaagcaaccagaattattgaatattattttttgtcaggtgaaatatgtagccaaattaggtcaaagagtgcataataattcctaacacattcattttaagatgaacaatggaggaacgttaatgaccgatttttactttattcgacatggcaagacgccagcaaatgcagacggaatcaagcagggaactattaataccactgaaacttatctttcggaaaccggcaggaagcaagcgcaaacgctacacgaacactttgatatttcatttgctgatcgaatcatttcaagcccactgcagcggactaaagagacgacgaagattcttaatcaaaccgcagacttaccggtaacttatgataaacgattgttggaaatctcctacggaaaatgggatggtcagaaaaataaagacttggaagctgtttatccagatgtatttgatcatgttttacatgatgttttaccgacatacgcaccattagctaatggtgaaacatttgaggatgttatctcgcgagcaggtcagtttatggttgatactgctcagcaatatccccaagacaggattattgttgtgactcatggttttacagtcaaagcggcagtattaactgcattgggagatccagatgaaaagatggttgtagaagagcctgataataccagcgttactaaaattacaaaggatattaattcgggagcctactacttaagatatttcaatcgaatggttaattcggaattttaatttgacaaataattcaccatccgttatagtttgactcagtaaataacgaaggaggaagccaccaatgcaattatcagctgctcaacttatgtgttgctcaatgtgtcaagttcaggttagcactgatcgtggcttctttggtaaaaccatcatttagttgggcatttaaatggactcgggtgagtttagcaaactaatgatgacccaaaagtgtcgcagtttcagtgttaactgaagctgcggcactttttctttgtttaaatttttgaataaggtggcggtggatttggattcttgttgtccgatgcaaagtgaagtgaaaaaattaagcaattattctggaggaatttaaaatgcgaaagtttagatcgattctattagtggccgttcttgggttagttgtcattggacttgcggcttgccaaaaatcaccggctaaaaagtcgacttcaagtgacaaagctgttttgaatcttagcaccaccgcaccacttgatacaattgatatttctaaggcgactggttatggtcaaaccggaaatgtgtttgagagcttttatcgattaggtaagaatggcaaaccaacggccggtttagcaaaaagcagtcaggtttccaaagatggtaaaacgtggacattcacgttacgtaatgctaagtggagcaacggcgataaaattactgctcaagattttgtttattcatggcgacgaacagtaacaccaaagactaaatcaacttatgcatatttattcagtgggattaaaaacgccgatcaaattgcagctgggaaggtttcaccaagcaagattggaattaaagccttgaataacaagactgttcaaattcaactggataaaccaatcgcttactttaaggttttaatggcttacccactatttggaccccagaatcaaaaagtggttgataaatacggtaaaaagtatgggactcgttcaaaatatatggtttactccggcccattcaaaatccagaactggaatgggactggtaataaatggcagtttgttaagaacaaccagtattgggataagtctgttgttaagctgaagaaaattaattataccgtggttgaaagcccaaccaccggcttagaactctatcagcagggcaaacttgatttaacaccactttcaaatacccaaattaaaaactataaaaataattcgcaatttaagcaatatccatattcagttgtcggttacttgaaatataattttaaggatgccaatccaacgaagcggaagatattaaataaccgtaacatccgactcgcaatgtcgttatcgattaatcggaaacagttaactcagaaagttctcggtgatgggtcagcaaccccaactggatttgttgcttctgatcttgctaagaatcctaaaaccggtgaagacttttcaaaagaacaggcggttcctaatacggtcgatcacaatgagaagttagcacggcaatattgggaaaggggattaaaacaacttgggattaagaaagtaaatctaacaattttgggtgccaatgatgatccaacaacaagcccaatttcacaatatttaaaagctcaatttgccaaggtgttgccaggattcacgttaaatattagaaatattccctctaaggcatctaatgaacaagaattaaagggcgattttgatattagtttgtcgggatggggcgctgactttaatgatccaatttcattcctacagattccgttgacgggaacatcatataatagcggaaaatatagtaatgcgaaatttgattcgttggtaaagcgtgctcaaaaccaagatgccaataatccagagaaacgctgggatgatttggttcaagcaagtcgattatttagtaaggatcagggaatgacaccactgtaccaacaagtcacttcgtatttgcagaaaccaggcttgaagggtgtcattcataatactgctggtacgcagtggaattacaaatacgcaaccgttaagtaacatcaacaagatcgttaaaaaggttagttgataggaaatcagctcatttaaatatctgaatagtgaaatcaaaggaagccagagcgggacaaaaggcggttaacttccagccgtgtaattggattatccgaatattctgaacttgaatatttggataatccaattacacggccggaagttgccttttgtcccgcgttttcgctcggtaacaatcgtgtttacatgaatagaggctgggataaatgacttttgtcccagcccatttgtgtcatcatgattattaccgagtggaaatgtgaggaaactaagcgttttttacctcactctttattttgatttcattggctatagagaatggccactaattctttttgctggaataataatcggtggcaactgaatgcgcggctgattggcttttatcgcttctaataacaaactagcggcattttgccccattttaagtggatcctgctggattaaatcaattccattgccaacaaattgggcccaattccagtcatcaaagctggttaatccaatatcgtcaggaaaacttaaatgtagcatattgatggccgacaatgttttgaatagtaacggccccattaatgagactaaggcggtcttttgaggatttttagtaacatgtttgcggatttggtttgcgatccattcgtttgtgtgattggccacattaacgttaatgataggaattgcgttgtgttgggcaacttttgtaaatccgtcgattcttggaatttgagcagaggtttctaccgttgagctgctaatcagaatcattttttgataacccaacttaattagttctgttgccatggcctcacttgcttgaccattattagtgattactttgccaataaattttggttgatctttaatataacgatccacggtcacaaacgggacgttagcgtcaagaacaaactggtaattttgaaaataattctggctcggttgaataatcaaaccatcaatttgttgttccagcaggcggttaatgcctttgtgttcttcgtctgaggagttgtttgcgtttaataggagcacgctgtaattaagtggttggagaatttcataaatgccgctaaataataacgaggaaaagacattagaaatatccccaacgataacaccaatcatttttgattcatgcgttcgcattcgccgagcagaagcagacggtcgataattaagctgcttaataacagtttcaattttttcctttgtgacatcactcatcttgccgtaattctgattaataaatcgtgaaacggttgtaacggacacacccgcagcttttgcgacgtctgatatggttatattcttcatttggaaacctcttgttagtcgttaattgattagataagctaattttagggcaaaacgagacctaatacaattagctgataaacctcaatgaagatgtctcagattgaatatgttgacaaggctaaagagagggggtatattcttggtgtatcgatacaccaattttggtaagcgatttcatctaaggagaatgagctatgaaagcgattgttatttctggtaaaggaaagattgatttaacgaatgttactgatcttgttaagcaagccaaccaagtgatttttagtccgaaatttgttggtatttgcggttctgatcttcactatctagcagatggatcggttggccaatcggtgattcgagagcccttaattccggggcatgaagtcagtgggacattggatgaatcggttgtcattgatggtaagacaatttcccagggaactaaaattacggttcatccagcaacatttggtgataagcaggatagaattgctgagtatccagaaatttggccaaacggtcgttatttaggatccgcgcaatatttaccacatactcaaggcggaatggttgaaaaaatggccgtacgaccagatcaagttcgagttgttcctgataacgtttcattggagtctgctgcattagctgaaccgttatcagtgggtttacatgcaattcaactagcaggtggcgtaaaaggtaaaaaagttttggtttcaggtgcggggccgattggactactcgccgcgggtggtgctgttacgcttggagcaaatagtgttaccgtttcggatgttttggatgaacctttagcccgggctaaaagattaggcgttcaaagaagaattaatgttaccaaggaatcactaccaactaatgagtttgatttgattcttgaatgttctggcgcggcaccggctatcagtgcatcatttaaggcggcggctttaggtgcgacaattatgcaagtgggaatgatgattgatcagagtattcctttaaatatttcatcaattaatggcaaagaattaacctatcgaggaagtttcaggtttaaaaatgaaattgatcaggcattgcagattcttagtaaaaatccggtaatcagtaccgttatcacacaaatatttaaggctggcgactatcggaaagcttttgaggttgccaaggacgcaaagcaatccgctaaagtactcattgaaatgtaacggagggatctataatggcaaaatttgatcgtgatagtttttcgctaaaaggcaaagtagcattagttaccggcggcgctcgtggattaggaaaatattattcaattgcgttgtcgatgtatggtgcgaatgtgttcgttgtcagccgaaaacaggatggttgggctgagttgaaacaaatcgttgagaagaatggtcaacaaattgactttctgagccaagatattactgtatcaggagcagcagaaaaagttattcaagcggttattgagcgatttggtaagttggatatcttggtaaataacgccgggatgcagctccgaaacgatgtcttggatttcaaagatgacgattggctgaaagtaattgatttaaatttaaacgccagttattttttggcacatgctgccgcaaaggtaatggctgaacaaaagtctggtaagattatcaatattggctccatgcaatcatatcgggctggcaaacgcatttttccatatgcagcaagtaagcacggtattttgggcttgacgagagcatatgctgatgctttagcaccttatcatattcaagttaacgggttagctcccggatacattacgactgatatgaccaaagcacttcaaaccgatccggttagagggccagaaattaaggcgcacattccatcaggtgaatggggcgttcccgaagaattgatgggacccatggtgttcctggcaagttcggcatcagactatgtgacaggtgtgatgttgccggtggatggcggttatttattaaggtagtttgtttttattattcaaataaataaatggcaatttattttctcaaaatgcaacaaattagagtgcgccaaaagttgtctttgggcgtacgcttccactcggtcataatcgtgattacacaaaacggcaggctggggcaatagtcgtttttcacagtctctgttagtgtcaacacgattgttactaagcagaaacgcgggacaagaggcaacttccggccgtgtaaccgaattatccaaatattcaaatttaggatatctcattgaacttgttacttagttaaaaaacgtggaccggcaagcggaccctggtcatagaagcccccctaacttaacattccaaaatcgggaatatcaagttaggggggcttctattctggggcctaaccacttgctggtccgctctgtttatttagtgggtggtagataggttaaacatcgggaaaaatgattcaaagttaggcaaaaaatgaatagatccagtaaatcagaaacccaaggcatagtcctaatgaaccactaattaggattttaacagagcaaacaaatgttttaactttaatttgttcgtgagtaaataatttcatctgtttaatgataaacggtaaaggtaacagaattgaaattagcgtgattggataaacgttgatgtaaattgccaagaagactaataaaattgctagaatattggcgatgttccataagagaacggaatgtgttacaccaagatagtgaacaatggtgtgccgatgatttttctcatcttcttgagcatcacagatgttattagcaaacataatattaccaatccaaacgaactcaggcgaagcggctaaaaaaatatgccataataaatgtggggtccaagtgaagatttgatacgagttgatataaaccgaaataacgacaatcatgacacccattgtgaagccggaagccagttcaccgaaaggcgtgttggatatcggcaatggaccggcggcgtataataaaccaattagaaagcaaaaaagtcccatccataatagtggcaagccaacttcgtaggtaaggtaaatgccaattagtgctgaggggataaacattaatgacatgattgttcgaagcaggtttaacgagatatgcttgcggccgataacgtttgtcccttttttaaaatcttcctgatcagagtgttgatagtcgttataattatcccaaatatcaacgaacatattgaacaggaacatcgctataaagaataaaatggcataaatcggattggttgaatttaggaaataccagctgaaaaaaagcccaacaataaacggaaagacgctggcagatttggccttaaattcaactaattctaagaaagttgataaactcatgtaaagcctccataattatcatatatatgtgaagctgaatgattctaaaaattggcagttcagctcacagtttgttgctaaataaattataccaaaggagttggcttatgggcctgacaaatcgtaccccggaacaaaaagtcgcatccatgtttgataaaattgcgcctaactatgatgccatgaattcgctgattagtcttggtggacatcgtcactggcgtaaaattacgatgaaagaattaaatattcagcggggaagtttcgcaattgatgtgtgttgtggaaccggagattggacgattgcattggcgaaagctgttggtccggctggacaggttgttggcttggactttagtgacgaaatgttaaaaattgctcaaaagaaagtttatcaacaaggtttgcaggatcgaatcactttggtgaagggggatgccatgcagctaccttatcatgatgggatatttagcgttgcgacaatcgggtttggattacggaacgttccagatgccaatcaggttcttcatgaaatggcgcgggtggttatccctggaggaaccgttgcctgccttgaaacatcacaaccgaccaatccagtcattaagctgggttggcgggcttattttagcctggtaccgttaatggcaaaaattgtcgttaataaatatcatgaatatgattatttacagcgaacaaccgatgaatttgtttcggcaaaagaattagttaagatgttccaaaaagctggattaacaaatgtttcctatcagacgtttacgtttggtgctgctgctctgcatttgggaaaacggctaaggccgtaggagaatggcgattattcagattttgtcttgcttcacaagattaaaacggttatcatatacgtaacttattcttaggagtttttaattatggaaaataattgtcgaactcagttgaatagttgtcgttattacttttggtttttccagatctgatctgtgataagccaagaggttttcgtaatggaaattaaaaggccgcgcagatcagcaattgactgtgcgggattaaaccaatggtgggtcctttcagtcaatcaatgactgggaggaccctatttttgagaggagatttaccaattatgagtaaattatcagaaagaatgaataagcgggtcgcagcattgtcaccgtcatcaattttgacgtttaatcaaaagatctcaacaattccagacattgtgaagttaacgttgggggaaccggattttaacacgcctgaacatgttaagcaggcggcaattacgagcattgaaaataatgaaagtcattataccaattcacgaggaacaattggtctccgaaaagcggcgactggttttttaaagcaaaaatatggattgaattatgatccggaagcccaaattttgattactgctggggcaactggagctatttattcagcactaacagcgatgcttaatcctggtgataccgtcattattccaactccgatttttccgctatacatcccgattgcgatgttgggtggtgccaaaccaatctttgttgatacttcggataacggattcatcctatctcccgaaaaattgcaggcagcgattgaagaaaataaggataccgtcaaggcagttattttaaacttcccaactaatccaaccggtgtaacatatcataaggacgatttgcaaaaattagctgatgttatttcgcagtatgatattttctgcatcagtgatgaaatatacagtgaattgacctatgatggtacgcatgtatcgatggggtccatcctgccagagcagacattagtgatgaacggtgtttccaaatctcatgcgatgactggctggcggattggcatgatctgcggaccagctgatgttatcactgaaattggtaaggtaagtgaattcacaattacgtcatgcacggcgaatgcgcaagctgctgcacaagaagctttcactaatggattaaatgatgctgccccaatgagagctgaatacttgaagcggcgcgatttattgactgccggtctgaaaaaagcaggctttacttgtcccaatcccaatggtgccttctacattttcgccaagattccggcagaattgaatcaaaacagtgttgaattctgttacgaattagctgaaaaagctaaagttgctgttattcccggtgcttcatttggtcctggtggtgaaggatacgttcggattagttatgcggccagtgaagcagatcttaaaaaagctgttgaaaggattcaaaagtttgttggtgaaaaggcaagcgtttaatttggaaaccagtttgcgcttggtagagtgactacggctagcaaactaacacaataaatcttgaataaaaacatttaaaaatcgaggcaattaattctcatgaaaattttaatgtacacggttcgaccagatgaacagggcccaatcagtgattggaataagcaacatactgaatatcaaatcgatacgaattccttgccattgaacgcgaaaactgttgatcttgccaaggggtatgacggaattgcgattttacaacatgcatcagttgatgagccgattgtttataaaacactcaaagagtttggcatcaaacaaatttcccttagaagtaccggctatgagattatcgacttaaaggaagcagcccaaaatggattagccgttaccaacgtaccgggctattctcctcgatcagtaagtgaattggtgcttgctcatgttatgtggttactccggcatcttggcgaggttcgcgaacgtgaacaacatggtgattttacgtggaccaatacagaagctaaggaaattcacacattaactgttggaattattggcgcaggtaaaattgggagtgcggttgcgcggatttttagagccttgggtgcaaccgtcattgcagcggatccaattcatcgaccggatttgaatgatacgttaacttacgtgaatcatgaaacggtttataaaacagcagatattgtcaccatgcataccccgttaactgaagaaacacatcatatgattaacgctcaggtctttaaagaaatgaagtcatcggctatctttatcaatgcttccagaggacctgttgtgaataccagtgatcttgtgaaagctttggaagataaagaaattgcggctgcggcaattgacacatttgaaggtgaaacgtcaatcgttaaccatgatttaacaggtaaaccactgcataacgaaaatctcgagaaacttttggcaatgccgaatgttaatgtgagtccacatattggtttttacacagaagttgctgttcaaaatatggttgagattactttgaatgatgttgatgcgattcttcatggtaaaaaaagcccacatcaagttagtagcaatgcttaaacagaaaattaaagaatcgtaaatatgaggcgattgggacaaataaatgtagtcctgattgcctcattttataaaatcgaaaaccacaaaccctcaattatcatcaattattgattaatttagcgaatgtaaccctacgtaaaatgatcgtttcttgttgtgagcttgaatttgcgctagtttgaaagtaattcaaatgcaaagaaggtgaattctaatgaaagtgactaaatctgttttgttggcagtcgcaacgatgggggttggtgttgtttgtttgacatcaagtaatacccatgctgcaaccaaagttaacccaatcccccgggttctccaaggttcttgggtcggaacatatcagcatcggccatttatgtacaagttaaccaagtacaaagtgcaatcaggtttaacggctaatggtcactggaaatccaaaccaatgacattctatgtaaaaacagctcaatccactgttagtcatagcaagtattcgctatttacagtctccaagcagacaaataagcgtggttactggaagctaagacttctaaactccagagataatttgtatttcaagcccgttaaacataatggtaaggcagcactatataaatatcatattgataaggaatatagtacaccaaaactggataatggctatttttatagaaaatagttgagtccttgtgagttccctccttaagatacagttcagcacatttcgatttgattaaataccccgattaaaaacaaagccatgtatacaaaaagaggctggaacaaaagtaattttgtcccagtccctatttgtgtaatcacgattattaccaagtggaaatgtgagataaaaggcaacttccagagtacaaccgaattatcccattattctacccggagaatattcggataatccagttatactctggaagttaactgccttttgtctcaccctatttaaagtttggatgatcaatttattggttagaatcaattaatatcaaaattacagttggcctaatgtatcagcaccaatggttgggaacagcgggacaagtcgttctaattcggctggaccaaatttgaactcaatggcgggaagtaaggtgttaatggcattttcggcctgatcactcatttcggtcgcgccaactaaatgatggtttttatcataaaccagtgcgttatcacccaggccttctttggtgacctgtcgataccagtcgtctggtaaatggttggttttaacttcatattgtccgttttgctgtgcgtcttcaattgaaacacccgcttttgcgattcgaggtgatgtgaaaaccacggatgggatgacagggtagttaattggatcggcactatcgcctgcaaattgatgcattaagtaggttgattcaaaaatagccgttggggttaacttgggctggtctttatcaatcacgtcacctgaagcataaatattatcaatactggtttggagatgatcatttacctcaatcccacgggcattgtagttaatgctaatttcatccaaaccaattccttgagtatttggaatcctaccggttgcatctaaaatccaatccgttgtgattgtttgattgtcattgtattcaatattgtaatgacgatcagtttgaccaaatttggtaactttagcattgttaatgaatacgactccccgtttttccaaatcagcgacaacttgtttgacaaatggttgatagaattttcgcaaaacatgatcgccatgcgtcaatacggtaacgttggatccagccgcatttgcgattgtcgcaaactccaagctaatatagccggcaccgataatcgtgatatttttaggtaatgtggttaggttcatgaagtcttcactgtcatgagctaagtcagttcccggaatatctaatcggtgtgggtgttgaccagttgagataacaatcttttcggcggtctttgaatcattatcaaccgttacggtgtgacgatctttaagaacaccatgacctgatatgagatcaatgttaactgatttcattagaccgccaatcatgttgggtaacccatcgatcacagcgtgtttatgctgctcattggctttccagtcaattgacaaatttccatttacaacgccgtttaagtttttggcgagccgggtaagtgcaaccggtgcatctagcgtgattttggcgttgcagcctcgattgggacacgtaccgccgatcagtccagattcaataacgccaactttgacgccgcgtgcagccaatggaattgcgccatcaaaggtaccatggccactaccaatgtataagacatcataatcgtattctgtgtttgccataaagtttatccctccattagaatgtgtctgagacgtttactgccttaagactactcttctcacggtagtccacgcaaagaatttggctgactttttcattccgattacgaaacatgtagcttaatgggttgagtctgcgtatactttactaaaagataaaataggaagtggtttgaatgcgaagaacagatcgggaagtaactgatatcgatgaaattaagtcaattttgcgagagtgccatattatcaatagtggttttcgaactgacgactatccctatgttgtccccacaaattatgggtatgagtttaatgatgaacagttagtgttatatattcatggggcacccgttggctataagcggaaactaattgcggcagattcacgaatggggtttgcaattcatgacgcaggaaaattaatgatgcccaaagatccttccaagaatacgcccagtatggcctatcaaagcgtgatggggtatggggatgccgaattaattgacgatcttgatgctaagaaacacgcgctggttcagattctaaagcacgagataggtgatcagtggaagacagtcaagattactgataaggcgcttcagtatgtcggtgttattaaaattaacgtgaagaaaatgacggcgaaggctcattcagctaatgatgccgggtttgtttcatgaaaatcaacttgttgtgagtattaaagagatttatcatggtgttagcggttacagatacagtaagtgcttcaaggaggccttgttatgttctttattgatacatcacgtaatggaaaaccggtttatgatccaattgtgaatcagtcattagacaattatttagttaatgatttaaagttgcctggtcacggcttgatcgtgtatgtcaatcagccggcagtgattgtcggggtaaaccaaaatgcatatgctgaagttaatatgccctatttaaagaaaaaagggattaagctagtgcggcgaacatccggtggtggtgccgtttatcatgattacggcaacattatttttgagaatattgtgattaatgatgacactcattttggcgactttcattattttgcgcagccaatcattgatgccttacatgacatgggtgccacggatgcacaagtgcgtggtcgaaatgatatggtcattggcaagagtaaattttctggcatgacaatgttcaaggttggcaagtcatacgccgctggtgggacactaatgtttgatttggatatggatgttgcaaccaaggtgttgacaccagaaaaggacaagctggcatccaaaggtgttaaatcagttgaaagccgagtaacaaacgttaaaccatatctcaaacctgaatttcaaaagctggacattgagggctttaagaaacaactgttgttacggttatttaaagctgattcgcttgatgatattgaaacgtatcacttaaacgaccatgattggtcgattattgatgatcgacttaaaggcaagtacgatacggatgagtggaattatggcaaaaatccgggctttgattattatgtctctaaacattacgatattggaaccgttagttttaatttttcactaatcgataataaaatctccgacattaaaatttatggcgatttcattactggcggtgacatcacggttattgaaaaagctttaagaggtgcagagctcaaccgaaattcattagttcaaacgctgagcggaatcgatattaaaaataatttgggtgatatttcaccggaaacattagctgatttattgctcgagaaaacaatcattaataagtagcctttggcgattggatcatgtcgaagcatgatggcgtaattgctttcttcgtatctgattgctagttaagaggatccaaattaacaataaaatgaaaaaggtttatggagtgacttccgtaagcctttttctttgacttcgagtttaaaaaatttaatacttaatgatcaatgcaacgctacgactgcaaagcgaagtcaagatagttgaaggatgttaaagagacgtatatactgactatcgttaggtacctaaataattagttattgaattctaaaaacaggcatattcgcaaagggaggggactgcgatgcaacaaacacaggaggatcgtaaatcgaaaacaaccaacgctgatgaaacccaaagcaaagtgacgatgacggggatgttcaagttcgtgttcggaaccgtgctgaaacgaccttgggtgctagtcttaaatgtagttgttctgacagttttgtcgttaatggactttttactaccgcaatttaatcaatacatcattgatcatgtgatcccaaataaaagtgtttcccagttggtggtggttgttggtttattgcttctaacggttacgatttccggcgtttttacctatttatcgacttattggatggggattatgagtcaaggggcgattacaaatttgcgaaatcaattgtatcgctatctcattcgattagatacccacttctttgaatcaagtaaaacaggcgatctaatggttcgattaacttctgatattaataacctgcaaaacctgatttcgcccaatatgttgtcactaattggcagcttatttacttttgttggtgtcctgttctttgtttattttgtaaactgggaaatggcattggctgttagtttgacgtttccatttattttcctggtagttcgcatttttagaacccgaattcggaattcctaccgaaaagcgcgtcaatctcaggcactgatgaccaatcagctgcaaaatacactcacggagattcaattgattaagagctacacgactgaagatttggaaaccaaccgttttagtaagttagcgaacatgaacaaagataatattatcgaagcaactcgaaatcaagcgatcttttcaccgttaattaatttcattgagtatttgggaactgcgattgtgttgcttttaggaaccctatttgtttttaaaaagcagttaaccttaggagaattagttgcttacttaagctatgttgggattcttcagagcccaataagttcgttttcgagattgttaaaccagttccaacaatcactggtttcttatggacgaattatggacattatggcgttaaaaccacaaattgttgatacgccttccgcagtgaatttccctacaattaaagatggggttcagtttgatcacgttacgtttacttacgacgttgacagcccagaagcatctcaaaagccagcaattcgcgatgtgagtttccggattccgtttggagaacaaactgcgttagttggccattcgggagctggtaagtcaacactgacggaattgctggaccgattatatgatattgacagtggtaaaattacatttgacggcgtttcaattaaagatattaagttaagatcacttcgacaaaatattgcgattgtttcccaagacattttcattattgatgggacgattggcgataatattaaatacgggactcccggcgcaactcaggatcagttgtgggaagttgccaagttagccgacattgatatatttattaaaggattacccgatcaaatgaaaacccaggttggcgaacgggggattaagctttccggtggtcaaaaacagcgaattgcaatcgccagagctctcttgaaagatgctcaaatcgttgttctagatgaggcgacggcatcattagacaacgaatctgaaaagaccattcagcatgcattggaaaacttaatggaacaacggacatcgctggtaattgctcaccgactgtcgaccattcataatgctaaccaaattctggtagttgatgatggtaagatcgttgaacaggggactcataccagtttgatggcacaagatggctactataagcagttatatgaagcccaatttgaataaagtacaaaattagacagtcggttaaagctgtttatcgagtcgtgatgacaatttagccattaataaaaccgattatgagtaagttttattaatggcttttttgatatggggcaaggaaacacgttcttttaaggacgtgtttccttgccccccttcttggcgtccaacagatgcttatcctgattaattgtcaaacccccccctttctaaatttgtgcgtatggtgacactttggatatgatacaatggttggtatgaaaaatacaaacagattaacgtatggtagaacgtcggtgtacaatctgaattaccatctcatatggggaactaagtaccgcaatcaggttttagctggacacgttgaggaggttttcaaacgcttggttaacgaaatcgccgatcaatacggttttgaaatcgcccatctggaaatcggtaaggatgatcaggttcacctactagtcagcgcaccaccgaaattatcagtcacaaatattgtccgctggttaaagggcattactgcttttcagctattccgtcagtgtcctgagttacagactcatgattggcaacaaaaagatcgtcacttatggtcacctggttactatgttgaaagtatcggggctgtcaatgaaccggcagtggctaaatatattgacaatcaacgcaagcacgaaaaataacaaaaggaggtcttggatggccacggtggttaaaggggttaaacttcgcttatacccaaaccaaaaacaaaccggtcagttgtggcaactatttggcaacgatcgatttgtttggaaccaaatgttagcgatggctcagaaacgctatgagaataacccgaaaagtcagtttgctaacgaatacgatatgaattacctgcttaaaccgcttaagcaagagtacccattcctaaaagcgagtgatt

SEQ ID NO: 686 - DNA, 9840 bp, Unknown
  Metagenome-assembled genome
ggatctgcccgccttgctgatgctcagatgcaattgtccgcgtgaccgtttacgatcaacaacatcaaaaaatccagttgaatatctctggttcatttgttcttgatggcaatctgccatcactcgtcaggaagagtgtgctgaagagtggtgaaaagagaactcggcggatgtatactgaatagggcgatcattatcttgcgttcttcctgttaatatttgttcttcaatcaatgtggcactcatcggctcttgaccctggtatttatcaacttctgatcaaaaaaagactttacgctgtgctgcaggactagcatgtttcaaaatggccctcacttaagatgccgggatgttgataaattgagtttggagcaaactttcaacctatcagcggacagcttctcgggtggtggtggatcctggcaagtacgatgctgtgttatcgtgctgattgtttgaagtttgaatttcgaaaaaaaaatgatatttttccaccaaagtcgaagcaaatttgcctcggaacttttttcgtatctggttaatgattaatctcgtagtctcctcgtccaagccctctcgtggtgtcgttccaagcaaggcctctggcaaagtagcagcagtagcaatgttgtggtttgttatctgcagtagcaatcaaatgttgtgcaaaactgggccggtcttctcttttcagccaattaaatttgcccgggtgacaaacatgttctcagtgcgaagtcatggaccgaagtcgttgaccagccactctgcagattatatttattctggccattttcttccagcatggttgttactccgtgaattccttttggggggacttggcgtgattaacgctttcatcgattaagaccggcccaaggcatccttttggtcgtacgccgcttagtaagtcgccgaataggactttcagctgttgggcgggacatccccttcacatccattttgcatctggaaaaaaaaggcttgttggaataaaactttccaagttggcaaaacgacgttgtgggccggtcatcgcacaagccgttggggtatggtggtcgatatctgctgcttacacgtcttgcttcaaaaattttctggggttgctgtgtcatattcttttcaaacactatttcactttaagtgatggaaacttcatagcctaaatgcagttaccgtagtctgacatttgtctgtggaaatttatcgccgtcaaaacagttttgacttggctgcattgaacaagacttgaagttttcccacccatcctgccttttcaagtgcgcccttgattttctgcatgacatggacggggcatgacagcgcgtctaattgaaaattgctttactcatattgataacctccatctcatttaatgttgaatgataaatcatattcgccaactgtaattgatctggatcaaggttggcggtttttggtgataataattaatcgcatgcgttgaagatgacaacaggaatactggctcatggacaaacattccgctggcatgtaaataaagccgagaatcaagccaatcagcagggcgaccaaacgtcgcaatggcgatgaaaaaatgtttcctggtgttgatgaccgttttttgggaagctcatatgcatgaatcaattcatgagtcctgatgacatcagacgacatcagaggtttcaaccgccacgtcggtttgccactcccccatggcaatcccgatatcagcggtcaccaatgatggactgtcattgataccgtcgccgacaaaggcaaactttgtggcccttccgcgaaatggttaacgtgattcgacttttgttccggcaaaagttctttgcgttggacttcatcaataccaatgttgcttcagacaacgcattggcgggtctgcaggttagcaccggtcagcataacgtagttgcgccgagggacttgagtgtcgctagctttgcattaacgccttgacgaatcaatccgagataccaggaaggcttgaatttgcccgtcgagaaggcacgcataaccgttgaactgccttcgtcttggatgttttccaagtcgtgacgttgttcagaagtcaactgcaacattttcatcgcttcatcattctcaagtcccaattaaaacattcttaccgtgggcgggggtgtgggggtggcagtggccttaacgccacgggcctttgactgtgtcagcatcggcaactgaaacgtcgtcaaacggaaagtatgatgattcagctgagaattaaaactgcttgtggccaacggatgatccgactgttccaaaccgccagcagcaatttgcaagcaaatggtcttttgagtagttttggaactgagttaaccgccgttgttcttcaggtccagagtcctgtcttatcgaataccaacgtgtcaacatggcaaaggtgttatcacttcacgcccttgatcaagaaccgtttttcgcaaccattaccggattccagccacgttgaaaccgggggcgccgaaaccaatgcccatgggccatcccaagaccaccaaagaaacggttcgctaatcggtaaatctttggtaccaagcccacaatcaatgcaatgatcaaaactccggagtgtaataagtcgcaaatttgtcaataaacttttctgctggcgacttggtgtccttgagcatcctcaaccagttcaacaattttgccaaacgtggtgtcgtcgccaaccttggttcccgaactttaagtgttccgttgtctaagatggtgtgccagagaatacctgattgccagtgcccttagtgctatttttgatccaccagtaatactggcttcgttgatggtgaccggatccatccacatttccccgtcaaccggaatctgaccgccggctttgaccaaacgagtgacgtcgtcaacgtcgacaagtcacaaaatcttctcctcatgtttgccagcatcatctacaatcattgcggtagtcggtgccatttccgtcacaatctttaattgagtggcgggtttggccaacgttttgtcttccaaaaacgtcccaaataagaacaagaagtgcgattgctgattcattgtactcgccaatgatgaaagcgcaaatcacagcaatgctgaaacagtaattcgatgctgatcgttttaaaccggagtgtctgaaccgcccgaagaacgatcggcacactgagataattgaagcggcgataaataaaccgtgtagaatcatatcgcgtgtcaacaactttcccacgagacctacgccaattaatatgccgttatcaatgtatttgatttgtgtgttgattaatatatctttgaaatttcataatccccgtcgcatttcttaattgatgtctttagtatatggtggttcgaccgataagaattgacgtgaatcaagtttgaaattttgttggggtaattaatgcgaatattattggatgtaagctgatcctgagacaactttttaagagagggtataatgaataaatcgtctcttcaaaaggaaggatttttacatgccatgcatttacgccagttcaaaatgtcttagttgatggtggtattcaggcgttaattttcagctcgatgtagccagtaatttaaacgcaaccgtgcaggttgcgaagcgcaatagttcaatgagttgcatcgattcgaagtcatgccccaacgttgggtagtcgaacgatcttttagttggctagagaattgtcggcgactttggaaaaattgtgagcgtcaattaaccaccagtctgcaaatagtcgttttagcgtttttagcactattacttaagagattttagacagcttctaattgacctcatggttaaacatccagaattgatccgccggccacttttgtttaatgaccaacagctccaagttggctttagcgaagacgacatcagaagctttttacctcgtcaagtaagaagaaaacatctcaaagcgctgatgagtgccgaggcagactgagcggaatcaaagaatcgtttgagtaaaagtagggtgagaagtcaagactgggacataaggcattttgagctggctgtcaagtggaccagccgttgcagtttctatcaaaagatgggtgacaattataggcataactggccagaagttttacttctaatggcgcatttattacctcattgcccaattcccgacttgacaaaatcattcaataatctatcagttacccgcttcaacgacgctttcaaaaatagtccaactaacagcgccattattaacatgcagcctaagacgaagaaatcaaccgttaccgtgcctatattagggccaccgatggcttcccgaaagccactgacgctatatgagaacggaaaaatcggttgcatcagcctaaaaatcagtgggtttaactgaaccggatacatggcaccactaccagccaactgcacggcaaccatcataaccgccaacgcctttcccaagttgccaaacaccgaggccattgtgtagacgatcaccgaaaacgtcagtgacgtcaccacccccaccattaacatgagaaaaaggctttccacgtggacgtggagaataaataccgttgatagaataatgataatcgtttgaatcatggacagcgtgttaaagattaacattttgccaagatactcttctttaggctttaacttggcaaaccgatgatatttaggcagacttgtgtgaagaaccgccaccaacatcgcgcagcccacccaaatcgacagtgccatgtaggttggcgaaaacgctgagccaaacgtgctaaccggataaatattttcgtctttcacgttaaagggttccgccaaagcattgcccattaactttggattgttctgcaaaacgctgatgatgtcggcaatgttgttatccgaagttaactttaactgattgctggcagtcaaaataatatccttatattgcaacaaccggctttctaactgaccagtggtatctccgatcaattgattaccatggataacggtatccaatgatttttcattcaaattgcgaatttgattaagatcgcttaaaattcccgaagtctgattagtcgttgccagcaagttttgcttaatgccatcaaggtcactgcgtgcttgattgtgatagcggttcactgaatcggtcaacttggagctagttgaataagcgttattggcaagccgctgttgcaagccagtgattgttcgattccctgaattgagattattttttaatgtcgtgacttctttttgctgcccatctaaaagctgttgggtttccttaagttcattaatcaaactcgtaattgccccggtgtgatgtgcctgattagccgtctgcaaatatgaaatcaacggtgtcaattggccgcggattaacttaatttgtgtttcaagttgatcagccaatcggttgacctgaccatgacgattagccgcgtttagctggctcagttgcttggataaaaccgcgagttgtttggcatttccttgaacacttgttaagttgttgtcaacgcgattaaaggattggttgattgaacggttcatctccttaatcaactcatcattagtggttccaagaacgccggcaacgttcacattttgtgaagccgaaataactggttttaattccgaaaacaccattgccagcccatttgatgcttggctaatatccccgagcgagctggttgccaattccatgctgtcgcccaatgagataattaaatctttaaggtttaaaatttcagcttgcttactgccagctttttttccggcgatattcaaataagaaaagattgttgcgttaatttgatacacaaattgctttttaaccgtgctaaccagtgtcttggcagccgtttcggtaattttatcccctatcggacttgctttcgtgtttgcgatataattgatttgagccttttgtggattggcggatgtgatgctagccagcttggttgagaagtcacttggaattttaacttctgcatagtattgaccattccgcaaccgggttttggcagtcttttcgctaacaaatcgccaaccaatttggtgattgtgcttcatattcttaacaatttggtcgccaaagttcatttgcttgccctgtaaagttgaacccgtatcctgattcacaaccgccacaggaattcgactgacttcctgtgaattgtaggggttccaaagggctttgacgttaattaatgtatataggcagggcaacacacaaagcgcagtaattgtgagtaaagccgctttatatttgaagattgattttaagtcgcgttgataaataagcttgatgttcttaaccataatttatactccaaaattttgtaaatcggtttttttctcgatagaaatgcattatactgataataacgcgcccattaatcattaacaatagttaactaataatttttaaacagctgtgtaaccataactcccgtcagcagtgacttacacactaatgcttactgctttgcttcactcacttacttctaaggagatcttacaattgaaacgttcactaatcaacttattaatcacgaacctagtcgtcatttttggcattggcttatctcagtcaataaccgcggctgctaaagctaagcctgctaaagttacgagtatcaaaactttgaccaaagattcctaccgagcaactagcggttacctatacagttcagctaagttaaccaagaaagttcataacgcggataattatccactcaccactttttacacctatcgttctgccaacattacccgtgcaaatggcaacaaagccgtttattattatatcaagaacggtaacggcaaggtaaagggatggatttggcgcggtcatttagtaagaatgattaacgttagtaaacgacgccaacagatcaaccaaatcattgggctgatcgatacgttatcaattaataatcgtaaccaaattattacgatcctagaatcaatgacgaaaacaaatacgttggccgacttactcaaccaactcgatctcttcaagtcagccattccagacgacgctgatattgccaagctaaacgaaatctttcaaatgatcaagtcagacggccaagaacttaattacctatttagtcagggaatcaatcgactctatccaaaagtagtcgctatccataacctgaatgacaaagtgttcgcactggctcaaggattgcttcatcggctgaattaatgaggatcaattctttctatgagaacaatatttactttattcaaacgagatttaagtagcatttttcatagccggccggtgtggatcaccctgctggctttttgcctaattccagcaatttatgcgattccaaatatcaaggcctcctgggacccttattctaaggctaacaccagccgactgccgatcgccgttgttaatggcgatcagggaagccgcattaatggccgttcaatcgatgtcggcaaacaaattgtcactcagcttaagcaaagcaaagatattcattgggttattaccaatagctggcaaggaaataacggtttggatcagggcaaatactacgcattaatcgaaattcccaacgacttttccagcaaacttagcacattaacgaccactaatcctcaaaaaccaaatattatctataaatcaaacgaaaagctcaaccctgccgcgaccaaaataacgggtcaggcaaaagattcactaaccgaacaagtccgcgacaactttattaagattagcagtaaagccgctcttaaagaaatgaacacagctggcgaaacgctgaatactcataaaccccaaattctccaaattcgcacttcattattagacgcgattaaaacgattaagaaaacgcaaggctatttgggccaggttaacaacgattcaaaggatatgcagcagtatctctcaaccgttaagaatgatattcctaaaatttccaatcaaattactgacctccaaaaagtcattagtcacggcaaatcactcaccagtgcgaccaaaacaaccttagccgctactaaaagtgatttagcagacggattagccgacttgcaaaccgataatcaacaactgtctgctttagcctcagacttaagagccagcagtgcaaatccgtccagttcattaatcaagactgagatcgctcaatcccaaacagtgacaaacaccattctcgatcaccttaataacgccttgcgactagccgatatcattaataatatttttcctagcaaccgcaccacttctttagtccgctcaatcagccaggctaaaaaaaccgtccgccagcagcaacgcaacctcaacaatcttaaatcaaaagcggccgccggtagctcaaaacagacgcttagccgattagcggcaaaaattgcccggacaagcacgcaattgggcagaaatatcgatgccgcgaatacgtcgtttaacgacagcgtaagccaaggcttagataacctcaataacaccctaacaactggcatgactggtgatgatcaagtactccaatcccttcgaagcctcatcccccagttaaatgctctcgcggacgccggcacttccatcagcaagctctccatttctcgggttaagcaaatttacagtcgcctaaccgacattcaagccaaattaaacgatttaaatgatcaaacaaagttcattaacgaaaagaacctcgatcatctcattaatctattgacagagaatcctcaagtggctaacttattatcgtcgccaatcacgttaaagcaagccgacctttacaacatgggcaaatttggctatggtgtaacaccattttatacaaccctttccatttggattggcattttattactcaccaccatcatctcttggaaataccgatcaaagaagaacgaacggtttccaagagctaacctcattgaaaagtacgtaggtaaactgctgctttacttgtcaatttcactcacccaaacaacttttaccatgctgggagaattattcattctgggcattcggccagttagcgtttgggcaatgctggccaccgcttatacggccacgattgtctttacaattatgatgtataccttggtgtatatgtttggcaacgttggtaaagttattagtgtcttactcatgattattcaactatttggtaccggtggcatttatccactagaaacaattccaccatacttggcagctttagcaccgtacctaccgtttacctacgccattcaaggattccgtgaagcaattaccggtccaattccaagtgttttttggcactcattattggttttaagtggttttgcgattgcgttcttgttgattgcaccactgcgacgcgtttttcaaaagcccattgccgaattggagaacgggtttcatcaatcaaaattataagtggttaatgaagcttaactggtatcaaaatttaatccgctgttgatttttaaccaccatctcctgtgccggatggtggcttttttaagtttcgctgaaggttcatttaaggatgttagcgttttttataaactcttttcacatcatccccaaatcggttcaatttaagtttgacttaagctgcattgaatattctactgtcattctaaaacgaaggggagatgccaatgatctaattaaccgacaattgaataaaaaacaatccggattgaatcacttacatgaacaacttacatgaacaattcaaactttaacctaccaaactaactaattagaagctgtccaagatctatgatttttgatatacttctatgtaaaaagcgagtttaagctatgaaaaattatcccagcaatattactcggcaacaatttgaattaattcgaccagctttagaaa

SEQ ID NO: 687 - DNA, 4870 bp, Unknown
  Metagenome-assembled genome
cacaacccatggcgtggcttgtcaagggcatttgacgttcccgacgttgtgtaaaccgccaaccaaactgaaaccaaaagagaaaccattgtcgaagctaagttttcatagaactttggacgttaccaccaagtccacgaaacaattgaatcgcgtggcggccaattcgacccgtgccaataattcccactgtctgctcactaatcagtcgacccataaaatctggtgaaaaatggaattcatgcctttcttgaagctgctgttgcatataacctacttttcgtgaaagatacagtgccatcatcaccgcaaattcagcaatactttcaggactatatgccggcacattagtaatttgaacaccgttagccttggctgcctgcaaatcaacattatcaaccccaacgtttcgtaacgacagatatttaatgcctaactcgtgaaagcgttcaaataattcttgggaataagggatcgtttgtaagcaggaaatgccatcaaaaccgtcagcatcattaatcgtctcagctgttaacgttgtggtagttgatgtcacctcaatatgatggtcttttccccacttttcaacaaacggaatttcatcatctcgaacattaaatgcaatgaatttcataatttcctcctaaaataactaaatataaccgcttaactttccacactatacaccaaaaaagacatccccgacaaattttgcaaggatgtcttttttactgaaattatcgatgactaatctttatttaacactagtaataaatttatcaaaggctgtctgaccagcagaattccacttgtagacaccagcgtcctcaagcaccctggcaaaaaccaaaccaacttctttgtcaacaaccttttcaacgttatcttttgtaaaattatctcgttgttttagttcatcggcccatggcttatggtagtccgcaatctgattatcttcaccaagaacgtatttttcgacttctttcatttcagtctttaaacgagctggcaaaatggcccgtcccataacttcgattaaaccaatgttttccttcttaatgtgttgaacatccttatggggatgaaaaataccatcaggatactgctcagacgtttggttatcacgcaacacaacatctaagacaaactcatcatctttcatataggcaatcggggttaccgtatggtgacgggtaccatccgtataagcacggatatccactgattcatcagaatagtctttccatgtatcagcaatttttgtagctgcagtaatcaccttgttagcatcagaactttgcaaacggatggttgccattggccacttcacaatcccggcttttaacccatcaattcctaagtcaacagatcgatcaattgccgccttcatcattggaaaactgtgtcggccaccttgataatgatcttgagccagcaatgagccaccaacgattggtaagtctgcattactgccaacaaagtaatgcggaaattgcttgataatatcagttaaattaacaaatgtctgttgactaattgacattgggacatgtttttgatttagaaaaatcgcgtgctcactgaaatacgcgtacggtgaatattgaaatccccacggttgaccaccaatcatcattctgatgactctgtgattactacgtgccggataacctaatcggccaagataaccttcattttcaattgcgagtggcccgacgggataactagttgactttttccgtccagccgctgcaattgctttgggatccttttctggtttggaaaggttaattgtaatttccaaatcgccataattagtctttgtcgtatacgaaatattcttagcaattgcccgagtcttaatgtaatcattagcttggcttaaatgataaaagtagtttgtcgcagtatcaggtgattgttgatatttcgtccaaaaaacatcgttaacctttgatggaattggcgttaataagtccatcaattgatcttcaagaatctcacgattagtgattgaattttcaatcttaccgtgcttaatcgctaattcaaccaattcattagctaaatcaacagctgttgtttgcgttgtcggatcaccgaaaccatcgccaatcagtcgaaaaacaagattggtcacgtaaatccggtcaacatttgtgtatggtgaatctgattgaataattagttcaacaaatttttcaactgcggattgactcatcttacttgtttcctttccgatcgtcgtaaccctttggatgggtttctttccagttccaagcggtcttaataatttcatgaacatcatcaaactgcggatcccaacccaaaacttttcgggctttatcactggctgcaattagagtacttggatcacctgcacgtcgtggccccattttagcgggaattggcttgcctgtgacatcacgcgcagcctcaagcatttctttgtttgagaaaccagttgacgacccaagattaaaggcgtcactatcatggccagcttgaagatacttcagagcaagaatatgagcatctgctaaatcaacgacatgcacataatcacgcacattagtcccatccttggtatcatagtcgtcaccgaaaatcgttaattgatcacgttcgccagctgcaacttgtaaaataatgggtaccagatgagtctctggatggtgatcttcaccaatcgaaccatccggcttcgcaccagcaacgttaaagtaacgcaaagcgacaaatttaataccatacgcaacgtcactccaatgcatgattttttccatcgccagtttgctttcaccatatggattagttggcacttgcggatcagtttccttaattggaatttgtttaggctcaccataggttgcggcagttgatgagaagacaatcttcttaacattgtgatcatgcatgacttcgaggagactgatcataccgtaagtgttgttatcaaaatattttaacggtttttccattgactctggtacaactgaaaatgccgcaaagtgaatgacaccttcaatgtcttctttatcaaaaaccccactcaggaaggttttatcacgaacatcgccttcgtaaaaccgggctttcttattaacggcagctcgatgaccagttaccaaattatcaacaaccgcaacgtcatagcctttttctactaaccgatcaaccgtatgtgaaccaatataaccggcaccacctaatactaaaattgccatcctaatatcatcctctctttcttaaaactacttaatctctttgggtccatcggaaatctcagcaatatagaattcagccggatgaccaatttctttctcataaactttgccaacgttctctttaaaagcatcgacctgatcacggtcaacaatcgcaattgcacaaccaccaaagccggcaccagtcattcgagcaccaatcacaccgggttgcttccaagccgtctcggccaatgtatccagctccttaccggtgacttcaaaatcatagtggagtgaaatatgtgatgcattaatcaacttgccaaattcttcaagattgttattcaccaaagcatccttagctttcagtgtccgctgattttcaaaaaccgcgtgacgcgcgcgacgaatcagcacatcatcgttaatcagatagctattctcatcaaattcagtttcggttaaatcacccaacgtcttaattggtaatttaacttgcaatcgtttcagtgcttcctcacattgggcccgtcgttcattatacttcgaatcttgaagctcccgatgtttcttagtgttcataatcacaactacccgatcacccatttcaacgggtacatattcatatttcaacgtgttcgtatcaagcaaaacagcttggttggctttacccattccaatagcaaactggtccatgattcccgagttaacaccaatgtagttgttttcaactaattggccgtacttaacaagatccaattcatcaatgttgaactcaaaaacgtcgttaacaatttcggcagttagcagttcaattgcggccgatgaggaaagaccagcagcatcaggtaaattcccgtcaactgctaaatcaaagccatgatccaattgatgaccatggtcaataatctgggccatcattcccttgggatagttggcccatccatgagccttatcatacttcaaatcatccagtgagaattcaacaattccctgatcagggacgttagctgaatacattcgaactttattatcgtcacgctttccgtatgcagcgtaaattcccatgctaattgcacatggaaagacatggccgccattaaaatcagtgtattcaccaatcaaattaattcgtcctggtgagaagaaaacccgagttgaatcgtaaccgaacttatctgtaaattccttttgtacgtcttgagaaatcataagtttcacccctatatatttttagtaaactttactcaaataaaagataaaacattttgagagcgttgtcaaccattattgagaataattggtttaattgttcagtggctattcccatatagaatgcaatgtaacagctttttgaaaaccctttttcacaaataaatgaaagcggtttatttttcagcggtatcttccttatatcccatagtaaaacaaagtaaatttttgacatcaatgttacatgtattcaataaaaattattgctggataaaaagcttacagcaaaattggaaaaggcaggaatcccatttcaagatttaaagggtctaaaatttttggggttgataccgtaaggtatcaatctttttttgcatataaatagggcatcgccctactattgaattagccaataattcagatagaaagaagtaaaaacgatgtcccaa

SEQ ID NO: 688 - DNA, 47766 bp, Unknown
  Metagenome-assembled genome
agcgaggacggaagtcgtagccgatggacagcaggtttaagattcctgcactactgatagacaatgtggggagtaggagcagccgggggccggaatggaaagccggttggcaagcgcaggaggcgtggaggcaaatcctccatgcaagccgagccgtgatgcggacgaactattaaagtagggaagccggtgagccatgcgagaaagccgactatagtcatatgatacccgctacgtaaaaaccggacacaggtgggtcaggtagtcgaggagagaatcctaaggtgagcgagtgaactctcgttaaggaaactcggcaaaatgaccccgtaactcgggagaaggggtgctgcacgtcgtgccagccgcagtgaataggcccaggcgactgtttatcaaaaacacaggtttctgcaaaatcgtaagatgacgtataggggctgacgctgccggtgctggaggttaaaggatgggttagcttcggcgaagctcagaattgaagccccagaaacggcggccgtaacaacggtcctaaggtagcgaaagccttgtcgggtaagttccgacccgccacgaaagcgtaacgatctgggcactgtctcaacgagagactcggtgaaattgctatacctgtgaagaagcaggttacccgcgacaggacggaaagaccccatggagcttctacttagcttgatattgagggtttgtaccgcttgtacagaataggtggagccgtagagcgggcgctagtttcggtggaggcatagtggggatactaccctcgctgttggacactctaaccgcagccactatcgtggtgggagacagtgtcaggtggggtttgactggggcggtcgcctccaaaaagtaacggaggcgcccaaaggttcctcagaatggttggaaatcattcgagagtgtaaaggcacagggagcttgactgcgagacagacagtcgagcagggacgaaagtcgggcttagtgatccggtggtaccgtatggaaggtcagtgtgacaacggaaaaagctaccctggggataacagtctatctcccccaagagtccactcgacggggaggtttggcacctcgatgtcggctcatcgcatcctggggctgtagtcggtcccaagggttgggctgttcgcccattaaagcggtaccgagctgggttcagaacgtcgtgagacagttcggtccctatcccgcgcggcgcaggaaatttgagaggagctgtcctagtacgagaggaccggaggacataccgctggtgtaccagtgttccgccagggcattggtagatagtatggatgagataaacgctgaaagcatctagtgtgaaactcgcctcgagagagatttcccatcttcttggaagagtaagaccctcatgatgatgaggtagataggttggaagtgggaagtgcagtgatgtacggagcggaccaatactaatcggtcgaggacttaaccaagtagaaatggtgtttcaaggatatagaaaattaatactagctagttttgagagaacgaagttctttcagtaacacaaagtgtggtggcgatagccagaaggatacacctgttcccatgccgaacacagaagttaagcttctgcacgccaagagtagttgggggatcgccccctgcgagggtaggacgttgccacgctaaaatagaaagtcttcgatagtgcaaataactaccgaaggcttttttagtatcaatattggtgtagatatctttaaatgaaaaaaatgagctaccgataggaaccaaaacctacatgtttccggaaatggatactaacggttaaacccagtatgtctaggatctttttatcagtatagtaattaattaatttaaaaaagaggattaggtgttattaatattggaaaatgattgctacactctctaactttaatttctatttcccatattgcgtggaaataaatgaagtgggataattaaaatgccgttttagctcagaaggtagagcatttccatggtaaggaaaaggtcccgggttcaaatcccggaaacggcttaaaaataaaaaatcgtaaaggtgttgtcttggaatactgctatttgatataatttaggtgaacatgtgttccctaaaaatttaattaaaggagcttccaaatgacatctaaaatgcgtactaaattacgtgaaaagggaagtaagaatcgttgctacttttcaggtgaatttaagaaatatggctttaagtattcagatcgaaacaaaagtcacgcactcccaacgattttgctaatgaatataaaagacgaacaacatcaattactaacagaccatctctggtttaatgtaacaaaaggatttagatcgttgggaattttacagcttggcgatcaggttagttttaatggtcgagttaagccttataagaagggctatcaaggtcgtcgaaaagggattcaacgtgaaattcaaattgattacaagattgatcggccgacacaagtgaagctgatagtatccgtacataattttgagcgagatcaatttttatccgaaaattggaaaatgtgcaatcaaatatatgaaatgtataagagtgattatcaacttcgagggattccattgccataccctgaatactgaattaaagatatgtgattgggggttgcaaatatgaaaaaaagaaattttgttcaatctttttaaagttgtgatgcaattactacatatctgaatcgaaatctcagcattaattgtaaaaaacatttaattgagaaggagtatggactaagtaacttgtccaaaaagtgtgttgatagccaaaagcctgtcagaaattcgggggaaaagcttgttggcattaggcatatcccaaaacgttctctgattttcttgaagtgatctgttatacttatttttatataatcttatgaaaatatgattaatacttgaggcagtaggagaacgagatgaaaagtaatcacattggctgggtttttgtagagttgtttagtttgattgttgggttggtgcttggcgttcaatctcagtcggttaatgcgcgtgcggcaacgcctgtggagattttaaatcagcaaatcgttgattatcacactaaaattggtcccaatttaaaacacaattgtgggatatattcctcagggggctatggaacatcgccggataattttgaaccaattgcgtatggacggaaatttcacgagcaagacgttcatattacccgtgaagagcaaactaaccaaggtacttggctaaagtttactcatcacacgtttaccggttggattcatcaaaatgggacagtaaagagcaactaccgattaactgcgccattgatcgcacaacggccggaattaccaactggctgtgaaataacggccgttactatgatgctgcagtttgccggccaacaagtgaccaaattacaactggctaaagagatgccacgaagccataatcctaacaaaggatttgtcggcagtccttattcaaggaatggctggtatatttatccggctggtttaaccaaactggtggctaaacacgttggtacttcagttaatatgacgggaaaatcgctttcagcagttaaaatgcaaatccatcaaaatcatttggccgttgtgtggttggcaaactttgatgggtttgctaatcatgccgttaccgtgaccggctattccaagtcacgtatttattataatgatccgtggacagttagaagatcaagtttatcgaatcatacatttcaaaagcattggcgtttagatgcctatcgagcgttgagttattaattgggggttaacaaaattgattaaacaaataaaagtttggggattaagcttggcagtggtggccgtgtttctgggaggtcacatggttgctcatgcgaatactcaaaacactaccagcattttagagactgaagataataaattatggaatgggcaatcaactgtcccttctgtaagcagcaatcaccttgataaggcgaatagaaaagtaaaagcatatcaaaatcctaaacgctactatcaggttcaatcgcagcaaattaaaccatttgggcacgttggttataccgtcaaaaggcattttgaaggaattaagacctggcttattatgcgcaaaatggggacttatactgggtacaacaattataaccaagcaacctttaatgctgtcaaacgatttcaacgacgccacgggttaaaggtgactggcaatgtgaatgaaaagacctggttgagaatgggatttacaaaacagtcatggacggcaattgatagttatgttgcaccactgagagccagtatttggcaaggtcgtcaagcacacattcaggcaatgattaaacaggcttatcgttatcttggtaatccgtacttagttggttcatcaagtagtcccaaatatggcactgattgttctgggctggtaatacaggcactttatgcaggtggaattaatcccgcaccgatcagtgcaattcatcatgcttatccaggtaatgagtggaacagccgcaatctttgggcaagtgagaagttcaagcacgttgcctatcatcaccggcaacgaggtgacctcgtgttttattatcaacctgggactcatatgatttggcatgtggcaatctaccttggaaaaaataaagtgattgaaagttggccaccaagaattatgatccagccaatcaagaatggccaacgatctgatgttgctggtattgcgcggccatttaattaagcataagagataaaattttaccgtttgtgtttcagctttttacttaatctggagcctgacagcagaataaggatcgattggttcgcaaaaagcttatttatcatgataatcttagaaaaattgattgccaaacaatgaacaatattgctttttgatggcactaaaaaagctttcgaataatcttaatttgagattatccggaagctttttaattatcgttccaaattagactggattgatttataaattaatggttatttcttgtaaactgattgtggtacaccatacctggatttgccccagacacgttgtaaccaaggaacaaaccaatagtctaatccaaatgagcgacctgaaccattcattaaagccaatgcgacaaagattacccaaacagttgaccaagtcagcatggcactaaagaagagtacgatgattgctaaattagccaaccatgttaagaagcccaagaagatgagtacaccaatgattaactcacagattgccaattctgggtaaccgacgacaagaaaaccaccggaaccattcatattggctagaccatccaagaagaacgccagtccaaagaatagtcgaagtgggacactccataaaacgttgcttcgacgtgctgtatgaccaccaaagacggttcgatcattatcgacacggaaaaattcatctaaaatatattgaaacataaaataaccggagcgaatacgcatgaagtagaggatgttggtaaaatgcttcataattgtggcaatccaaccacgaatacgtttgccgccaaagacttgggcaatgccgtagtaagcaccgaatgaaacagtaaatcccttattatcatctttaaattcggtgtaattctgattgccgttgatgtcggctgccatattgtccgaaacaaccttggcttcattctcagcttcctgtgctgtttgaggaacggctcgttcggctccttgttcagttgcgttggcatcatcaccggcaacgtaaatacttttatcttcgaacccctttgcctgcaaatactggttggtgattaatcggccaccacggccagcatcgatgccaaaatcatcagcaatgtgattcgttttgacacccgcggtccaaattaaagtatgagttgagattgaatcctgatccttgatatcaacactatctgcgttgactttagtgatcattgaagatggcctgatatcgatattattttttttgaaataggcttcagcgtgggcagcatttgtccgatccaacatcttgataatagcaggtgcagcttcaaccagaacaatcttaatttcattagggtcaagtttattttcacgagctaaaacttttcgataatcaattaattccccaacggtttcggcacctgtaaatccagacccacaaacaaccagcgtcaacagggattgacgttttgttggatcacgttcaatcgcaccttgccggataatttcactgatatgagcgcgtagccgcagcgcatcttccatcgaccaaagtgtaaatccattttctttgacgccgggagtcccaaaatcgtttggttctccacctaagctaattaataggctatcaaatggataagtgccatgttcggcaataacttccttcctatccttgtccacttgggtaacagtatctgttaccagttggacatttttttgtttgtgaaagatccgttgcaaatcatactgaatactgtctgggtcaactcgttttgtggccacttcatgtagtcgtgtcatataagtaaaataagaatgacgatcaattaaagtaatttttacgtcagaattacttttgaactgtttagcaagtcgctttgtcgcgtaaacaccagcaaagccagcaccaatgacaacgatattctttgacataacaattcccccctcaattaatagcgtaataagattagtaaataaatatacaaaatgacgaatgattgcattaataaatcttatcaactatattataaaagtcctgtcgtggattgtctaatgatagccattacaatcttttaagaaaggccagactgggcttgagatgacaaatttgttgccgcttccagatatttcggttggctattggatccagaacgggattcttataagcaaacaatgatatttgaatgacattttcatttgaatattcgctcacatgtcgatacaatagacatatatgaggagaactcataatgtattagttaaggggggatacaacaatgttcaatattggcttatcagttttaggcttgtcgcggtttcaatttgcgatgaccactgtgtttcacttcttctttgttccgttttcaattggattagcatttattgtagcgattatggaaacggtctacgttattaagaaggatgatacctataaaaacatggcaaaattttgggggaagattttcctatatagttttgcagttggtgttgttactggtattatccaagaattccaatttggaatgaattggtcggaatattctcgatttatgggggacatttttggtgcaccacttgcaattgaggcgctggccgcattcttcatggaatcaacttttatcggtctttggatgtttacatgggatcgattcaacaaggtgattcactgtttgtttatctggttaactgcttttggttcaacattgtcagcagtttggattttggctgcaaatagttttatgcaaaacccagttgggtacgcaattaacgcaagtacccatcgtgttcaaatgactagcttttcagcagttgttagtaaccgtcaattgtggaatgaatttccacatgttatctttggtgcctttctaacggcatcatttgttgttgcaggtgcttcggcatggcgattacttaagaaagaccatgaacatttctaccgtaagtcattgaaagttggcttgatcattggattgtgcgcatgcttgggttctgtttggtcaggtgatacacaaactcgttacctaattaacagtcaaccaatgaaattctcagcaatggaaggattgtacaagaattcaaccaataaaggtgaatgggctcctgctgcggggtttgacactaagaatcataaaacgacttggtcaattgatattccttatgttctgaatattttaagttatcataaattaagtggaacaattaagggtcaaaatcaagttaacaaagagttaaaagccaaatatgacaatacacgtcaaggccgaaatattaagaactattatgtaccaaccaagacgttgttctggagcttccgtcttatggcagtttcagcagggttgtttggcttgattgcaatcatcggtctttggtttaaccgtaagaagtcgcaagcaattatgagacagcgttggttcttatatgttatggggatctgtctctggttaccattcattgtgaatactgctggttggtttatcacagagtttggtcgttatccatgggttgtctacgggttgttaacgatcgctgatgcggtatcgccaacatcaacggttgtcggactattatttaccaatatcgtttacttcttgatctttgcaggattaggactagtgatgattctcttgagtcatcgagttctcaaagcaggtccagattctgtaacgactgatggttattcaaccaagcctgacgagacttctaagaaagtagatccatatgaaatgggggcggctcataatgagtaatctgcaatttctctggtttctgttgattggtgtgctattcagcgggttcttcttccttgaaggatttgactttggcattggaatggcagttcgcttcttcgcaaagaatcgtgacgaacgggataccattattcaaacgattggacctcattgggatggtaacgaagtatggctgattaccgctggtggtgccatgtttgcttcattcccaatgtggtatgcttccttattctccggatattatattgtcttattcctaatcttggttgccttgattttccgaggtgtttcgtttgaatttcgggcaaatatgcaaacggaccaatggcgtaatttctgggaatgggctgcaacaattggtagtttttgtgccgcattcttatttgggatgatgttcaccagtatgattcaaggtgttccaatggattctcaaggaaatatttttggtacttttaccacatacgttaactggttctcattagttggtggggttgcggtttcactactgtgcttcatccacggactcaattttattcgattaaagaccagcggcgaattgcgtgaccgggctcaaaaatggagcaaggttctttaccccgttttattagcaggtgaggttgtttttgtcattttgctcatgatgtatactgacttcttcagtcgtaaaccaatctctacttggtcgatcttagttgctttggttatctttacgttagctgcatggtggggtgcccaggctcggcatgattgggtatcgtttatttcaagcggcttatcgctgattagtgttgttgtgttaatctttaacggcctatttccacgagtcatgattgccacgacaaatgcaaaatcaattttgattaaggatgcttcaagctcaccctatacgctacacttgatgacaattttgacgttttcaattttgccgattgtgttaatttacttcgtttggagttactgggtattttataagcgtttgaaatcaccagcagctgccaaagagtaagttgatattaggtcttattagaagaataaatggattttataaagaaacgaaattaggaacaaactattccggtttcgtttcttttttatattggttatgaaacatgtcatgccaacgacactaggtgattatggttaattgtcgtcttttttcaatgaccggtatgtgatttcgttcttttttgaagatggcctatttcattgtgtgcaagttttctctatactaaacattgtaagtatttttgaatattggggagtgaagattttgattgacaaaagattgttcgctttaccggggatgcgacgatacgtcatcattttgggggtacttgtcttttttcaggcagttgcgattatcgttcaggctcgttatttatcaattgcgattgttggtttatggaatttacaatcatttaaggcgattgttggtccaactatcatttttatgattgcttttctatgccgccatttgctcacggtttggcaaaatcgggttttctttccgtacgttgaaaaaacaagtggtcaaattcgcgaaaaattgatggcaaaaatattccgattggggccggcggagattgaaaaacgcggaaccggtaacatcgtgaccatggcacttgaaggtattgataaagtccaaacttatttaatgttggttattatcaaagtgttggatatgtcgattacaccatggctggtgttgctttacattttgttccttcggtgggaacaggctatctttttatttattatttttcccgtcattattttattcatgatcattctggggtatgcggcgcaggctaaggcggatcgtcaatatgaaggctatcagcgcttgtccaaccacttcgtcgatacattacgggggctctcgaccctcaagcaattaggactttctaagcgttacgcagacaatgtttacgaagttagcgagtcttaccgaaaagaaacaatgtcaacactgaagattgcgttgacatccacctttgcacttgatttcttcacaacgttgtctattgctgtcgttgccgttttccttgggtttgatttgttggacggcaaagtaactttattgccagcgctcacaatcttggtgttagcaccagaatatttcatgccaattcggaattttgccaacgactatcatgccacgttaaacgggaaaaatgcattaacggcagttttggatgttttaaatgagccggaaatgaagcaacgtgatgaactgccatcatttaagtgggataaccaatctcaattggtgcttagtcacgtttcgttgacctaccctgagagcaagcaaccggctttaaaaaatatttccattaacattcaggggatgaaaaagattgggatcattggtgcatctggatctggtaaatcaactttagttaatctgattggtggttttttggcacctgatcaacccgatcaagttgcgattaatgggcaaaaactgccccatttgaatcaggaagcttggcagcaaaactttttgtatattccacaaaatccatatttatttcatgcaacattggcgcaaaacattgccttttacgtggatcatgcaacatctgaatcgattcgaaatgcggctgagcgggcaggccttactaagtggatcaagtcgttgccggccggattggaaaccatgattggtgaaggagctcgaagtgttagtgggggtcaagcccaacgaattgcactggcgcgggcatttttagataccgatcgaaaaattctcttgtttgacgaaccaactgcccatttggatattgagactgaggcagcgttaaaaaaagatattttacccgtatttgacaatcatttggttttctttgcgacccatcggcttcattggattggtgaaatggactatgtattggttatggatcacggtcggttggttgaacaggggacgcctcaggaactggcaaatcaaaatggcgattatgttaaattacgttcagaaatggaggcgtcagacttatgaaaggattacgacaaacattcgcacatgacacttgggtaatgccgtatttacgaaaatataagggattgctcatcttagtcttatttcttggatttatgacgttcttttccggtggcgcactcatgtttaattctggctatttaatcagtgaagctgcccggcgaccttcaagtattatttatatctatgttccagttgtgctggcgcgggcatttgggattgcccggccgtcgtttagatatgttgaacggcttaccagtcataattgggttttaaaaattgtttctgattttcgaaagaaattatatcagtctgttgagaaaaaagcttcagccattcagagatcgcatcagactggtgatattctgagcattttggccgatgatatcgaacatattgagaatctgtatttacggacggtctttccgatggtgattggttggctcctttatgtgttcattgtgatcgccattggtgcaatgaattgggttgttggtatcttattactgctgttgcttggtgtgattattattttaatgccattaatgtcggttacgactaatggggttcgtgaatatcgtcagcatcaaatccaacatactttctacacgaatttaactgatgaagtactaggattgggtgattggttgatatccggccgatatgacgattttatggctttacagaagaagccaattgaacaaattgccaagttacgtcgacatgatcattactatcaatggtggcgttctttctttgttcaagtaatggtgttgttaagtgtcctggtgttgttggtatggtcagcatattcgtttacagcaaccaagtctttggctaactgggtggctgcgtttgctttggcgatctttccggctgtttcacctttcttaaatattagtcagggtgccagtgagtggccggtttatcgtcgttcaatcgagcgggttaatcagttggatgctggtggggatggccatcctgttaaacaaacaagcttgtcagaaccatttaaagaactttccattaaacaactgagttttcagtaccctgatggtgatcgtaaagtggtcgatcatatttccatgacgatccatccaggagaaaaggtggcattattaggacctagtggaactggtaaaagtacgttattaaagttgatggttggtgacttaactccagaagatgggagtgttgagatcaatggtcaaaacattcttagcttacaggatgttcgatcatcattgtttggaattttagatcaacaaccttacttatttgatacaaccgttatgaataatgttcgattgggaaataccaatgcttctgatgatgcagtcaaagacgcaattgcagccgttggtttaaaagatctaattgagtcgttaccggctcagtacaacactgaggtgcaagaggctggtcaacggttttcaggcggtgaaaggcagcgtttgtcattagcaagaatccttttgcaggatgcgccaattattattttggatgaaccgacagtcagtttggatccaataacggagaaaaagttattggataaggtttttgaattattacatgataaaacgattatttgggtaacccatcatttagcaggaattgcccatgtggaccaggtccgcttcttggaacacggcaattttgatatgcagggaacgccgcaggaattgtacaaacaagaagcaagatttagacagttgtatgatttggatcggggaaagtaaccagagtgcaaagtcaagcagcatcggtgattatggttaagtaatcaagagatgcgtcatatatagccgggagttgcttagctttgcacgtttcggccaagcagcatcggtgattatggttaagtaatcaagagatgcgtcatatatggccgggagctgcttggctttgcatgtttaggctcggttgacttgagcgccggattctgattaaggggttatattctgggagcttaggtttgcacgtttagagatgaatcacagttaagaaattgaagggttgtgctgcatgtttaagccagatatcatcgatgttaacggggtaagaaactgatgagatcggtgattccaacttaaaaggcaggaaaatgaaggccaagtccagtcagagtgagacacagggcggttaacttccagagtacaattggattatcccaatattccgggtggtatcgggtggtatagtgggataattcggttgtaggtcagggagttgccttttgtctcacgtttttgcttggtaatagccgtgactacaaaaatggggctggacaaaattacttttgtccagctccatttttagaaccgatcttaattgatagattctgtgatcaaaaaacgggaacggcgaaacatacgcttgcaccggcctcgttaccggttaattctgtcctcccaaggcacttttatgatacacctaatttaaatttgaattaacctttttaaaagtcttttccaaatgatcgtctgtaattaaaataagtcgcacaggtgattactgatttctcgtcagcaataaacgggttaattttgttaaatcctgttttgcgggttggtctggcaattgcgtaatgaggtctagtgcttcattagttagtctatcggcaatttgatgtgcgcgttttaggccgccagactcaactacaattcgttgaatttcagaaatatcctgatcagataaatgttgttttttatctagaaatggtttgagctgattatgggcgctttgttgtgccaagattaatggtaatgtatagacaccagatttgagatcctccaaaactggtttttttgtatttttagtcgatccactgtaatccagaatatcatcgagaatctggtaagctcgaccgatcgtaagtccaatccggccgcccagtgcgacaatttccgctggcgcactggttaggatggcactttgctcaaagcagaggcgaaaaagttcagcggttttacccgtaatttcatgaaagtaatcgtcttgagtcatttcttgatggtaattaaaagtcatttgatctaactcaccatttaaaataaattgcattgcattaacgtgacgatgcatttcctgtggatctgatgtcgatttaaggacttgggcaaagtaacatgtaaacagatagtcgccagcgtaaattgcgtttttctgcccatattgcgtgtgaatcgttgtaacgccccgacgaagggctgattcatcaatgacatcatcgtggattagggttgcaacatgcagtaattcaactgccgcagctccagctcgcaatttagcagcattggttttctctccgaattctgaaaatatgtaaaagaaacctggccgtaagaatttccccccggatttaagtagttcggtaattttatggtggattggtcgattagacagatttacggcttggagcaagtatggctcaagccgaattaatttaaattgtatgcgtggaaattgacgccaaagttgatgaaccatgagatacctcaatctttaagaaaattttaactacatcatctaagatacaaattcccgagacagatgtcaattgaacgagatggatttatcagctaagactggtaaaataagtgggtaaatagaaatttgggtggtgagaatgttggttggctttgtcgatacgttacttaatcgaaaggaatcgttgcttcaagcgcttgggcagcacttggagatctcgttttgggcattgctgatttctgtgctgattgcggttccactggcaatttgggtccggaaatataagaaaattgctgcttttttcctacagataaccggaattttacaaacgattccttctttagcacttttggggttgctgattccttttgttgggatcggtaaagttccggcagtgattgccttggttgtttacgcattactaccaatatttcaaaatacatatgttggcctaacagaaattgatccatctgtggaagaagctgctgatgcgatggggatgtcggttcctagaaaattatttcgggttgaattaccaatcgccatgccggtaattatttctggaattcgaacctcaatggtcatgattattggtacggcaacattagccgcactaattggggccggtggtttgggaagctttattttgcttggaattgatcgaaataatactgatttgattctcattggggcaatttcagctgctttgttggcaattataacgtcgtttctgattgatttcctgcaaaagatgaccggtaagcatgctcttgttttgttgagctgcctggcaattctggttggtggtaccagtggctaccacgcaattactcagttgaatgagaaggttgtgatcgctggtaaattgggtgcggaaccggaaatcttgattaacatgtatcgagatttgattcatgtacaggatccgagaatgagcgttgagcttcagcctaattttggtaaaaccagctttttgtttaatgcgcttaaaagcaatcaaattaacatttatccggaatttaccgggactgttttagaaactttaacgcactcaaaaacaacgcccagcaacccttggcagatttatcagctggctaagcagcagttagcgactgacaatcaaatgacctatttgaaaccaatgaaatataataacacgtatggaattgccgttcggactcagtttgcaaaacgatatcatttgaagacaattggtgatctgcaatcgattcaagggaagttaaaagccgggatgagtttggaatttatggaccgaccggatggcttgaaagccattaaacgacaatatcatgtgaactttccggtcaagggaatggaacctgagcttcgctatcgagccattcatgagggaaaagtcaatgtgattgactgctattcgacggatagtgagctgcgtcaatatcatttaacggtattgaaggatgataaacgtgtatttccaacttatcagggcgcgcctttaatgaaaacgagctttgccaagcgccatcctggggtcgttcatgctttgaaccgcttagctgatcacattacagagaagcagattcagcaaatgaactatgaagtaaatatcaagaagaagtcacccgcttcggttgcacatcattatctcaatcaacatcacatgttaaagggggctccaaaatgacacaaccagtgattgaatttaaacacgttgtcaaatcatttgacggtcatccggtcattacggatttgaatttgaaaatcatacctggtgaattttttgttttggttggtagttccggtagtggtaaaacaacgaccttgaaaatgattaatcgattacttcagcccagtgatggtgaggtcttggtgtttggaaaaaacgtgcgtgattattcattgccaaagttgaggtggcagattggatatgtcttgcagcaaatcgcacttttcccaacaatgacggttgcaaaaaatatttcagttgtcccagaaatgcaacatttgcctaccaaacaaattcatcaactgattaaacgtttgttaaaggaagttggcttagatcagagttatcgttctcggctgccaaatgagttatcgggtggtcagcaacagcggattggaattttaagagccctggctggaaatccggcgatcgtgttaatggatgaaccgtttagtgctttagatccgcttgctcgtgaatcacttcaacaattggtattgaaattacatcatcaatatcacaatacgatcgtttttgttactcacgatatggacgaagcactgcgtttaggtgatcgaattgggattatgaagaacggaaaattacttcaagttggatcaccaaaagtcattacaaataatccgacgaatcagtttgtcgctgacttctttagtaaaaataattattccgatctcaacaaaattttggttagtcaagtgattgaggcgggctttttgattacacctaagctgattgttaatcagcggaatgtaccatcagttgagaaaacgtcgaatttaaaagaagtcctgagaattttagcatccactgctttagttggcgttgttggtactcatcaagagaccattggttttttcaataatgaaagcattattcgttttttaagtacaatttgagggggttgaatcgtgaaaagttatgaagttgttattttaggcggtggtgttgcgggtggcacacttgcacacttgttgcggcgtcaaaataaaactgtggcagtggttgaagataatttatttggtgggacgtgtcctaatcgtggctgtgatcccaagaaaattttattatcggggttggaagtcactcaaactgttgataatatgcaaggaaatggtatttctggtcacgtcagtgttaactggccagacctgatgcgtcataagaggcagtatactgacccaatttcaaacgcgatgcaacattcgttggtttcggatggtgttgacacctaccacgagcacgctgcctttacggaagatggtcacttgcaagccggaaataatctgttaagtgccgatcaatttgtgattgcgactggtcagcggccagaaattttagacattgttggtaaaaaattttttaagaccagtactgattttttgaatttgaatgaaatgcccgcagatgtcacatttgtaggtggtggttatatcggttttgaattggcagggatcgcccatgcagcaggggccaaggtccatctaatccatcacaatagccatcctttaaagcaatttgattcacaattagtaaatgaagttgttgcccatttgcgagctattggcgttgatgttcaactcgatacggatgttaacacaattgaaaaacagggggatcggtattgtataagcggcgatgataaattcaaactaacgactgatatggtgttttgtacggcaggtagaatccctaatattgatacgattggtctggaaaatatgagcattgatgctgatgcacacgggattattgtcaataattatttacagtcatccaatcgaaaggtctttgctatgggtgatgttgtcagtactagtcgacccaaactgacacctgtagccgggtttgaagctaattatctagctaaacatcttaatggaaattctggaaaaatcaattttcccgaaattccaactttggtgtttggtcagccttctttggcacaagttggattaccatccaaagtggcggatgataataaacattatctgttaatcacaaatgatatgactaagtggtacagctatcatcgtctaaatgagccgcttgcaaaggcgaaagtcgtcgtggatcgggataatgaaacggttgttggggcaacggttttaagtaatcacgctgattacttaatcaatttgtttacatcaatgattgataaccaaatgaaaattgatgatttcaatcaacaaattttagcgtacccaacgttggcaagtgatgtgcagtatttaatttaaagagtgcaaagccaagtgcttagctcccagaatataaggcaaaaagacggatatcccagattcagggatatccgtctttttgccttatatggccgggagctgcttggctttgcacgtttcggccaagtagcatcggtgattacggttaagtaatcaagaaatttgccttatatggccgggagctgcttggctttgcacgtttcgaccgagtaaggttggggaattattaaaaagaagccatcaagggggatttgtcttattggggagacgttgcgactatccattatttaagcatcgctaggtcattaaacatttttattttgtcaatacagatcaatcgtcaaacttgatgctgtcttcgcagagctttagccgcatgtcttcactcgggaatactcgtgattacccaaaacgggactggacaaaattacttttgcctcagccccggccattactttttaaatgccaaatcaatgttcccagctatcttttaattgttcgttcaatttttactcggctggttgttaatgactgatccgagattaacggggtcacattgccaatgctaagtaaagtgaggtgatgcatggctctggtaatgatggtgtacagtgttcccagtagagtttcatccggataattgttttctgatgtgtcccaagcaataaccgaatcaaattctaatccctttgccaaatagattggaagaaccaaaacgcccttgggcaatgttcgatcagcgtcttttaataaggttgcgtccagtttactatgaattcgatcgtaaacttgtttggcctcctccatattttttgtgaggattgcaacggtgccataagtgctccgttggttaggaacaattttttcaagccgtttaatggcattttcaaaatttggtaacacgattagttcgggaagatccccatcccgattaaacgcttcgatatcgtcgccattgggtaaaattgatttggcaaaggttgtgattgggtaagttgaacggtaggaacgctttaagctgattaatcttgaatgacggacgttgaaagcagcatttaatttattaagaatttccttgggctgctcaacatctttaaagagtgcctgttcactgtcgcccaaaagtgtccacttggtttgaggaaacgcataccgaagatattttaattgggctaccgagtaatcttgcatttcgtcaacaaacaagtatttcattgtgttgttttgaccactgctgcagatataatcccgcatgtacagaagcggtgcgcaatcatctaatttaatactgtgaaattcaattgcatcattaaattcactggtagcttgctgccacttcttttgatcaatgttttgcggcagatcaacggtctttaagaagttggcatattggagataaggatccaaaaagttgttgttgaagatagcgtcatagacaacttccaatctgtcagtaacaatttttttggcaataaagaatcgttcatcatcttcgttttgaaattcgcccagtgcgtgaccggctagcaagtcatgatacttttcattacttagctggtcgatttcatcgttaacccagtctttaccagtttcatggttaattcgcttctttaaacgtttgatcagttcgttcttggttttaaagaaccgatcggatacggtaatggcttttggaaaaccatcaaagattgagcggatttcttctttactaaagaaaacagcttcgttaaaaataatatcactgaagaaaatttgggaagcggataaatgattacagtaatcttttacgttatccataaacttagctgattctttaaatccccgaatcagcttttgctgaggagttaatgcatcatcggtttcataacgttcaaataaactttgcacgtttaatcccttcaaacgattgtcaataaattcgtcgaaggtgacctggcgcatgttacgctcacccaaacttggcaggacttcggaaatatagtgactaaagagtttgttgggtgaaaataggataatttgatcagcttccagcgtatcgcggctgtgataaagtaagaacgcaattcgctgcaaaattgcagatgtttttcctgaaccggcaaccccttgaacaacaagcaaattactcttggtgtcccggataatatcattttgctcgtgttgaatggttgccacgatgttttgcatataatcatcgttctgcgcgcctaatgcactctgaagcatttcgtcgcccacagtttcatttgtgtcaaacatattccggatctggccattgacaatttgaaattgacgcttctttttaagggttgttttttgttcacccattggggtatcataagccacctggcccagcgtgccattataataaatactcgaaattggggcgcgccaatcataaaccaagaattcaccatcggcgttttcaaatgatgcaatcccaatgtaaagggtctcgtcatcgggttgtccatcatcttggatatcgattcgaccgaaataaggcgatctttttaaatcatgtaaggttgataactgggtcttaaggatactctcgttttctgttaatcgagaaaccaagccccgttgctgttgaagttcggcactggtttcaattcggtcatcgacttcaaaatagttgactgaagtgttatcagaataagtctgctgaacctttttggtttctgtgtgggcccggtcaaattcatcttttgtactgataattttcttgtcgatttttgaaacgaccttatcaacccgtaactgttctttgtgctgttctttattttccaaaagggctcctccattcgtctgctattccgtcatcaattctgaacgcttgcacaattttagattgattttacttttctgtcaattcaatggaccagattgttaatttattagcgaatcattgtataatgattgtaaaaattagcgattcagaaagaagaattaacttgaaattattaaatttatttgaactcagttcggctaatcgaaagcagttagctcagattcctgatttagaaatcattgatcccaaacaagtgacaccgagtttaatcacaaagatttcggcaatctatggttggaatcaattgggtacagaagttttgaatcaatcgactgaacttcgctttgtccagtccaattccgctggtgtcgactatttaccattaaaaacctttaaacaaaaggggattttgcttgctaatgtcagcggcattcacgcggagccaatttctgaaacagttatcgcttatgtgttggcgtttgttcgtggtgtcttggaaagcgagcatgccaagcagcagtctaaatggatcggcgatcagattcggccaacaattacgacattgcatcaaaaggtggcggccatatatggaactggccatattggtcaagagattgccaataaattaaaagtgtttggtgtcaagacaattggcattagtcgacatggccaccccgcggccaacttcgaccaagtctttacggatcatgatgcaataaaggccactgaagcagcagacatcattattaatattatgccactgacggaacagacgcatcacctttttgaccggtcgttttttgaaacattaacaaatcagccgttgtttattaatgttggccggggaccctcggtagatacagaggcacttgtcagtgcacttcaggctgggaagctatcaggggcaggccttgatgtttacgaacaagagccacttgcaactgattcgcctttgtgggggatggcaaatgtgattatgacacctcatatttctggtggcttcgttgaatatggtgatgcagcatttgcaattttacgcgagaatctcaagtcaattttgaagaatgaccgggttgcccgtaatcaggttgatttaagtgagggctattagttagttctgagaagtttatctaaaagaaatgtttctttattaataactttttgacatttagactattaataagtaaaattaaaatgttattaagaaatgagtagaatcgtcggccaacagagagattgcattagctgaaagcaatcgtgacgaaacgaattggaaacgaatacgggtgactccatatcgtcaagagcggtaactaaatacgatagttacaatttaggtggtaccacgtttaagcgtcctattgtgaagacaatagggcgctttttatcaatttgatacgcgaacccatttcgtgtgtgttggtaattgtagcttggataccgctggtttgccaattatccacaagtacatgagtaaatgacaggtaacgaaaggatgaattttgatgacaaaaaagattattttaacaggcgatcgcccaactggaaaattacatattggccactacgttgggtcattaaaaaaccgagttgaactacaaaattccggtgactacgagacatttattatgattgctgatatgcaggcattaaccgataatgcccgtgatccagaaaaaattcgacacagtttgattcaggttgcgctcgattacttagcagtgggaattgatcccaaaaagtcaacgattttagttcagtcgcaaattccagcgttgagcgagttaacacaacattattcaaatctggtgaccgtttcacgtttaaatcgtaacccaactgttaaaaatgaaattaaacaaaaggactttgggcaaagtgttccagttggatttgccatgtacccgattagccaagctgctgatattacggcatttaaagcaacaacggtgcccgttggcgatgatcaggaaccgatgctggagcaaacacgagaaattgtacgttcgttcaatacaatttaccacgaagatattttagttgaaccggaaggctacttcccaccaaaaggaatgggtcgaattcctgggctggacggcaatgccaagatgagtaaatcattaggcaatgcgatttatctttcggacgatgaagatacgattcaaaagaaagtgatgtcaatgtatactgatccaaatcacattcacgttgccgatcctggtcaagttgaaggcaatactgtgttcacttatttggatatttttgattcagacaaggagcaagttgctgacctgaaggcacaatatcgtcatggtgggctcggggatgttaaaattaaacggtacttaaatgacgttctccaggcagagttaaaaccgatccgtgaacgacgtaatcgttatgcgcaagatgttcagagtgtttatgatattttgaaaaaaggtagcgaatatgctaatcaagttgccaatcaaactttgaaagaggttcgtgatgcaattggaatcaattactttaactagtttgtccagaaaggatggcagggatggaaaaccttgtaattttggatattggttctaattcggttagaatggcaattaaccaaattttaagtgatggttcttatcgggaaattaaacgaattaaaagtgacagtcgtttgtcggaagggatgggacgcgaaaagatccttcagcccgaggccatggagcgaacgatccgcgctttagccgatttcaaaaagatctatacggaatatgatgctaagcgagtgatcggaatggcaaccgctgcggtacgtcaggcaaaaaatcaagaccagtttttagcaggggtcaagtctcgaattgggattaccattaaagtgctttcgggaaatcaagaagcctattatgattacttaggtgtgattaaccgtctgggaattcgaaattgtttgattttagacattggtggggcgagttgcgaacttattcgggttaaccatggtgagagcacaaatttgaccagtattccaatcggtgctgttaatattacggaacgttatcatttggacgacaatattaccggtgctaatttgtttaatgcacaattcaatattcgaaagctctattcaaaagtgaagtggttaagccgttcccgtcatcaaccgctggtattattgggtggggcgaatcggacactggcccgaatcaaccggcgtcgtcaaaacatgatgcgcattgatgcaattcacggttatcatttaacctatgaacaggttaaccggacctatttaggattgttgaaaggaaatgtcaagcgccggcagcaaattcaaggcttggaagtcgatcgagccgatatcattgtcggtggtctactccctttgattgtcttaatggataaggttgagactaaaaaggttattttctcggaaagtggtgtccgtgaaggcgttatcacggaatacgttgaccgtcattatcatcgcaaaaagtaattttcaataaatggtttgaatacagggctgaaatcaagagacgatcttgggggaggcccttttgtgaccaaatatcattatcttggatccagttatctttggaggaaatcaatgaatcagcaatgggatcacttttataaaaagacttatcaggagcgattacagttaatcgtggccaatgctaaactagatgctgctcaatttcaaaaattacaggccggggcatctggtgtttccactaatttaatcgaaaattatctgaccgattatgcgctgccggagggaattgtcactaatcttgttgttaacgatcagccatacttggtaccaatggtcactgaagagccttctgtgattgcagcggccagcaatggcagtaaattattagcggacggcaaggggatctctggggctgtcttggatcgggtggtgactggccaggttgtgatcaagactagtcagtttgaaaaggttaatctgtttattcaacagcaccaggccgaagccattgaagtggccaacaaaagtcatcaacggattttacagtatagtcggggcgcccgtgaattggccgttcggcaactggattcttcattcgtatccgttgatctgacagttgatactggtgaagccatgggtgccaatttaattaataccatgttggaggctgttgcgaattggcttcgagaacagttgcatgttgagattacgatggctattttatcgaattttgctgatggcagtttggttcgagtttccggttgtgttaatagtgataaattagctacccaaacaatgactggtcggcaagtggcacaacggatcgttgatgctagtcgagttgctcagattgacattcgtcgggcagccacccacaataagggtattatgaatggcattgatgctgccgtgattgcacttggaaatgattcgcgagcagttgaaagtgcggttcactcgtttgcggccagggatggcagctatcgtggtgttagtcagtggcgaattgatcatgatcgattggttggcgaaatgacggtgccgatgccaatcggatttttgggtggtgccactaaagtattaccactggtgtcagtcaatcaagcaattatgggtgttaaaaatgttcatgaggaaatgatggtcattgcagcggttgggttggctcaaaatttagcagcattgaaagccttggtaactgacgggattcaacgtggacatatgaatttacaattaaaatcattggcaatggcaaacgggacgactgaagctgaattaccccaaattttgccgcaactgcgccaattaaaacagccggattccttagctgttaaacgacttttaaatcaattacgaaaataggagaatttcaatgaataacgaaattaatatcgaattaaacgacagtgttcacagtttaattgacgctgttaacagttttttccccgggacggtcacagtgacgtttattggtaagcttcaatctggttatgtccgccatgatcaagcccaagcagttcaggatggtaagaacatcacggttcaaattgctgatttaagtgcgccaaactatacagcatcccacgagttgctccatttgctgatggttctacgaggctttccacaagtcttcttttcattaactaccggtcaggatcagcttgacgatcagctaaaaatgatgggtaccgaattgtatgatattgtgtctcattttgttgttgtttcagaacagcggaaacatggtctgattaatgatgaaattgaaaagatgtatcttaagggaatttatgcaaccattaagcccgaacctgatccggtagacgatcaaatgacgttacgattaatgactttgttggatgcacttgtgttttatggtgaccattttgattctgttgctgataaactcagcggcgattttccaatttcattggctgctgctaagaacctttataaggttattacggagaagccgactgattcgccatttggtttgcgacgaaatgttgttaaactatttaaggcatttgatgaacagttgcgaaagtgggagctaccgcctttacacaatgatgaattcacaacattaacgagtgtcttgtcaaaacgacaattagggctgcaggtaaaacagttatttgaggtgtaccattcggaactaatcgaggttaacagcaacacgcgggcatacgttggattcaatcgggtggatgaccaaaactcgttcgtaattgctaatcccaaaggaaatcaagataatccagaatttttcaagacgatttacaataaaacggtgaaagagttgtttgatgaactaaaaatgccttatattgaacgtaagtcataaaagttgaggaggaattcaatgactgcaattgatcctaaaattcaaagcgaatttgataatgcaaaacatattgtttttctaactggtgctggtgtatcaacggcttcagggattcctgattatcgctctaagaacggtctttatacaaatgataaatctgataaacccgcggagtattatttaagtactgattgtttaaacaatgaacctaaagttttctatcagtatgaaaaatcaaatatgtattatccagatgccaaaccaaacgtgattcatgaaaaacaggctgcctttacccaaaggcgtggggcaactgttgtgacccaaaatatcgatagcctgtatcgaaaagccggcaccaaaaacctgattgagtttcacgggaatctttataacgtctactgtcagaagtgtcggaaaaaagttgattatcacgagtatttgaagagcatgtatcatcgaaactgtggtggtgttttacgacccgacattgtcttgtacggagaagggcttaatccaagtgccatttcaatgagtgtgaatgctgtatcaaacgctgacttaatcgtgattgtcggcacgtcgtttagagtttatccattcgctggtttaattgattatcgcacccaagatgctaaagtccttgcaattaacgaagagaagttagactttgcatttccatttacaatgattaaggaaaacgccgtcgacttttttgatcaactaagcgtttaatcatggcttatcagaaaggggcagacgcatgattacaattggtttaacaacattttcagagcacccgtcgttgattgatggtcagaaacgaaaagtcaggctgacggagtatagtgctcattttccggttgttgagttggataccccattttatgcagttcctaaaactgaagtgatcattaactggcaacaacaagttccgagtaactttcaatttgttttaaaggcgaatcgcgtgatgacaatgcatgatcaaggcagttcggagccggtgggaaatgaagaacggcttgaaatttttaatcggtatcaacgggcaattgcccctttggtagatgcgggtcagttaaaaacaattctgtttcaatttccgccctattttggccgtagcgttgaaacaattgaatatttgcgtcggatcagccaggtgatggctggatatccgattgcagtggaatttcggaatgccagctggtttggcaaagaaatcacccgggatgtttcgggttatttacatgaattggggatgacactcgttgcggtcgatgaaccccatacgaccaacatgggagttccatttgagccgattgttaccaatgatcagttgagtttacttcgactgcatggtagaaatgtgaaaggctggacggaaaacggcagtgattggcgatccaagcggactctttatcgttattcaaaagaagaattacaacagttttgtaaaaccattttggccttgcaaaagcactgtaaggaagtttgcgttattttcaataataatgctggccgggatgcggctgataatgctttgcagttacagaagctgttgggaatttcgtttgatcatttatcgccgttacagatggatttgttttaaagtgaatggactggaataatgggggattaatctttgcggctctaatcaatcagatgaagatttcctggttgatgaagtcgtttaaacaagctttcgttcaccaaattatctcgcatacgattactttttttgctatactggattgtaattattaaagattaataagtttggaaaagaggtactttcatggcagaaagtaagccaaaattttatatcacaactccaatttattatccatcagggagattacatattggtaattcatatacaacaattgcttgtgacgcggaagctcgttataaacgggcaatgggttacgatgtattttttctgaccggaaccgatgaacatgggttgaaaattgaacaaaaagcagaacaattggggatgtcaccacaaagttatgttgataagatggcaggaaccattaaagaactttggaaaaaattggaaatttctaataccaagtttattcgaacaactgacgattaccacgaaaaagcggttgctgacatttttcagaaattaattgatgctggtgacatctatttaggtgagtatacgggctggtattcggtttctgatgaagaatactttaccgagagtcaactcgctgaggtttatcgtgatgacgacggcaaggttgtcggtggtaaagcgccaagcggccatgaagttcaattagttcatgaacaatcatacttctttaaaatgagtaagtatgcggattggctacttcagtactataaggaccatccagattttattcagcctgcttcacgaatgaatgagatgattaagaacttcatccagccgggacttgaagaccttgccgtttctcgaaccagtttcaactggggggttcgcgtcaagtctgatcctaagcatgtggtatatgtttggattgacgcattgtcaaactatattactgcattgggttatgatggcaaagatgatagcaacttcaagaaatattggcctgctgatgttcaaatggtgggtaaggaaattgttcgtttccataccatctattggccaattattttgcatgcgcttgggttaccattacccaaaacggtctttggccatggttggctattaatgaaggatggcaagatgtccaagtccaagggaaatgtcatttatccagagactttagttgatcgttacggattggatgcattacgttactatctgctccgggcaatgccttacgctaatgatgggatcttcacaccggaagattttgttgaccgggtaaattttgatttggcaaatgaccttggaaacttactgaatcgaacggtttcaatgattaataagtatgagaacggcatcattccacaactcaaacttggggttacagagtttgacacggagctggagaatacagctgctgaagtcaccaagaactataaacaattgatggatgacttacatttctcagatgcgcttgctgagatttggaaattagtatcccaaactaataaatatattgatcaaaccgagccgtgggttttagctaaggacgatgctgataaagacaaattggcttcaactatggcacatttggcagctagtttacgggtcatcgcagagctgattagtccagttatgactcatgcacccaaagaaatttttcaacaattaggtcttactgaggcaatcaatctcaaagaacttagattcgctgacttacctgctggtggtcagtgtgctgctaagggaaccccaatttttccccgggttgatgttgatgaagaagttgacttcattaaagcccagatgacgaaaaatgataaggctaagggccgagcagcaatgaagcaagcggctgaaaaggaatttgatcccgaaacaaccgatcttaagttgactaagaaggaagttagatttgatgctttcgaaaagattgagttgaaagttgctgaagttcaggatgttaacaaggtccaaggcgctgataagctacttcaatttagactaaatgccggcgatgatggtgaccgtcaaatcctttccggaatcgctcagtggtatcccgacttcaaaaagttagttggcaagaaagttatcattgtatccaacttaaagccgcggacaatgcgtggacaagttagtcaagggatgctcctttcggttgagcatccggatggtaatgttgaactagtcacggttgattcccattttgagaatggtatcacactagagtaacaacatcggcagttttcggattagagctggtgattgggattaccaataattactgggtcaatgggctttgacggctatctgtcgggattaaaaatagtagaattggtacgattagatcataattatgtataatgaaggggccgggacaaagcgtgatttgttctggtccttttgttgtcgctgagaagcctccagagttaggcaatttggcagcgtttaagtgaatgccaagtgatttcgattgcaacgggaaaaaacaacccatcaaaatactgggagtttagttatttatcagaaattattggtatgaccagtcacccatattttgttgtaagtggtaataacgaggtagatcatgaaaatttttgattcacatacacatttaaacgacgatgcattttattcaaacgttgaaaagtacgcgcaacatgccaaagccctgggtgttgttaaattggccaatgtcggatcaaaccagattttaaacgatcgctcactggctttatcagcaagatatccagatatgtattctattattggttggcatcctgaggattcgattcactaccatgacgaacaggaaaaattgttgattgaacagttacaaagccccaaagttgttgcattgggagaaattgggttggattactatcagacaacgtcaccaagagctgttcagaaacaagtgttcaagcgtcaaattgatatcgccaagcagttgcatcttccaatttctgttcataatcgggatgcttttgaagatacgtatgctatcttaaaagaaatgaatgtttctgatatcggtggtgtgatgcacagctttaatggtgatccggagtggctaaagatatttttagatttagggatgttggtgtcttacagtggtgttgccagctttaagaagacacgggaggttcacgaatcagtccggcaaaccccgtttgatcggatgttagtggaaacggatgcaccgtatctagctcccgagcctttgcggggcaaacaaaatgaaccggcttatacactgtatacggttgaagcaattgctcggttctgtgatgttaatcctgatgatattgctgctcatacttatgcgaacgcattgcgactatttggaattgaggactagatttgatgaagaaaattaaagaagtgattgtggttgaaggtaaagatgacactaagcggattttacgggcagtggacgctgatacgattgaaactcgcggatcggcaattccggatgaaacgatggccttaattaaaaaattggccaagattcgtggtgtgattgttttcaccgacccggatttttccggcgagaagattcgcaaaacaattgcggccgaagttcccaacgtgaaacatgcttttattactaagaagcagggggctcctaaacgttctgaggggtcgctgggtgttgaacacgccagcgttgaaagtattaaggatgcgctccatcgagtctataccgaggatcaatcggccgaggaattgatttcccgggaagagttgatgaccgacggtttaatgggaaatcctcaatccaaacaacgtcgtcagcagctgggggagctgttgcatatcgggtatgtcaatggtaagcaacttcaacatcggttacgaatgtttggaattacgcacactcaattcgtagatgcggtcaagaaaattgataaggaaggtaaaaatgactgattatccagcaattgcaagtccagcacgaacccaagcgatccttaaccggtatcgcttgtcggccaagaagagtcttggtcagaactttttaacagatcttaatattttgaaccacattgttgaagctgctcaaattacaaaagcagataatgtgattgaaattggacctggaattggcggcttgactgaacaattggccaaggctgcccaccaagtattaggttttgaaattgatcaaaacttattaccagtcttggaagaaactctgtcgccatatgataatattacgattattaatcaggatattttgaaggctaatctgcctgaggtgatcggacaatattttgaaccaaatcggccggtaaaagtggtcgctaatttgccatattatattaccacgccaattgtcatggatttattgtcagatcaaatcgactttgaggcaattgtggtaatgatgcaaaaagaagttgctgatcggttgaacgccgagccaagcaccaagccttatgggtcattgtcagtaattgttcaagaatcaaatcatgtcgaaattccgtttattgttccgcggactgcatttattcctcaacccaaagttgactctgccattgttcggttaacaaagaaaacacgcaaagagtcggtaccttttgaccaaaaacggtttgttggttttgtcaggggctgttttatgcatcaacggaagacactttggaataatttacaaggcatctttggcaaaacatctgagactaaggcagaaatgaaagcaatcttggctactctcaacattgacccaggtgttcgacctgaacaattaacagtggatcagtttgtcatgttaggtaatgagtttcataaacgcggtatcttaaactaatctttattatttttgtgttgatagataaagcgaaatgtggtaaaatttgcgtttttgttcctcacatgctataatgacttattgtgaggtgaatataatgccaattacactgtctgtgatcaaacataaaatggatgatcacattgggcaacacgttttagtgacttctcaaatcggacgaagaaagactaccaagcgccgaggcgttttgagagagacttttcctgcagtttttgttgtggaattagatccagggaaatctaattttgaacgagtttcatatagttatactgatatcttaactaaaaacattgaagtcgattttgacaatgtgcaagccgaataagatgcttacctaatttctggggccatggaggcctttttgttttggccattttttcactggattcgctgacaattaataaataatttagtatacttttcttattaagcagccgatgaggagaggtgtgggccatgaagatgattgttcgagcaccagcaaaattaaacttagggcttgactcaccttttgtgcatcccgatggttcaattgagtggcggatggtgatgacttcaattggtttggtcgattatgtccaagttgagacaatccaatcaagtgcaattaagattaggtcggatgccggctttttgccaaatgatcgccgaaatcttgcttaccaggctgcaaaactttttttaaatctgactcacattaaagctggaattatcatttcaattgagaaacatattccggttgccgctggacttggcggtggttcctcggatgcagctgcagtattgagagccctcaatgaaatgtttcaaacggggttatcgcaaaagcaactggcaatgttagggctccaagttgattctgatgtgccttattgtatctacggtcgcacagcattggtggagggacggggagagatcgtgacaccacttaaaaaattacctaaaatgtggtttgtattggctaagcctaatgttagcgtatcgactccccgaattattagacgaatggtgcatacgaaaattgatcatcccaatattgacgcgcttttaagtggtattcagaatgatcattattcccaaattgttaataacatggggaatgcattggagtcaatcacaattgcaaatcatccccaaatctcaacgatcaaagaacgtcttttaaaatatggcgctgatggatcggtgatgagtggcagtggaccgactgtttttggtatctgtcctaatgaaacgcgggctcgtcgggtttttaatagtatttcaggattttgtagcgaggtttatttgacgcaacccgagtgttcgatggactaagtgagttcaattgggcacggatgtcggtgtaagaaaaataactgttcattttgttaaacaatcaacaagtcattggcgattattaatacttcgatctaacatcatttttactgtcggatcggggtatttttgatttttgtatgattaaacaagcctttaacacttataacggtagcggtggttgtaacggatcatgaaagcgtggacttaacaggaaactatctttaaagtagtcgatcagtgatctattttgacatcaacatgactgataaatttaggcgccgagacaggcacggattagggtgatattgaagcaatttatgcataacggtaattgacaaaatctaaatttactttaaactaaaacagtaataattactttttacatacattggaggctttcatttgagtgaaacattaatttctgttgaaaatttgtcactaagttttcctaaccatccagttctcactaacttaagctttaaggttaaccggggcgagttcttaggggtgatcggtgaaaatggggtcggaaaaacaacgcttgttcgaattattttaaatcaactacgtccctcaagtggcgaagtccgtttaaaagacggattgaaaattggttacgttcctcagtttagaaatgttgacatcgaatttccgttatcaattaaggattttatcgcgcttaattttaccggtattaagctgccttggttatcgaaaaaagagaaagcgcgcataaaaaaagtgatcgaactggttggcttgactgacatcgctaaccggccacttggtttagcatccggtggtgaaaagcaaaaagcatatttgggtcaagctttggtgaatgatcctgatttattgattctggatgaatcaactgccagtcttgacccgaatacgaagcaggaattactggatgtcgttcttcggctgaataagcaattggggctaacgatcctttttgtctcgcacgacatgcagctgattcataaatacccagatcattatctgtggctgagaaaggggaaatatacaacaggcgctatgagtgacctgcacaatgaaaatcaggagggacaatatgtttgaactagagtttatgcgaaatgcctactttgcaggtacattaattgcgattgtgagtgggatgatgggagtctttgtcattgcgagggatatgccttttatggctcacacattgtctgaaattggatttgcgggcgcttcctttgccgttttcatcggttggctgccattaaacgggatgctagcttttaccactgttagttcagttttggtcggtgaattgagtgggtctgtccaatctcgtcgggaggctgtgattagtgcaatctccgggctctttattgggatgggcattctgtttttatcgctttcaagcaaaaattccagttatgcaaccagtattttattcggaagtgtgattgggatcagtcatcatgaagtgattcaaatgacctttttatcgggtgtcattttattaatcttattaatgatttatcggaatttaaaagatgattcttttgattcagttggggctaatacgaatcatattcatcggtcactcatttcgattgtttttttagtgatgttggcttttagcgtgagtgttgccgcccagattgttgggtcgctgttgatttttgtgctattaacactaccggctgccagtgcaaagtattatgttcatacggttgctaaaatgatgggattagccgttggttttgctttgtttggtgtttggatcggcctttatcttggatatttaacaaattggccggttacattttttattgcaacgattgaagcagttatttatgccttggcattggtatttaatgcggtaagaaagacgagcttatagcacctttcaccttaattgaccgggttagtttagcggccgatttcttgtgttaccccccaaataaacatgaatctttggttggttaaaatcgtaaatcatttcgaaaacattatattttgatatagaacccccaaaagccgaacgtttatgataaaatcaaatagatattacataaactagaggtgggatttttgaagatacgaagaagtgatcgattgatcgatatgactcgatacttgttggaacggccacatacacttgtgccgttgacattttttgcggatcgttacgactcagccaaatcatcaatcagtgaagatttaacgattttaaaacgaacattccaagcccgtggaacggggttacttgaaacaattcccggcgctgctggtggtaccagatttttaccatacatgttaaaggaagaagcccaagatgtcgttagccagctaatcgaagaaatgtcttcagatacaagatatcttcctggtggttatgtttacatgtctgatttattgggaaacccagccacgttacgccaaattggtagaatttttgcgacccagtatctcaatcaaaacgtggatgctgtgatgacgattgcaactaaaggggttccaattgcccaaagtgttgctgacttcttaaatgtgccatttgtgattgttcgacatgatacggagatcactgaaggatcaacggttaatgtgaactatgtttctggatcgtcaacccggatcgaaaaaatgtcattgtcaaaacggagcttaaaaccggattcaaacgtattgattgttgatgattatatgcgtggtggtggcaccgttggtggtatgatttctatggttgatgaatttgatgctaatttaattggtgttggtgttgtggctgaaagtaccgctccaaatggccgatcagttggtgattacacgtcattgatgagagtagacgctgaaaataacaccgttatttcacaaccaggtaattatttggaaaagatatttaattagaacgcattggggagacatttatgatggcaacaaagaatacaattatcttggctgcaggcaaagggactcggatgaaatcaaaactatataaggttttacaccgactctgtggaaagacaatggtcgatcacgttttaacacaagttcaaaaagcaaatatgaacaatattgtaacagttgttggctttggtgcggacgccgttcgcgagaatcttggtaaccgaaccaaatacgttgtccaggaaaagcagttaggaaccgggcatgccgttcttcaggccgaaaagcttttaggagaccttgatgggatgacgatggtggttagtggggatacaccgctgttcacaactaaaacatttgaaaatttgttcacttatcatcaaaacaaaaaagccaaagcaacaattttgacttccaaggcacctgatccaacaggttacggtcggattgttcgcaataatttgggaattgttgaaaagattgttgaacaaaaagatgcgacgactgaagaacaagctattgacgaaatcaatacgggtgtttacgtatttgataaccgctcattgtttcaagcactgcataaaatcaataatcataacgctcaaggagaatattatctaacggatgtcattgaagttttgaagcaggaaggcgagacaattgctgcatacaaaatggacgatttcaatgagtcaatgggtgtcaacgatcggattgccttagctgatgccactcggattatgcaggagcggattaatcgccaacatatggctgacggtatttcaatgattgacccacaacggacgtatattgatgccggtgtcaagattggatcggataccattattgaaccaggtgtccagcttaaaggtaatacggtgatcggtaacgattgttatattggggccaattctgaaattcgaaattcggttattcatgatcacgtgactgtcacatcttcactgattgaagagtcagaaatgctggatcactcagacattggaccaaacagtcacttgcgaccacacgcattgataggtaagcacgttcatttgggcaacttcgttgaggtaaagaaagcctcgattggtgaaggaaccaaggttggtcatttaacatatgttggtaatgcaaaacttggtaaaaatattaatgtcggctgtggcgttatttttgtcaattatgatggtgctcataagcatgaaacgacagttggcgacgattcatttatcggcagcaactcgaatttaattgcgccgcttgatattcaagatcattcatttattgccgctggttcaacaattaatcggcctgttaaccagtatgacatggcaattgcccgttcacgacagacaaataagcctggctatttcaaaaaattaccatatcagaaggattaacaataattttctaataaaacattgtataattaggttagaaatgagttaacaaaaaataaattggaggatcatatggctcagcaatattttgattctaaacttaaaattttcgcgctaaattcaaatcgtccattagccgaaaaaatcgcagagactgtcggcgtgcctttgggtaaaacatctgttgatcgttttagtgatggtgagattcggattaatatcgaagaaagtatccgtggcgacaatatttttattattcaatcaacatctgctccagttaacgataatttgatggaattattgatcatggttgatgcgttacgaagagcaagtgctgggaccatcaatgttgtgattccgtattacggttatgcacgacaagatcgcaaggcccgttcacgtgaaccaattaccgctaaattagtggctaatatgattcaaaaagatggtgtcgatcgggtggtaacattggatcttcatgcggctcaaattcaaggattctttgacatccccgttgaccatctaatgggtgcgccactgttagctgatcattttatcaagcagggatttggtagcaatgatgtcgttgtttcacctgatcatggcggtgtttcaagagctcgggcattggcagagtttttgaaggcaccaatcgcaattattgataaacgacgtcctgaagcaaacgttgctgaaattatgaatatcatcggcgatgttaagggtaaacgctgtctgatgatcgatgatatgattgatacagccgggaccatcacgctaggtgcccaagcgctcgttgatgccggtgccactgaagtctacgcttgttgtacgcaccccgttttgtcaggaccagcaattgatcggattaaaaaatcgccaattaaacaattggttgtgactgatacaattcaattaccaaaagaaaagcatcttgataagattcaacaagtttcggttggtccattgattggtgatgccattaagcgaattaatgaaaacaaaccagttagccctttatttaataatcgatttcgtggtgatcaggattaatgaaggctctgtataaaacccatttatcattgatctggatcattatcgttgctttatttaatgcgatttggttattaataagtggttcgtcaggattgatgtttttaggaaacattgattttctgatcgggcttgcattactggtgattgcttcgatctttattgtgggatctggtcacctgtttaccggctggcgattttcatttcgaaaaaagtctgatttggaatcagaaaatgggcctaagtatcctaaagccaaagaagtggcgtcaattaaaaaccagccaattaaagttaatcggtatgcccgcttttgtttatctgttggtatttttatgattggtctgggaattgttttgactagtatttaaaagaacacagtgagacgaaaacggatagtcttcgattgtgttggaaacagagtgggtcagcaagcggttagatctcagaatataagtcccctaacttaatatttccgactttggaatgttaagttaggggacttatatggatggccgggggttgcttgttggtccacgtctctactcagtaatcatcgtatttacactcatagaaactgggcaaaacaattgttgttccattctcaatttcatagtacgactgagggttgcttttcgtgcccttttttatttggcaataatcaagattaaattaaagaaaataggacaaaattaattttaaaccggtctcgtcatttaatataaataattctttctgagagtataatcaggcccccataaaaccaagtttctaaagaagttggttttatgggggcttgattattgaaattatttaataaatctatttaaggcatatgcaaccccatcttcagagttgggctttgtgataaatgacgcggcagctttcactgtatcaataccatttcccattgcaacgccacagccggcatattcgaccatagtgagatcattgccttgatcaccgattgccatgacattatcggcggacatcccaagttgagtggctaaatcactcagcgcatttcccttgctggcttgtttgttcatcaactcaataaagaatggttcgctttgaaccacgtataattgatcacgaagttgttgaggaaggttctgattggccttggtgatcagatccggaaaatcgacaaacattgcttttgaaatgaccatgtgttgattgatctcttccggggatctaaatttaaccggtaatcgaaccaaatagctttcgccaatactataagggcttaggtcacggttaaatgcataaatactatccattgtttcaaactgataatgaacccctaattttctggcaatcatttcggtttccaaaaaatcgttataagttagcgtgtgatgtgccatgacatgaccttcgagatcctgtgccatggcgccgttaaaggtgatggcatattcagtcgcaccactgatgcttaatttgtccaagtaaggttgaaccccacttaaaggccttccagtacaaagcaccactttgattccttttttgcgaactgaagtaatagcatcaattgttgcctgagcaagctcgttattttcatttaaaagggtcccatcgatgtcgattgcgattaacttgatagtcattccgttactcctttgagtcgtttattaattggtcgttacgaatgtgatttttaaattcatcatattcgggttgaaaaagatcaacattttcttcaggtctgagaatctctcttgggaagaaaaagcggttgtcaccggtttgcttgtcagaaattgctttaacaatggggcttactgttgaaagttcaaccagagtaccatcattttgcatcaattcaatttgttttttacccggacgataagcatcatatggtaaatcaaagctattgtctgttgaggtgtaataatcaggattaaaaccggattgttcgataatttgtcgtagccttggtaataattctttagtgttagcattaaatttaacggactttaatggttttcggtcgatgaagcgactggccagattacttaaaatatcatctggatagcgtttccagtgaataaagtaagtatttaaaacgccatcgtcaagctgcagataatcggccaaattaaaatcaccttggaagaatggtaacagtaaataaggcgtttgtggatctttatgcgttggcgtgctaaagatgaatttggctcgctgcaatagccggtttaggataacttccatcgatcgagaaacagggtgaaaataaacctgctgatacatttgaaatcgactaacaatgtaatcttcgacagcgtgcatgccactcatttcaaagcagataccatcttgatatggccgcattacttctagaattcttgaaagatcgaatgtcccgtatttaacaccagtattgtaagcatcccgtaataagtaatccattcgatccgcatcaagttgactggagatcatttcaacaacttgtttgttaggataagttttgttaatcacacttgctactttttcagggaaatccgggctgacttttctgagtacgtgattaatttcggttgaatctgatgtaataattgcctgggtaattttttcatgatttgtaccgaaaatatgttcaaaagtatgcgaataagcaccatgaccaatatcgtgtagtagggctgcacaaagggtgactagtttttcggaatcatcccataagccgtcacctggtttttgcgatggaaagttcttttgaaatgattcaataattcgccgggcaatttcgtaaacacccattgaatgagagaaacgggaatgttcagcgccgtgaaaaattagtgatgttgtgcctaattgatgaattcggcgtaaccgttggaattcacttgtgttaatcaaatcaagaatgacctgatattttacgtagacgtagttatgaaccggatcacgaaataccttttctctttttagttgttgatgtgcgtaatccaaaaaattatctccttagattcttggcagttgttcatttcgtaattgcatttttcgcaactgctttttttgttgtaataggtactcatctgatgccaataattcctgataaccggttaagtcgagtgaaatgccttccttactgacacttgctaaaaatttattctcaacatccttcagcgtaacggtcggcatccccagttgttgaatggtggtcatcgttgttttgtcgacaacaggaaacttccagtccgtttgtgaataagcgtcgccggcattgtaaaaatcagtgacaacgtcgcttcggtgatcttgatcgccggaaacactgagatacagcatgaggacgatagcatcatgagttcggcgttgggcaataccggcaatcttttgaccattgacgcttaggtcatacttgcctgggcaataagaatgttcaatctcgtagctggcaatgtccagttgtgggaaacacatgctaattaatcccttgataatttcgtaagcatcgtcaactgtataaatgactgtttcctgggggataaacaacgaaatatttaggatacccaagtcactaatgacagccaacccgccagagtttcggagaaagtaatcgtatttattagcaactaggctttgcaaggcctggtttaagcgaggcagatggcggtcgttaatacctaaaattagtgttggtaatgccgttgtccaaaaatgaataaatgggcgctgatatttgccacacagttccagtaaggcgttggtatcagcaaaagcatctaatttattgctgccggcataagtttgatcgatgacagtaattggttcatttgtaaagggcatattaaacctccacttgttattgaataaacagctattctaattataacagaaagtgtcccaggacaagtgggcaaagtcaaagagatcagcttgggtttgcttgagcaataattctcttaaatatggtaatgaaggactgaattaaattcaaaacacttgtacttgcgatgaattcttcatataattaattggttagataagtcccagtaaagaaggtgcattatggacaacttagcaactggcgtacccgcgcaaattcatttggaaactagtattgttcaggatggtaaaacgtctgattttatgtttgacgtaaccggacaactggttaaaatgggtaccagtatttatattcgttatagtgaggatgctgatgaaggaccagtccccgtcacaattaaaattatggagaatggggatgttaaattgacccgttctgctcaaaatagattacaactgctgtttagtgatggcaaacgagtcgctgcccgataccgaacaccgtatggcaatttagatattcaaactgtgacgtcttccttgaatatggaaattttaaatcagccgcttcggggaaatatagaaattgattatttgttgtacgcaggaaatgaattactaggtaagtatcatattcgattgcaatttacaatttaatcgggtatagtagtttttagactgttgaaaggacgtgtaccagtttggaattagaagtctttaaaggccaaaacaaaagtgaactatcgatgatcgaggttgcccatgcaatcttagcccaacgtggcgacacgatgccatttgccgatttggctaatgctgtgcagggttacttaggcgatagtaacaaggaaattagagaacgattgtcgcaattttatactgatttgaacattgacggtagctttatttcgcttggcgataatctttggggcttgcgaacatggtacccatacgaatccattgatgaagccactgttcatgcggaagatgaagatgaggatcgtcctaagcgtaagaaacgacgcaaggttaatgcttttcttgccgatgcttccgatgatgacgatgtcattgattacgatgatgatgatcctgaagatcaagacgacgaagatctggtggatgacgacgatgatgaagactcagacgatgagagtggcgaagatcttggtaagtacaataaagatcttcaagacattgatgatgacaccgacgatcctgatgataccgatttaccggatgggattgaaggccagttaaatgaattgaatgatgacgatgatgattcattcgacgatgacgatgacgacgatgatttcaactcaaaagatggtcattaatccttgactaaagttgagaatgtatgtattatgttttttgggctccttgaagttttcaaggacatctgaacgatgattaaaatgttccctattcacttttggatagggatttttttatttgtgaattccccggctaattattaagaggagaggattatataatgaccaaatatatttttgtaactggtggcgttgtttcttccttaggcaaaggaattgtggcagcatcattaggccgattgttgaaaaatcgagggttaaatgttactattcaaaagtttgatccgtacatcaacgttgacccaggaaccatgaatccgtatcaacacggtgaggtttttgttactaacgacggaaccgaaactgatctagatcttggccattatgaacgattcatcgataatgatttgaataagtactcgaacgttacaacgggtaagatttacgatgaagttctccgaaaagaacgacatggggattatcttggcgcaaccgtgcaagttattcctcatattacgggaatgatcaaagaaaaaattatgcgggcagccaaagtgactgatgccgaaattgtgattactgaaattggtggtacggttggtgatattgaatcattgccatttttggaagccattcgtcaaatgaagacggaagttggcgacgagaacaccttttatattcacacaacgttagtaccttatctacatgctgctcatgaaatgaagactaagccaactcagcatagtgttaaagaacttcgcagcttgggaattcaaccgaatttattagtggttcgttctgaaaagcctatcactgattctatgcgtaaaaagatttctctcttttgtgatgttaaaccacaagctgttgttgaatcattagacgttccaacgctgtatacgattccactaatgttgcaaaagcaaggaatggatcagcagattcttgatcattttggcattcaaaaacctgttgctgacatggaagaatggaaagagcttgaacaacatgttcagcatttgaagcgaaaagttcacattaccctggttggcaaatacgttggtctgcacgatgcttatatatcagttgcagaagctttaaagcatgcgggttacccggttgatgccgatattgatcttgaaatgcttgattcggagaaaatcacgcccgaaaatgttgaagagttattagcaccggctgatgggattattgttcccggtggatttggtgatcgcggaatcgagggtatgatcacggcaattaaatatgcgcgtgagaaagatgtgccatatcttggcgtttgtttaggaatgcaaatggcttgtgttgaattcgccagagatgttctcggcgataaagatgctaattcgaccgaaatgaatcctcggacaaaacacaacgtgattgatttgatggctgaccaagaggacgtccacgatatgggtggtactcaaagacttggtgcatatccttgtaagttaaaacccggaacggtagctgccgctgcgtataataatgcggatgtcatttcagaacgtcatcgtcaccgttacgaatttaataatgcttatcgaaaagaaatggaagcacacggaatggtcatttcaggaacatcacctgataaccatttagtagaagttgttgaaattccagctaataagttttttgttggatcacaataccatccagaatttatatcaagacctaatcgtcctgaaggtttattcaaagagtttgtttcagctgccaatgatcgatatattgaacgatcaaagtaatttcaatctacaaaaaggagtcaggccaaggcttgactcctttttgtgtgtcttcaggaattgttttaattggttgttcgtcaactgttgttggtgaattcaaatattaaagttctaatcatttcgtgattagggcttttttagtatgaatgcgcaaaacgtagagcacacgggttcggaaacgaaaaaaacca

SEQ ID NO: 689 - DNA, 41774 bp, Unknown
  Metagenome-assembled genome
atactttgcataaaggtgacctcctattgtcatgcggtaacaactcagtgtttatacaacatcattatgagtttaaatccgcgaattgacaattaggaggtcacttcatattatctctggaagttaagcgccttttgtcccgctctgacttccttttactttccacttctacagagcacttaattaaagatattggactatgccaaaattaaacgttaaaatgtgatcgttttttggctcaacctgccgtccctggagaggggcatgatataattaacgttaatatcaattaataaaaggtggaacaaatggacgagacattaacaaaacagattcagcatgatttaccaaaactgcgtgccaaacaaatttctgaaactttaaaaatgcttgatgaaggtgacacggttccctttatcgcacgttacagaaaagaacgaaccgccaatcttgatgaagttgagattcgcgatattcaagcggctgctcatcggattcagaccttggataagcgaaaaacggaggttctgaagataattgatgagcaaaaagccttaagcccacaattgaaaaagcagattgaggcggcaacggttttacagcaagttgaagacctttatttaccttacaaacaaaaacgacgaactaaggcgacaatcgccaaggaaaaggggttgcttcctcttgcaaaagctgttttggcgtttgattcgcatttggaccaattagttgagtcagcagtcaaccctgacaaagaactgcctgacaagcagtcggtctatgacggcattcacgaaatcttggctgaggagattggtgatcgagctgagtttcgaaaatgggttcgtcaaaacacaaatcaatatggtcaaattgaaacgaaggttaaaaaaagcggtaaagaacttgatgaagccggtacttaccagcaatactatgagttttcgcaacccgttcgctcaattccgtcattcagaactctggcaattaatcgtggtgaaaaagagggcgttttaagtgtcaaagtaacggtcaatgaaacaccgattaaatggcatcttcaggcaactttggtgttgaagcataccggcttggcggctgatatcattaaagacgcggctgatgatgcttatcaacgatttattggcccggcaattgaacgcgaaattcgtaaagaattaagtcagattgcggccgaccacgcgattgatatttttgggaaaaatttatataatcttttgatgcaggccccgctaaaaggcaaaattgtcatgggatttgacccggcatatcgaactggctgcaagctggcggtggtagatcgaaatggaaagtatttagataaaacggtcatttatccgcataaacctgccagtgaggctaaacgaaaagcggctaagggattatttatcgattttatcaaccgaaatcacgttgaaatgattgcgattggtaatgggactgccagtcgggaatccgaacagtttgtttctgacgcgattaaagaaattaagacaccaatttattatgtaattgtcaatgaagcaggggcatcggtatactctgccagtaaagtcgctcgtgaggagtttcctgacttcagcgttgaacaacgatcggccgttagtattgctcgcagaatccaagatccattatcagaattagttaaaattgatccacaatcaattggtgtcggccagtaccagcatgatgttccccaaaaacaattacgagatcagttggatcaagtagttgaaacagcggttaaccgcgtcggcgttaatttgaacactgcaagtcctgatttacttgttcatatttcgggactaacgaagtcgacggctaataacattgtgacctatcggaatgaatcaggggcatttgagagtcgttctcaattaaaaaaggtgcctcggcttggtcctaaggcgtttgaacagtcagttgggttcctacgaattattggtggaactaatccgcttgataatactgatattcatccagaaagttatggggctgcaaaacaacttttggcacagtccgaattaacaattacggatcttggaaaaagcgttgtgagtgaaaagttatcaacaattaaagttgatcaggcggcacaacaattcgatgttggcaaagaaactttaagggatatcattaaggggcttgagacacccggccgcgatcttcgtgatcaaatgcccgcacctctgttgcgcaaggatgttttaacaatggctgatttaaagccgggaatgaaattgcaggggactattcgaaatgtcgttgattttggtgtctttgttgatatcggagtcaaacaggatggtttagttcatatttcaaaaatgagcagtcattttattaaagatccaagtaaggcggcttcagttggcgacattgtgacggtttggattgattcggtagacactgatcggcatcgaattcaactaacgatggttgatccaacggcttagacgggttaactatcggtctggcatggttcatttgctgctctgactggatgaactgaagatgttgaagtcattgattataggagatctttagaaagttgacagataaacaattacaaaagttggttgaacaagtttcgttaacattttttgccaaaccttttttacatcatgcttattttaatcgccggctcaaaacaacaggtggacgttatcatcttgagagccatgacattgatatcaatcccaaaatggatgagatagataccgggactaaccatgatattctggtcggaattattaaacacgagttatgtcactatcatcttcatttagccggttttagtggcaagcataatacacccgaatttaaacaattattaaaagcggttggtggatcgagatacgcgccaaatacaacaattcgttctcaaccgataaaatatctttatcgctgtaatcggtgtggtttggagtatcatagaaagcgaagaattgacgtgtcaaaatatgtttgtggtcggtgtcgaggaaaattacagttagtgacaaattatcgaatggccaattgaccgctagggaggagtttttacatggcaaagattattattcgggtcccggccacttcggcaaatttgggttccggagtcgattcaatcgggattgcactgcatctttactacactgtgattgttgaggaaaaaacagatcaatggaaggttaaccatgcattgggaagtgatattccaactgatgaaaaaaacttaattgtccaaacaattttaaaagtagatgcaaacattcatccacatcagttaacagtcatttccgatgtcccaattgctcatgggttaggatccagcacaacggctgtagtagctggaattaagattgccaacgcacttggtgatctcggattatcgattgatgatcagcttaatttaggggccaaatttgagggccatcctgagaatatcgcagctgcattattaggagatttggttgtttcgacttttgatggcgaaaaagcaattgcaaccaaattagctttaccggatattcgggcattaatgtacattcgtcctgatgggattagtgaggcgcaaagtcgtaaaaagctacctaagaagattgactatccaacggctgtttatgccagcagtaaggctaatgtctttattgccttggtcagtcaaggaaaatgggatcaggcactgcctttggttgaggatgaccaacttcatgagccttatcgtaaggatttggttccagagatcgacacgattcgtcaagcagcccataaattaggaatctacgggacttatctgagtggtgccggcccaacaattgccaccttgggtgaaagttcagcattaacacagttgaggatagaattagaaaaagaaaatttaaatggtagtttacggttgttacaaattgataaagatggcgcgactgtccgcggagaataaatttaaaaaattgattgtcaacgcttcgaatttctgctataattttatctgttgatgcggccatggcggaattggcagacgcgcaagattaaggatcttgtcgggaattatcccggtggaagttcgaatcttcttggccgcattgttaaagttcgagtcactatcattttggtagtggtccggactttttttattggttaaaagcgtctgtaaaggaaacgggtattaacaggaatcgctttctactggtaagataaaggtacattaaataatcgaaaactttattagggacgcatttatttattgcggagaaaaatttgggttgagttaatcatgttgagtgaaatgttgttcatcagtgaaacaagtggtctgatcataaaaagctaagcggatgggggagtttaaggcatgcataattttatttttgatgtggatgggaccttaattgattcggaaaaaatgtacctgctaccgttacacaaaacgttgcttgagaatggttatgatattcagtatgaaagtttaaagaaggtttttgggattacagcagttgattctttaaaaattcttggggtgaaaaacgttcagaaagttttgaaagaatggtttagtaaaattcaggactataaaaaatatgcgaccgtttacgatggcatttatgataccttagagggtcttcatcaggataaaaataatcggttggcgattgcaacttccaagattgaatcggagtttcatcgagatgttgctcgatttggattagataagtattttaatgcctatgttttttctaatgagattaagcatggtaaaccggcacctgacatggtttacaagggaatcgaaaagcttcatgctgatcctaagcaaaccatttatattggtgatacgatttatgacttacaagctgctcatgcagccaaagtggcatttggattagcgggctggcgaacaaaaaagagtgatgaatttaaagaagccgagtactatttggttcaaccgtcagatttattagatattaatgattaatcagtgttttaaggaaatggaattcataccggtgataagcaatggatatccgtcgtgacacttatgtgatatatttatcatgactgtttaacaaattttaatgtgttttgttaccaataacactagaggagacattcttatgatttcaattattgttgcaagtcatggcgggctggcatccgccttggtcaaaacttctgagatgattgctggcaaacaggatcaggttgcaacagttggtcttgaaccaagtgatggggttgaatcactatctgtaaagtttgcttcagctcaaaaaaaattaccacaagatgctgatacgctgattttggctgatttgtggggcgggtcgccatttaacgtggctgctggtgttgtagctaatgatccaaagcatacggccttaattgcgggcgtcaatctgccgattctcttagaggcatttatgtcgcgccagtcaagtcttgatgaattggttcgtcacattcacgagatttctgatgattcaattcgccaatttacaattgcgccaccaacagataatgatttgggagatgatctttgatgacaatggatatccgattagccagggttgacagtcgattactgcatggacaggttgcaaccttttggactcatgccgttcggcctaatcgaattatggtagtttcagatacagttgcgaaggataaccttagaaagacgttaattacacaggtagcaccgcctggtgttcgggcaaacgtggtcaccgtcaataagatgattcgggcatattttgattctcgctttgattcattcaatacattgttgcttactgagaatgttggcgacatggttcgattagcagaaggtggcattgatttttctaaaatcggtatcaatattggtagtgtggcttacgcggatggtatgacaatggtgactgaagcgattgccatgaaccctgaaattgccaagcaggtccgaattttgacccaagactttcatttgaatgtttacgcacaaaaagttcctgctgaaaagaaaattgagatgaccggtctgctggaaaagaagaatttttgatttatttcgagggtagaaaatgagtataatttcgacaattttaattttaatcattgcatttgttgtcggaatggacggcatcttggatgagtggcaagtttatcagccaattattgcttgtacacttattggtattgcgacgggtcatcttgtgagtggtatcttacttggcggtacactccagatgattatgattggttggatgaatgtgggtgcggcggtcgcaccggatattgcgttaccagcggttatttcggcgctactagtctgtggcccggtagctttgaccatcaaacacgggattgcattaaccattccagtggcagtgattgggcaacttttaaatgttgctatccgaaaatcaattgttaaagttgtccatcgtgcggatgaggcggctaatgaaggcaacctttccaaaatgaatcgaatgcacttaattagtcttagtattcagggattgagggtattaattccaactgcactggtgttggtggttaacccagtttacattcagtggttgttcaatcaagttccagctggtgtcaccaatgggattgcagcgtcaattgggatgatttcagccgtcgggtttgccattattattaatatgatggcagatcatacattgtggatttggttaggtatcggcttcctgattgccgcgtttagcaatcttggtatttttacgttagcacttattggcgcgtttttaacacttctttatttgtggttggtaaacaagcaccagcgctcaaaaccagagaatggtggcaatgatgacatggatgactttgataaagaattagatgatttgtagaaagttggggctcagcgatggtcaaacaaattcatgatcagtcaagcaggaaaccaagaaaggttgaactccgaccatctgactttatcagtattttttggcgttccagttttgaacaagcttcatggaattatgaacgaatgcaaaatttaggctttgcttatattatgtcaccggcgattaaacgattatatccaaataaaagtgaccggatttctgcaatgaaacggcatcttctattttttaatacgtcaccaattatgcaatcactggtgaccggggttgttttatcaatggaagagcagcgagctaatggtggtgacgtagatgacactgaaattaatgctgttaaaacggctatgatgggtcctttaggtggcattggcgatccgctatggtctgggaccgttcggccggttttgtccgcatttgctgcaagtctggtcattggtggttttgggatttatggaccaatcttgttcttcgttgcgtggaattgtgcgcggcttttattccgttatgaagcacaaaagattggctaccaaaatggcactgatattattaattttttcaatacggggattttaaaaaccgtgaccaaggcgacatcaatttttgggatgtttatgatgggcgtaatcgtcgcgcgctgggtcaaagttaacttttcaatcactgatcaattagccgagcaggtaaccaagttatctggtcatttctttggtaaactgattggatctgggatgacagcaatcgctgctattggattaacgttgatttgcatttggttaattcgcagacaaatttcaccaatttggattattattggtttatttatgattgggattattggttatgctagcggcatcttgagtatccaggcttttctagtttaaatccgatggaattgttttaaatcatgagcttaactgtctcaagccttgaaaattgaatattgttcatgaatcaaaaacagagtgggccagcaagtggatagatcctagaatataagtcccctaacttgatatttccaattttggaatgttaagttagggggcttttatgaccggagtctgcttgttggcccacgttttttaactaagtaaaaagtttaacgagatattccggatttgaatagttggataattcgatgacacggctgaaagctgcctttatcccgcgtttttgcttggtaataatcgtgattaaccaaaatgggctggacaaaattacttttgtccagcccatttttggatatgtttagatcatctgcgagtagtgctgttaatagccgtagcccgtcgaagatgatgattgttgtgtagttgtttgatccgaataaccggtagaggtaccactataatcagaatcagtttgcgtttgttgtgcttggagttttgttgatttagacaggccaagcgttgcccgaatatcattggaaacctttaacaattcactgttagggacaacttgataggacaagccatcaatcattgcatcttggccttgaagcgtctgcgatttaatgtgatgggttgcatcaccatatttagctcgaactgcgatcatatcatcaaaggtcatgtcggtcttcatattgccggtaagtgacgataagattgccttatatctaggaagtgaagaaatgtttaagcccttcattactaaatgtttgataatttgtcgctgacgagcctgtctgccgtaatcgccaagaggatcatcgtcacgcattctggcataatccaatgcttgcttcccgttcaagtgaaccttcttgcccttcacaacatttgcatgaccgtattggaaggtcaaaggaggcttgacgtcaacaccaccaacagcgttgaccattgtttccattccgcccatgttgataatcgcatagaaatcaattggaatatccaatagattttggacagttttaaccgcggttccagcaccaccaatcgtataagctgcgttgatcttttcataagcctgtgtatcaccaggaacgacaactttggtatcacgggcaatacttgtcagatgaatggtttgcttcttaggattgatggtggcaacaatcatagtatcagttcggccggtatcgtgacgtcccagtgcaccagtatcagttcctagtaggagaatcgaaagtggcttcccttgttggataaccttcgacacatttcgagctttctggacatgtgttgaatcgaaagtttgggtaaaagtctttttagcacttttataagcgccatatccccaaatgagtccgccaccaatgattagtagtaaaatagcaaaaatactccaaccaataatcctacgtttacgtctgttcttctttttataatgcggctttttgtccgcccgtcttgaatagacaggttcaaaatcccgcttcttgtctgatggcatattaactcctcatttacaaaaattcttacaaaagtatattgcacttttgaaggtggttgcgaaaatatccggttatttaaacataatttaacaattcccgctgatatttgaaatagttgaaataaatgtccatgaaagattatagcaaactgtggattctaattgtgttataatgtgacattgttattgtttttttagaattggggaattgttatggaagtatttgagcaggctgtatccggggttctgattattttgatcatcattgcccttggatttattttagcgagaaatgattggtttgacagtaagatgacaagcatgatcgcgcggctggttactcagattgcgctacctgcttatatggtttcaacaattgtcagaaaatttaaagcggatcagttgttgaaaaccttacctgatcttgtttttcctgttatttcaatgttcttgctatatattatttcaattatcattgttaaagtgtgtcgaattcctaagatgcacgcagggttatttgaatctatgttttccaactccaacacggtttttgttggtttaccggttaatatggcgttgtttggccctcatagtttaccattcgtgttggtttattatatggctaacacgacgttcttttggacgcttggcgtctatttaattagaaaagacgggtcacaacagggatcatttagtttaaagacagtattcaaaaaggtcttttcgccaccactgcttggatttatggtgggggttttgcttgtcctttggcatgttaagctaccacaatttatcatgcaggacttcgattatgttggtaatttaacgattccgctgtcaatgatctttattggtatttcaattaacagtgttgatctgtcaaatgttcattttgaccgaagcaactttttaattttgtttggtcgctttctcctagcaccaacattgatgtcgttgctggttattccaacaccaatgccattgttgatgaaacaagtttttatcatgcagtcagcaatgccaatcatgacaaatgcaccggttgtctctcgtttgtatcatgcagattcggaatatgcgtcaattatggttgctgaaacaaccttgttaagtttgattgttattccggtcttgatggtgttggttcaacagttttaggctggtaaattcactcaggaggcctttgattcatagaaaaaattctgttaacataatcattattgttgctgcaaagcatgaactgaatgaaagtgaaaagaagatgaaaatttgtcaacgctggttataatgcgtcatggcgagagccaagcaaatcgggataatatttttactggctggagtgatgttgcgctcaccgagaagggggttgcacaggctcacacagcggggcagattattcaggcctctggtttgcaattcgatgatgttcatacgtcatttttgaagcgagcgattatgacaacaaacatcgttcttgatgaaattggtcagaactacataccggaacataaatcctggcgattgaacgaacgtcattacggcggtttgcggggaaaaaataaactggctgttaaggaaaaagtcggtgccaaacaattaaaaatttggcgccgaagttttaacgttgtgccgcctttgctaaaagttagggatgaagattctcgctatgatcgttatggtgtcaaaattcccttaggcgaaagcttagaaatggcgcaagagcggttaattccgtattggactgatcaaattgcgccacggttgttagacggcaaaaatcaattaatagtggctcatggtagtacgttacgggcacttatcaagtttctggaaaatatttctgatgaggatatcccagaaattgaagtcccaaacggaaaaccaatccgctacgattttgatcagcatttaacgattcttaacaaacaatttatgagtgaataagtttgtctgttggttatatttaaatgatccgcaaaatttatggttaataaaaaagatatccagcatcgccgttgcgcgtgctgaatatcttttttaaatcctaattgaatatttaaatgtaacgctaagctaatgcacccattggatcccatggctttaaaacgattggttcctgggcttgatccttcagttgctgctcagttagatactttttattgatcacgaattgataaacaaattgatccaaccagtcgtcactcatgacaaagtatcctttagtcccaactttttcaccccagctgttttcaaccttccacttagttggcttgccattaactaaatcaacgcctgtaatgaccattgcgtgggtcattaaactttcggcataatcaagtcgttcagctttggaaagggataggtctgtagcaaataattcgtctggaacgtacaaatctgtatccataattccttttttagtgtttgaactttgaccaacgtcactaccaaaccaaacggattcgccattttgtaattgtttgatggccaattttttgagttcagccatttctaagttcaagtgcttaaccggtcgaccattaacaacattacccagcatttcgatggtgtatgttttgttaaagggtttgtcatcagttggcgagttgatcaatgagacatagtcttcaagatttaagttaacgtatttcttgaaaaattcttgaggcgtgatgttttgatcaatgtgataatttttatctttatctcgatactcgaagtcaaacttggtagcgggttcgccgagtgcataggttaacattcggtaaatttcgtttaacattgtttccttagtttcagcaatctttttatcagaagccttatcagcaaccaattcacgtagtgcaacggcgtcatgacgcaattttaaattcaggtatttatttagttgacctgatttttcactgttaaaagtttctggcattgcagactttggaacgattccatatttttcaataagggcacaaagcatatcccattgaccaccgtcctgttgtggtgttgtcatgagccacgataccttgcgtgaatccagtggtttattagccgttttgaggacattttccaaaaaatagttagacttttcgaatttatcccaaaagttggtgtagttttgagaaagttcaaaatcatcagctaccttgtaggtgttcattagatgaattcgcattgtgttcaaggctgcgaacatccaacaacggccactttgcttttggtcagctacttttccagttgaaagatcgatagaaaagacaggttccattttgctttctgcatcgaagtcttcactgcttgctaagattccttgatgagaaacggctcgttggattactttagaatctttacgattgtctaaatcttgttgaaacttgccaagttgatctaaattaatttctgctgtcaaaaataatcactctccttaatgacttattattttactctcatttatgagaaagaaccagtaagagtagtgtgatacgcgaaggaacttttgaaatttccaagaagtttccggcacgcactttttttgccccgagataaacaccaaggagaggctgagacaatcatcattttgtggtctctgttagtgtaaaaatgatgattaccgagaaaaaatgcgggaaaaaaggcaacttccggccgttcaatcgaattatccgaatattctgaacttaaatatttggatatttcgattgaacggctggaagttaagcgccttttttcccgctctgatttagtttgttgattaaattaacgtgcgtgtaaaacttgtggaccagtttctctgccaacaatgacagtattaacaatgtttaaaaataaaccatgttcaacaattccagtcatttgatccaggtccaacgctaatgatttcggatcatcaatctgatgcatatgcaggtcgatgatgtaattgttggaatcagttgtgacatgcttgtctgctgccattcgaaactctggctgataacctttttcttttaatcgtttaaaaagctgaatgctaccataaggaatgacttccaaaggaagtgggaaagtgcccagctggtcagccatcttgctctcgtcaacaatccacatattcttatcggaattaattgcaacgatcttttcccataggtgggcggcgccgccacccttaataccttgaaaatgtttatcaatttgatcggcaccatcaatcgttaaatcgatgtgatcgacctcgtcaacccccttggtcgggatgccaagacgattggcctgttggcgggttctttctgatgttggaacaccaatgattgataagtgttcatcagttactcgttgtcctaaagcatccaccataaatttgacggtcgaaccggttccaagaccaacaaccatattatctttgatgaatttaaccgcttctttgccaaccaattgttttagttcgtcttgatgtgtcatttgtttatcctttcaatttcaaaagttgcttaaaggttttactaacatttattttgcgtgtttttagctaatttgtcaatctattcaaaccggctcacatgagttatactatttaactattaagaatcgaattggaaatgtcgttatgaactggcttgtactatttgattgcaaatatttttttattatgaggagagatttatcgtgaaacgtggatttgaaattgtttcgaagtacgaaaataaagaactaacagttccttacaggacaactaatcacgctgcgggatatgattttgaaagcgccgttgatatggtcattccatcaatttggaaattaaattttttgaaaatcttatgggctgttaaacatgaaaagaagattaatcaagaatcattagcaaaagcgcgggcggttttaaaacccttcttgattccgactgggattaaggcatatatgcaacctagtgaagtcttaatcattgcgaatcggtcaagcaacccattaaaacggggattaaccattccaaatgggattggcgtgatcgatgctgattactacaacaacgccggcaacgaaggtgaaatttttgttcaaatccttaactttggaatcgatgatatcacgatttcgaagggggaccgaattgcacagggaatttttatgccctatctgctcgccgaccaagacgatggttccaaagccaaaacgcgaaatggcggttttggctcttctggaaaataaagtataagaagccttaaaatctggtccgaaccaattcaatactatcgattaagtgctaaaatatgactaatattagtgagaaggagaattttattggctaaagttaaaactcaatttgtatgtcaaaactgcggctatatttcacctagatatttgggacgctgtccgaattgtaacgagtggaataccttagtagaagagacaattacaccaaaacccagtagtgcctctaatactttgcgtcgaactggtattcatgataatcagcctgagccgattgatcaggttaaatttcagagtgagaaccgtttcaagacaaaaatggaggaacttaaccgggttttaggcggtggggtagtgccaggatccttaatcttaatcggtggtgatcctggaattggaaagtccacattgatgttgcaattgtccggtgaactaagtcagtctggtaagattctttatgtttccggtgaggagagtgccagccaaattaaaatgcgtgctaatcgacttggtgtcagtggcggtcaactttacgtttatccagaaacggatatggatgttattaaaagtacaattagtgaaatgaaaccggatgcggttgtcattgattctgtgcagaccatgcaaataccagaattacagtcagctaccggatcagttgcacagataagagaagtaactgctgatctaatgaatgttgccaagggacagggcgttacggtgtttgtggttggtcatgtgactaagggtggtgcaattgccgggcctaaaatattggaacatatggttgatacggttctttattttgaaggcgaccttcatcattcatatcgaattctgcgaacagtgaagaaccggtttggttcaacaaatgagctgggcgtttttgaaatgcggacagatggccttcatgaagtcaccaatccttcagagatttttcttgaagagcgattgaaggatgcaaccggttctgcaattgtggtttcgatggaggggactcggccaattttagttgaaattcaggcgttggtgacggcatctgtttttggaaatgcacagcgaacggcaactggacttgaccgaaatcgagtttcgctaattatggcagttcttgaaaaacgcgctggtttgatgctccagaatcaagatgcttatttaaaagctgctggtggtgttaaactggatgagcccgcaattgatttggcgattgcagttagtattgcctcatcgtacaagaatcgtgggacaagtccaactgaatgttatgttggcgaacttggattgacgggtgaagtccgtcgggttacccggatcgaacaacgtgtctccgaggcacaaaaacttgggtttaagcgggtattggttcctgcaaataaccttcaaggatggacgccaccaaagggaattcaagtagtaggtgtttcaacattgtcacaagcgttgaaattagctttgggttaaattaattttgaaagaaggcgataagagtgaaacgaaaacgaattgttcaaattgtttttacattagctggtgctgcaattggggctagctattttccattgctttggttgatccttcaagttagatatggcacagtcttcaacaataccctgacaaacgcgatttttggtgcaattattttttatattatttcgttgatggctggaaactatgttttgaagttgaccgaccgaattgaggcaaggctaacgagtcaaagcccattgcagctagtttttggaacgttggggttaattattggtctggttctggcagttctggtttcaattgtgttctttaggacaaatacatttttcttgaacacaatgattccaattattttaatgttaattcttggatattttggtttcagactcggagcgactcagagtgaccggtggcgaaaaatgtttcaatttcggcgccgttcggaatctgcaccaaaagcagccgaggaaaagattattgataagccggttgataagaactatcatcactataaaattctcgataccaacattttgattgatggtcgaatttatgatgttgttaagaccggctttatcgagggcacattgttggttccaaagtttgttttgtacgaacttcaatacattgccgattcaagcgacagtgtcaaacgagtccgtggccggcgaggtttggatatcttaaataaattacaaagtgaagacttaattcccattgagatgtcggataaagattatgatgatatttctgaggttgacacaaaattgattgcgttggccaaagacgttaatggggttattataacgaatgattataatttaaataaagtcattcagttccaaaacgttcaggtctttaatatcaatgcgttggctaattcgttgcggcagaaaattttgcccggtcagcagctaaacgtgatggtcgttaaaaacggaactgaacgtcaacagggagttgcataccttgatgatggaacaatggtagttgtggaagatggccgctacttcctaaatgatcatatcgatgttgtggttaccagtgccattcaaacagatgccggcaagatgatcttcgcccggcctgaacactccactaaaaatatttcggaaaataatgaagaaagcgacagtaagcgtaataagccgaaaaatggtcgaactgctaagtagctaaaaatcttttttacttctttccagttaatcacgctgatggttcaaaaaacgaggtaggccaatttggtcaacctcgttttttgaaccatgtggataaaggtcaagtaagaggtagttttcaactcagttatcttggatacctttatttttcccgcacttcattgtaaactgaagacactgccgaaatttgtttaaaattttggaataattataagaaagaggcgtttgactttggcaaacaatgcaattcgagttcgttatgcaccaagtccaactggccacttgcatatcggaaatgcacggacagccatttttaattatttatttgcacgacacaataaaggaaagttcattatccggattgaagatacggatacgaaacgaaacgttgccgacggtgaaaaaagccaacttgaaaatctcaagtggcttggtttggattgggacgagggtcctgatgtcggtggcgattatggtccatatcgtcaatcagaacgaaaagatatctataccccccttatccagcagttattggatgaaggtaaggcgtacgagtcttatcgaactgaagaacaattgcaagccgaccgtgaagctcaaaaagctcgtggtgagatgcctcattatgaatatgaatacgaaggaatgagtaacgaagaaaagcaacaagccatcgctgatgcaaaagcaaaaggtttgaagccggttattcgttttcgggttcctaagaatcgtgattatgcttgggatgatatcgttaaaggaaaggtttcctttaattctgatacaattggtggcgattttgtcattgccaaacgtgatggcatgccgacttataattttgcggttgtcgttgatgaccataagatgaagatcagccatgttttccgtggtgatgatcacgttgccaatacccctaaacaattgatgatctatgaggcctttgggtggcaagcacctaggtttggtcacatgagcttaattatcagtgctgatactggcaaaaagcttagtaagcgagatgaatcggttcttcagtttattgaacaatatcgtaatcttggttatttacccgatgccatgtttaactttatcttgttacttggctggtcaccagttggtgaggatgaaatcttcaataagaaacaattcattaaaatgtatgatgaaaagcgactcagtaagtcacctgctaaatttgattcaaagaagttggaatggattaataaccaatacgtaaaagctgctgatgatagtacaattatggacttagctttgcgtcaattgattaagggaggtaacatcccggaaaatccagacaataagacaatcgaatgggctcgtcagctaattaacctttacaaacgtgaaatgagttatatggctcaaatcaatgacatggcttctgtatttttccaagaaccggaagaagtttcgggcgatgcgttagatgagatttctaacgagacggcaccagttgttttgaaagaatttcttaatcggatccaagaactgccaatgtttgattcggttgaggtcttaaagacaatcaaggccattcagaaggatactggtattaagggacgcaagttatggatgccaatccgaattgcggttacacatgaaatgcacggaccagaattgcctgaatcggttgaattggttggtaagcaaagggcgattcaacatattaatcagactttaaaacaaatcgataaagattaaatgataaaaaatatttttaagttaattggtctcgttgaaatttcggcgagaccttttattatagtttatggttatattgaaaaataacttgaaaattatgctatgatttcattatataagacgtaaagagaggaattcgaaatgttgcagatatttaatacgctcacccgaaaaaaagaaaaattcgaacccgttaccccaggcgttgttaatatgtatgtctgtggtccaactgtctacaattacattcacattggtaatgctagaagtgcaattgcctttgatactgttcgtcgataccttgagtatcgggggtataaagttaattacgtttcgaattttacagatgttgatgataagatgattaatgctgctcgtgaaaataatacaaccgttggcgccattgctgataaatatattcacgccttcatgcaggatactgctgcattaaatatttccaaagatgttgttcatccacgagcaacccagaacattccagagattatcaatttcgttaagacgcttgttgataaaggctatggttacaatgttgacggtaacgtttattttcgggctcgcaaatttccaacatatggtgccttaccacacatcaatgtcgaccagttggaagttggtgccagtcagcatatttctaaggaggaattggctcaaaaggaggatccgattgattttgcgctttggaaaaaatccaagggtgatgagatttcgtgggattcgccttggggaaagggccgaccgggttggcacatcgaatgctcggtaatgtcgacaaaataccttggtaaaacacttgatattcacggtggcggcgaagatttaattttcccacatcatgaaaatgaacgtgctcaaagtgaagccaacaccggccagacatttgttcggtactggatgcataatggatttgttacggttggtgatgataacgaaaaaatgagtaagtcacttggcaatttcattactgttcatgatttgttaaagaaagtcgacggtcaggtaattcgcttattgatgtcaacaacgcattatcgccgaccaattcaatataatacggcaagtgttcaggaagccagcagtaatttaaagaagctacagacagcctttaataatttgacgtatcgcttgcataatgccgaagaaggtgacgatcccaagactgatcaggaagtccgccagattgttgctgattttactgatgcgatggatgatgattttaatgttcaaaatgggattgcggcagtgtatgaacttgctaaatttgcaaatatgtatgttgaacgtcaggtcgtttttaaactcagtctgcagttcattatcaatactttgaaacagttagctggaatttttggaattaaacttgaacaaagtgagcttaaagatgatgaaatttgggcattgattaatgcacgtgaaaaagcgcgtcatgataaagactttattcgaagtgatgaaattcgtgaagaattaaaagcccgggggatcattcttgaagatacacctcagggaactcggtttagaaaggaatagttggatttatgactaacaatttcacacagcttaacggaattgcgcttgcgtacatgggggatgcggcctatgaggtttttattcgccgtcatcttattaatcaagggttgactaaaccaacgcggttgcagcatgctgctacaaactatgtttcagcaaaagctcaggcagcattaattgatttgatgaaacaaaatgacttactgaacgatgaggaatgggaatactttaaacgtggtcgaaatgccaaaagtcatactcatgccaaaaatactgacgtgattacttatcgaatttcgactgggtttgaagcggtttttggttatcttagtttaagtgatcagacggatcggatgatcgaaattgctaactggtgtattaaccaagtagaaagtgggaaccttaaacatgaagaatgatcaagaaaacgaagaatttgtcatcggtcgtcatccggttgttgcagcattgaagagcaataatcccgttaataaattatttattcaaacaggcattaaagatgatgataatattgtttcagaaattttaaaattagcgcacaaaaaacgcttagtgatttccaaagttcccaagcaaaaattggacaaattatcggataatcaaaaccatcaaggcgtagttctatcaatagctgcatttagatatgccagcattgacgaattgtttgagaatgcaaaaaaggttggaacagcaccattttttgttatcctggataatattgaagacccacataacttgggatcaattattcgaaccgcggatgcagctggcgtaacgggagttattattcccaaacaccgtgctgtcggtctgactgcaacagttgccaaaacttctgccggcgcaattgaacgggtaccggtggctagagtaaccaatttgtctgccacggttaaggaattgaaagatcgcggtatgtggatttttgggaccgatattgcaggaactgattatcgtaaatgggacgcaagtggttctgttgcagttattattggtaatgagggaaagggaatttctccattattaaagaaacaagtagatgagatgctgacgattccaatgattggcgatattcaaagccttaatgccagtgttgcagccagtgttctgatttatcaaggctttaattcccgtcatcctttaggaaagtgaaaaatggtgatggtaaatgaaagaggatttattaattgttgatgcgtataatatgattggcaattggccgcacctcaacaaattaaaacaggctgatcggcttgaagatgcccgcgatgagttgctcgcggaattatcggagtataaaaagtatcgtgacattaacatgattgttgtttttgatgcaatgtatgttccgggaaatgccaagagttttcgcaaatttgacatggaaattgtctggacaagcaaggaccaaacggctgatagttacattgaggcgttatctcggaaaaagcaaaatcgatttactcaggtgattgttgcgacgagtgatcaagcggaacaatggacaattttttcggcgggagcgttgcggattccagcccgtgagctactgagtaatattcgccgtgcaaagcaggaagtgaatgcggaagctaggaaaatgaccgataaatcggcggttatccgacatacaccttgggattcaaaacaaatgcttgaacttgaaaagcttcgggataaattgacccatgacgggaaataatattagtaaaaatattagatatctaatattttccaattggtatagttaagctcgtttttagctgaacgccggttcccttgtgactatcatgcaccttttgtaatgtatttttcatgagttttcagaaaatacatgacatgaggagaatttagcatgacaggaacaagcaaacaggaatttaaactaatttgttcagtagccatggggaatggagacgattttatcgtccttttcagaaagtatcaccccatcctatctaaaatgaaacgccggtattttgttccggggtatgatgaagacgatcttgatcaagaagccggaattgtgcttcttcgttcagccaaatattttaaaaaaacacgtgaagttagctttgggacatactatagcaagaacttaagaaatcgcgtaattgacttaattcgcttaaacaatgcagaaaaacgaaagccagctgagccgcttaaatccgttgaagaaaacgccgactattattccgcaacggtaatggatcctaccgcggcaagtccagaacattcggcgattgttggtgaaagtctacagcaactgtatcttaattgttctgttaatgaaaaacaggcaatgcattttatgttatcttcagatggtaagcttactcttgatgatcctaaacgccgggcaatttatagtgcttttgaacgatgcaagtggaaatataaaaataagataaattgactgaatgcatttagaatgctagaattactatgcttgttaggaggtgccgccatggcacaaagaaaagttgctttagcctgctcggtttgtggatcaagaaactacacgattcccgaaaatcctaatcgaacgaaacgtctagagcttaataagttttgtaaatattgtggtaaatacacgttgcataaagaaactcgttaaaggggatactgacttgagattagtaaattttctaaaaaacgtcgttaaagaaatgaaagttgtgacttggccgaatgcccatgaaactcggcgtgatacaagtacggttcttggtacgtcaatcattatggcaatctttttaggatgcattgattggattgttcagtggggcttgtcgtttcttgcatagccaacttggcaaaaatttgttatagttatgttgttaaaacctgcaaaaagtgtcaggtttttttatttgaattaatttaaagaggagtcgacaaacgatggttgagtcagcagaaaaaaaatggtacgtattacacacttattcaggctacgaaaacaaagttaaattaaacttggatagtcgtaaacaatcaatggggatggaagattatattttccggacagtcgttcctgaagaagaggaacacgaagttaagaatggtaaagataaggttaagatggaaaaaaccttccctggttatgtgcttgttgaaatgatcatgaccgaccagacttggtatattgttcgaaatacaccgggggttactgggtttatcggatctcatggtcaaggaagcaagccaacaccgctattacccgatgaagttgactcaatcttgaagcaggtagggatgagtgccaaacacgaaactcttgatgttaatgttggcgatactgtgaagattgttgatggggcatttactggtcttgacggtaaagttactgaaattgacaacgaaaagatgcgcttgaaggttaatattgaaatgttcggacgtgaaacaagtaccgagctggaatttaatcaagttgataccgttctttaaaatgtgtcatgattgttaagttgctcgagaactgtaaaatgatgaatcttttatcaaattggttattaattaggaagatactaggaaagtttgcagcttaattcaagtgggtgattgagttgattagcgtggttgtgttgggagtcatcctaatttgtttattgtttgttgtgattgtgaagacaattttacttggacgaccgagaagcagtaaaactcagactgttcgatcgacaccgttagatcaggtgccaacgctatttttacctgggtatcttggaaatcgtttctcatttggttttttacaaaatcgattggtttcaaaatttaatgctaataaatcaatggtgattattgttaatcgacatggtaagcttcgggtgattggccagatgaatgattatcggaccatgatccaggtcttatttaaagacaagacttccagaccaaaacaacaggcgatttggctgcttaagatctgccaacttttggaagcggagtaccatgtttccagtgttaatttggttggtcactcgatgggatgcattacgattttttggtacttaactcacgaacaggcaaagtcatcgatttcagttaagcgggttgtcgcgattgctggaccgtttaatgattctgaaattgccaggagtaccccggatgttgatgcctatccatttaatgcgaatgggccggttaaaagaatgccgatttatcgagcgttatctcaaaagatagcggcgattccacctgagataagcgtattgaatatcgcgggtaaaattaatgatgagcagcaaaatgatggtcaagtatctttaaacagtgctttttcattacgatatttattgcagcagcccgcccactattatcgggaggttgtcattcgtggtaagtgggcaactcatcgattgctccatgagaatcggttggttgatgctaatattgccaaatttatttgggacgtttgaaagtttatgttgttagcaaacgctctttgtggtatatttatgtggtatgtttattcatacgaacgtgggaggagaaattttgatctccattaaccacacacggacttaaggaggttatgtctcgtggctaaaaaagtagctaacatcgttaaattgcagattcctgcgggcaaagcaacacctgcccctccagttggtcctgctttaggtcaagcaggtatcaacattatgggctttactaaggaatttaatgctcgtactgctgatcaagcaggaatgattattcctgttgttattacggtttacgaagatcgttcatttgacttcgttaccaagactccacctgctgctgtgttactcaagaaagctgctggtgttcaacacggttctggcgaaccaaacactaacaaggttgcggaagttaccaaagaccaagttaaggaaatcgctgaaactaagatgaaggacctgaacgcagctgacgttgaagcagcaatgcgcatggttgaaggaactgcacgtagtatgggattcactgtcaaagattaattttgacgccatctaagcggaaccaatttaacctaatgcatcgcttgaacgttgcgtgggaggtttatccgttataaccacaaagcaaggaggaaaacacaacatggctcgtaaaagaggtaaaaattataaggcagcccttgaacaagtagacgctggtaaggcatatccagttcaagatgctgtggaattagttaaaaagattgattatgcaaaattcgatgcaactgttgaaattgtatttaatttaaacgttgatactaagcaagctgatcaacaattacgtggtgccgttgttttacctaatggaactggtaaagatcaaacggttatcgtatttgcaaagggtgataaggccaaagatgctgaagcagccggcgcagattttgttggtgaagctgacttagtacaaaaaattcaagatggttggttagattttgatgttgccattgcaacacctgatatgatggctcaagttggtcgtctaggccgagttcttggaccaaaaggtttgatgccaaaccctaagactggcactgttaccatggatgttaccaaggcggttactgaatctaaagccggtaaggttacttatcggactgatcgtgatggtaacgttgctgttccagttggtaaggtttcatttgatactgaaaagttgatcggaaatttgaagacaattgaagatgttattgttaaggcccgtcctgcttcagtacgtggcgtttacgttcaaaacgtttcaatttcaacaactttcggaccaggtgtcaaggttgatcttgaatcattctaatcaagttgattagttagtttctgatttaaataaaaaatccctaattgacgatagatcattaaatgtggtatattgttaattgctgatatatacgcctaagactcaggtggctattgccttaatatcctgccgaggaaagaatcttatttcctatgtctaggtatggcatagggattttttttaaatcccgaacgaaaattttgggaggtgaaattcgtgagtgaacaaactgttgctgttaaagcaaaaaaggttgaagaagttactgagagcttaaagagtgcttcatcaatcgtgattattaactaccgtggtttaacggttgctgaagttactgatttgcgtaagcaattacgtgacgaaggcgttaagatggaagttatcaagaataagattatggaccgagctgctaagaatgctggattcgatgacttaaaggatactttcaacggtccgactgctgttgtattttcatcagaagatccaattgccggccctaagatcgtccacaacttcgctaaaactaacgaagcccttaaactaaagggtggcgttattgatggtaaagttgctagtcttgatgaaattacggcctatgctgcattgcctagccgtgaagaattgttatctacgcttgctaatattcttcaagcacctgttcgtaactttgcatacggtgttaaagcaattgctgataagaaatctgacgatggcgacgctgcctagtcacaataaaataattccaattataaatggaggaaaatataatggcttttgataaagataatattattgatcaattaaaagatgcttcaattactgaccttaacgaccttgttaagtcaattgaagacgaattcggtgtctcagctgccgcaccagttgctgcagcaggtgctgctggcggtgacgatgctaagaaggattcatacgatgttgaattaactgaatctggtgaccaaaaggttaaagccatcaaggctgttcgtgaaatcactggtcttggtttgaaggatgctaagggtcttgttgacaaggttccttcaactatcaaggaaggcgtttcagaagacgaagctaacaagatcaaggaaactcttgaggctgttggtggtgtcgtaactcttaagtaatagggttataattagatcaaattaaatcgcttcatatcgacattgactgttgatatgaagcgattttttgtgtcttaaattggatatacgtggaacaaaatagatatttttgtggtaactttgcggaacatcttgtattttggctgttttgtaccacaaaatcttcgtagttgctggtctatcaatcattctggccattctttttaaaaagaacgtcttgcatgccattaattacctttaggctgccttgtctagtaggccgggtataggaattggtcatatcgagcgaagagtgtcttagccattgcataacgtcagtgggagatagattaagcgaacgtgccatggtggcaaagtaatgacgcagcaaatggggatagacatgaattccacatgcctcttctactttttttgaacaatcgatttggatactgtatataaactggcattccagactgttcatttaaaaataagaaaccgtcatcttttaagacgtgtccagttcgttgacaaatgtttttggaatattgaattgaaaattttaatagatctaccatttcaccactgacgtaattttgacggtaacttgactggtttttaagcggtccacccaaggtctcaactcgatttcgaccgaagttataagtgatctcacaaatttcctgattattttgtgtaaaaaatctgaacgaattgtaccgcaagccgattacttcttcacgtcgtgctcccatggcacagagataaaccaaagttaaatagtatttattgagaattttcttagctgtatccataaatgtttggtattgttccggttccaattgcgccgactttttggttggtgcaccttcaatgacgattgtcttcaatcgatttttgtcaatcacatcatttagtgctgcacgattcatcaataattggacaattgagttgatagatttgatagttgtgtagccaccaaattatcaataaagttttgataagtaactcgagtaatttcagacattggcacatttctaaaaacaggtttaacctgctttttccaataagtttctttctgggcaactgtttcagggcgccacttaccaacttcaattgctcttttctttgtctgctcatagtattgtcctaaagttactttacgtttagtaagagtattgttaccgcccttgtcaactgttgtttgcgctcgcctaagaattacttcagcgtcttgccagttaccaaaaccgcttttggtgaactcctgtcgattgtgttcactatcatagtgagtccaccgaacccggtatcgcttaccattttcggtctcatacttgtaaatgtagggatgtcgcttcatctttttataggtgcgcttattatttgccatatcgtcatttccttccaattgtgtattcttaattgatttgtttacaaaatagggcacatatgttctttttgagtgcgaaataaaagcccatcaaaagggctgaaaaaatatgatgttaatatcgaaggctcttcaccatttttaaaaaagacgcacgctgggacattgtcatgagatttatgtcaagactacaaagtattggtaaacaatcaattgtaaaacttgatataaccgtaatggttgagtataaatcttttttcgacaggtccgtaccttcagtaattatctgttgtaggtatacagttgagttatttaaattagaatcttttgagtgtaagttatcagacttttctttgaaaatattgttaattttgtccaagaattttttaactttagaatcttttttatatagcgatgttaatttaattccatccttccaaagttgtcgataatttaattttgacaattttttagaagtaatagagcgattaaaagtttttgcatagactatttttaacaattcttctgatagttgtctaaaacaggcagagataaacaagtcttcgcatgtaggaatcgcataaagtaatcttagaattgatatttgagctttctttgattgagtacgaacagccaaagagttatccacatcgtagtcggaaattactctaaaaatagttaacatttgaaatataaggagtagctgcttattctggaaatggttcaaaatatatgagtctcgaaaaaatgttttgcaaaagttcttgtattcagtaatttcacttctgtaaatattatttatcattttctattaaaccgctcaaagagttcatcaacagagttaggacgattgctatttgtcttcttttttgaaatgggtttgttatcttggagtataagtgaagagtaactcttttctaagattgaaagggaatgggcatcagcgttctgtataatacgtattattctcgaaattattaaagaacgacttttataaacatagtcttttagtaccaatgtctgatttttgcgaaggggatactccttttccagatcagtcaataagggtgttagaaaatcttttaaatcaatgtttaatttaaagagttttgttgatagaagtaaggtcgcatatcctgaatagagtagtgatcttttatactcaatgtcgttagtttttgctatattctgaacatttctttttagaatgtcagtctcattcatattttttcaccctctcttgaaattccttaactagttgattaaggttcggcttagatgtcttttcagcatttgaggcatctataaaatagccaatgtcgctttgtaggtatgggttgtgtaggaatcttgttttaaaaataccaattccactatttttaagagttttgctagaagtaatgtcttgaatcagatttttaatacccgttgatggtttagagttaatatcggttaaaattattcctaaattatgtaacggttgttgtttaaagaatatacggttatcgtcaacgatcgttttaacaactttattcaacatgtttatacctaaaatcgaatatgcttcgggttttactggaacaacgtagaaatcactgggtttcaatgctgcaactgtatacgaagaatatgtgggaggacaatctattaagatataatcaaacaatgaacgtaaattttgtgtgtcaatgaaattataaattccgttttcaagttgtgcactatttaggtttcttgtcgtgaattcaattccaagttcgccgggaataatacttaggttactatcaggaaacgtcaaaacgcaatcatctaaattggcagggaaacttgaatttccttcaaatactttctttattgacgccgttgacactttggtgtttttaaaatttacatcttcattttcgaaatctatgtcggtattatcatactgcttttttaatttttgagcaatttctgctgattgtgcatagttaaaatatttaaaaatagattgcgtcaagtttatttgtggatctacgtcaattagtagtacttttttaccgagcgaattggtaagtcgaaaaccaatttccttggtcaaagtagttttaccaactccacctttcatgttgataaaagatataaccttagcattatgtaaaactttttctgaaccagccattgttaaatccctccaatatttttatattattcacaattgatttcagaagtttgttattagattccaacttttatagtcatcagtatttagactaagttccccgatgggagttgaacctatcgttggcaccagtggggaaggtgaggtgaaactgtaactaataaatcgaatgacctaagtatccttgtctgtaaaattcaaatctatttgttgcgcgcccttacggtgctctaagacttttaggatcttgtaattactttttaaggaaccatctttatcaacaaattgttgcgtttcaagtgttactttcagaatatctgttgatccaaactgttgaatattccgtttaacggatttcaaaaaatctgtatcgagtatttccgcaaaaaactgattgccacctgatgagaacttccatttgccatgttcaaatgcaacgtttatgatttgaagatattgcgtagttacggaagaatctaactctttagatgtagcagcaggaaccttaaagtcttcatagttttcctcagtgatcgtaattccttgttcttcagaatgatggaattgaatcgaactaattccgtcttctttcaaaggatcgacgacttcttttatatttttcctaatctccaaattttgataggcatcaagaacttttttaggaatggcgattttagtctgatcgtctaatgtaatttcaatctttccatcgttgagctcttttttacttttaagtttatgtttagccaattgaagtattgtattaataagcaatataaagatttccacgtagtcctttaaatttaaaaaagcattggaatctgaattgtttaaaagtgaaactactttttgaagaagatcgtttccacttgttaaaactaagtccacaataaaagaacctttttcggttgcttgaatgtccaatgaaatgggggcttctagtgggttatttagtttttgtatgttttgaaaggtttctgataaagccaagagtgaaggggcgaggtcacgaatcggtatccgattttcttcgagagcttcaccagcgtaatggactgaaaaatcatattttgccatgttgccgcctcctttctaattagtatactgcaaacaggttctccatttacggttattaataatccattttagtggctgataccgtagcaagtgataagactgtgattccaataatgcttttttatgttcatagttattttccttagtttcattaataagccttatggtacagattaggaaacggcgtacttgaagttgaactgctaccatctatataaatttttattagcccatgtctgacttttttaatagtcatacgacggtcgacgccatagtcgcccgggcatgctccgtgaatcgaatatgcgtgttttccaacttttcgccagtaagtattttttaaatatgtcggtgctgattgtgtgaaaccagctataactgaatgtgattttgccttaaatgttgcgtgatgtgaagattccatatacggtagaaagacatttcgtgtgcgccaagtccctctgacagctgttggcgttccgtcccaccaggagtgtgctgacacatttgatggggtagtaaatactccaatagttcctaatgacaatgctgtaatacccaataaaattgattttctaaatttcatatttatatctccttaaaattctgatcatatttttaatgaactttgacgtaatcaacaatgatatcagactttagttttttaccatttaatgtaacagtgtcagttagaccagatccctttacagtgattgtgtcgccctcgtgaatagggtgggctttcattgtatcaatatctatcgcggtaacggttccgtgaccatcagacattccggatgttgtgtattcatctgttggaacgatcacaacgtaatacatattgttatcatcaggattcttttggatataaataacagttccagttattgaaatgaatttttcgtcatacttaattgggtcattgagaataataatcggttcccgtccatcgtaacttgtatcgccaaggggatattttcctaaaggcataaagtaccaatccacatttaatttgtcagcgattgcaaatggatcggctgtgttataacgggagatcatagtttcaatggttcttttggcgtaactattcgtgcttatgtcgtttccagaagatagtttccattgccactcgcaattgttgtttttcatcattggttaactcttcacccccataagtcattgaattagcattattttcaagaaacttttgaagatctcgtcgatctttatcagttgcccaatttgggacactgccatttcttgagaaagtattgccaagaagatagtcgacagatgcattaaaatacttcgcaagacgattaagggtatcgtaatctggctgtcgtttaccttgttcataagcagaatatgttgtttttgcaattccaatttgtttagcaaccatttcttgggttaaacctttcttttcctttcgaagctgtttaagccgttctgcaaacatttaaagacctccttgaatagtattattatagtatgcggtacgcatattgtgggaataaaataaaaagatacgcgaaaggagtttttttatgttgaccaagtacgcgtaatgtattatatttaattcataaagaaatacgaagcgcgtatttcaggaaagaagcggttccatgtcggaacgaaaatggctaaagcagtatcgagaatatcttagattgtcgcaagatcaaatggctctcaaacttgatgttcctaaatctacgtatacatcgtatgaaagtggctatcggacgctttccgtagatcgggcaaagaagcttgctcctaaaattaatgtttcgtggagtatttttttgaaagcaatatactcgatatgcgtacattagcacgcaaaaagctcatattgactgacttagatgctaaagaggtggctaaatgaagattgcgcaagaagcaagagttcttgacttttaccaaaaaacaactattgagatacaacctggtgaactaaaacaagttatcaagatcaaccagcatggaggtgatatggacacagaggaattagaaaagaagctcggtaaagttttcaatgatttatttaaaaattttgattctggaaaggtgagttaatgaaaaagcttttaagtgatgaagtccaaaaagaaatttaggaaagaatcattgatttacttgtaacaaaaaagtgtactcttgccgactttgaaagggtatcggaaaaagtacaccaattttacaaagacaatgcagtcataaacgcgactacatccattcgaaagaatactgagaacctgagccaccatcatcaacaatcaagtaccaccggccaggaccatccacagtgattttgacagggctttgattgtaattcccaccaaaatactcaaaagactctccgcgttggtagcggttaaagttattttgatcaagcaaataaacatcagcagcatattgaagatctttaacaatgactgataatgagccatcttgattgtcagcatatggaacagacatagttaccaccacctttaatggaataacttaattatcccactaaaaggtgacgaaggaattcaaatttcaaagaacgaaaggaatgatttagatgaatgaattgattaagactttcaagcaaaaagatggttctgttaccgttgatgggcgtgatttgcatgactttttagatgttgccaccccatacactaagtggattgaacgaatgatggaatacggatttatcgaaaacgttgattttttcgtgtttgacaaaaatgtccgtgacgagaccgtttttggaaacaaacgaagaattaaagatcacgccttggctttggatatggcaaaggaattatcaatgattcaaagaaccgacaaaggcaagcaggctcgccaatattttatttcaatggaaaggagagctaagcaagtcacagcatagaaaaaccattgttgcccttctattttttaactatccattgctgccgtaatttgatgggagaaagtgttatgtgatcatatcctttataggatgctagagggtgtttggtataatcggatgaaaggagcaaattatcattaccgagttgcaatgcgaataagccactattagtttgctgagatattaactctaatatatcttggtaagactttttcattaattctcttatatatttgcacggtaccgaattgagatcaccagttgcaataagaaaatcggttctagtattgcttttcaatacggatttgaaacattgaagattggtagtctggatcccatattttttattcttttgatgaaaagttacgctttcaaacttgtccttggtgagtttacgtatatgatttgtacggacggggcaggtattaagtaggactagtttcttgtacacaacattttgagaatgttcttcatttaaacgatttatcagtcgaattagcttatttgtagttcgatctgaatattcgatgttagctcttgcgttagaaggatttttcaacaggacaattaacgtccgtgtattactactcgattgccatttagaaaagattattgataaaatgtagcgaatctcatcattgttttgttgggaaaaattatctttttcaatcggaaaactaatttgaatatcctctggatatttatatttttctttcataatatttgtacctttcatatataaaattagttgcttggatctagcctcagcttttacctataagtatatctctatttagccagttaagttagtgcgacgcggatattaataaaccaacttaaagggcaatcagaagcaatcttttatcaataatacaaatctaatattatcgattatagaggcataaattaacgtgctatatattttatctgcgcctctaaaatgccattttcacatcggtattgatatctttgccttatccactcatcgctaagattaatttgtccttttaggcttccaacatctatccgttgttatccttcccaattcttggcataatggaacaggattatcttttttaaggggaggagattgagttgaaaaagattgtacaatttattgataaacgaatgacgataattaagctcctcttcgtcttttctgttttgatttttgtggtccgccagctagctaaaattattcatcaagttaatggggatcaatttaaaacggtgctggcaagccaatcaaagggcgcattggtgatcatgttagtcctggggtttatttcgatcacgccgatgttgatttatgattattcaatcgtaaaatttttacccggcaaatttgctcccggctacgtgattcgaagtggttgggtggtaaatacttttacaaatttgttaggttttggtggactgttaggcgctagtttacgcgctcatttttatggtcatggggctaccaaaaaacaaattttatatgcgatttccaaagtcgcgttatttttaattgccggattatcacttctttgttttgtttcattaatcatgatttttgggtttggaattggttcgacgtttgcccattactggatttggttattgggtggcgcgatttattttccggcaatgatcatctttaccaaaattaataattcaagcttttttagtgacctgtcaaccaaacaagaaatcattatgacaactgggtcgtttttggaatggtccagtgcgatgggattttttatattaattggctatttgatgggactgccaattaattttgcgattgtaatcccaatctttgtggtagctaacgttgccggggttgtgtcgatgatccctggtggtctggggtcctttgatatttttatcattatcggactggggttcatcggtgttgctcgaagtgatgcgttggtctggatattgctttatcgactcttttattatttattaccatttttggttgggacagctttgtttattcatgatacgggcagtaaaatcaatgcctttttggatgaattaccgcgaatcctgattcaacgaatcgcccaaatctttttgactgtttttatgtatttctccggtatcatgatgctgttatttgccaccgtgccaaatgtcgtgattgtgaaccggttgtatattcgactgattccttactcaatcatttttgtcagccatttagcaaatattgtggtggcatttctactgattgggttagccagtggcctttggggacgaaccaaacgggcattttggccaacagtggttgtgctgatcatttcgattcttgatacatggtttaacgaggcctttacttggcggatgatcacattatttgcggttattttggtcatgctgtggctatcgcgtggcgttctttatcgtgatcgaatggcaaattcctggggggttcttttgtttaatggatcgatctttgttgtaacctttgtcatctacacgttaattggtattgcgactaatcgtcatacgccacttcattttgatgaggcttatttatttccttcagaagcggcatggctggttggatttattgggttaattatcgcaatgttggttttgctgctgatgaatcgttacctaaccgccaagcaaccaaaatggttatctgagccatttaacgctgatcgggtaaaggcagttattgacaaatttggcggcaacgaggacagccatctggctttcttacgggataagagactttacttctatcaagaagatggcgaagatcaggttttctttatgtaccggcaaattgctgataagttattaatcatgggcgacccagttggtaactctgaaaaatttgcgactgcgattgaccaatttatgaccgtggctgacaagcagggacttaagctggttttctatgaaattaatcaagatttaactatgcaacttcatgaaaatgggtttgactttattaaaactggtgaagatggcctagttaatttagctgaatttacgctcagtgggaagcgtcatcgcggtgaacgagcgttgatgaataagttcaaccgggaaggttatcaatttgaaattcttcaaccgccgtttgatgatcagttactaaccaagctccaaaatatttccgatgaatggttggataataaagctgaaaagggattttcactcggattctttgataattattatttaaatcaagcaccgattgctgtcatgaaaaatgctgatggggaaattgttgcgtttgcaaatttaatgccggacggtaaccacatgacgacctccatagatttaatgagatcgtcggctaaagcaccatccggcatcatggacgggatcctgataaatttgtatgatcattctcgtcaacagggatacacctattttgatttggggatgtcgccgctatcaaatgttgggacttccagatttagttttacccaagagcgaattgttcacctgatttatcagtatggctataagatataccgttttgagggacttcgatcgtataagaataaatatgttgatcggtgggaaccaaaatatatcgcgtattatcgggggagttcattggtgtttactgtcctgcagattttaatgattgttaaccggcctagaaatataccacaatctggatttccaaaattgatgtggggaattttagattggcgagaagagtaacctgttggaaaatcacaattaatttcaaaaagatagggtccttaaccccgtattctaattggaatacggggttaaggaccctatctaattgtggtgagctattttgttccaaaagaaacgacggcatttttagcagatggtgcaaagccataataaagtcggtgaccgtgatagttgataagtgacatcttttttccaccaaatcgggggatcggttggtttggttgcaagattccgtataaaaagtcgttaacccgtttatttttaacaatatttgtgagcccatatggtcgattggcttttaaacttgttaaagctgtttctcggtaccctttgatgcggtaaccaccgacagtacgttcacggaattgaatgattaatcgattttgattggtaaacccaacaataatttggtcaccattgtcatcggctgacagagttgtgacactcttcttatcgatttgttgagattgcctctgttgggcgacgtcattcaggatgacctggggatcacgattgtggataagtagataaaggagacttgccccacaaataatcagaagagctaggattgtaagccccgccttccagtgatcaagaatgctgggctttttgtgtactgacttatccatcgtgcaactcccttcgtttatcaaagtgacattggtcatcaagcagaaaccaaattgtcaacttcgcagataattgtcattttacaggttatttttgaattttgtgtgacgattaaatgaaaggaatatgaaaataattattataccgttaactatttagacattaacgtgtgatgaatttgtgtggctaacgcgtggtattgagattcataaaaactatgatgcaaaaagaccatacttaattctcgttcaatattaaagtcggttactggtaattgaattaaggttcggttatctagattgttggaaacaagcgaccggtacaaaaaactgattcccatgttggcagttaacattttgataattgttaacatgtcaccaacggtaatcacctttctaaagtcggcggtattgtagttctgggttcctaaccaatcttcaagaatcgcccgggtcccagaccctttttctcgcaataatagcgggtatttcaaacaatcagtgagggaaacggctggtttttgtgctaacggattgtcaggatggcacaccgccacaaagttgtcattataaatagtgagatgttcaaatttagaaagatcgaagttgccttcaaccaaaccaaattcaatgccaccgtggctaatttggtctagaatttcatcggtgttggcaacaatacaactaatattggcaaattgatcctgaatagattgaattaaatcaggttcaacaatatgattaaatgacaaggtggcgccgaaatgaagatcacgcttaattgacggatgtttaatgtgatcgagaatggcgttactttgaattgtaacttcttcaataaatgaagccagttgttttccggcggtggtaatcaccaagttgggtcgatcatagtgaaccaattcaattttcagttcgttttgaagactggtgatttgttgcgtgactgcgggttgcgtaatgaaaagtttttcagcagttttcgtataggagttggtttgaacgagagtcagaaatgtttgatatcggcggtctagcaatgaatagttctccttaataaaattattttataagatcattatacttaataattatctttaatacgaaaggtttggtaaactttgaaagtaatttaagaatgagatggaggaaaattgatgagaaactatgcaattgttcgcaccaacggattttttgtagcatttattttaacgtttgtttgtgcattattaggaacttttttaggtggtttaccatatttaagtttaattggtgccttggtgatttcattaatccttggaatgatttttcaggtctttccaactccggttgatgaaaccaaagagggaatcggctttatttcaaacaagtttttgcggcttggaattatcatgctgggctttaagctaaaccttgttgatttagcttctgcgggtgtgaagacaattggcttggcaatggtcgtggttgccggaaccgtctcactgacttatttcttgggccgtaaattaggtgttgaaaaagagctggcaatcttagctgctggtgggactggtatttgtggtgctgcagcagttatgggaatttcgccacaaattaaagtcagtgaagatcgtcgagaacatcagcgtgaaaatgaggtcctggcagttgccattgtggcaattttagggaccgtctttacactaatcgaaatcgggatcaaacccctgttacatttaacgccgacccaatttggggttgtgacaggtgcatcgcttcacgagattgcccacgcggtggcagccggaagctcaggcggtccggttagcttggatacggcaattattaccaagctatcaagagtgttgatgttggcgccggcagccttaattattggtgcttggtatcagaggacaactgttaaatcaaatgccaaaggaaaacaaaagttaccaattccctggttcatgggaggattcattcttgccagcatcttagggacatttttacccctgggaacggccgtattagctgttctggttaagattgcttatttatttttaggaatggcaatggctgcactgggaatgagtgttaactttaaagtgatttttaaacgcggtaaaaatgcctttttagccgcttcaattgcctcgattatcttgttatcatttacaatcttggttagtaaagcattcttttaaagtgctgatataactcagccgggccaataagcgattagaccccgtaatataagccccctaacttgagattcctaattttggaatgttaagttagggggcttatatggccggagtttgcttgtccgtccacgtttttccttagttataatggtcattacgttaaactgggtgaaataataaccattatccaaatctagaaaaaaatatagattatcataaactagctgtaaacgagtttcacgatctgtcatagataattgtgtactcagtttcataaaaaggcaggaatcccattttaaatcggctctttgtcaactgaggttgatatcagcttatatagcaaatccgaaaggatttgctttttcttttgcattaattgaattaagcaaataattccatttgaatcctagttcgataatggtcaaaa

SEQ ID NO: 690 - DNA, 29335 bp, Unknown
  Metagenome-assembled genome
tgaccattatcgaactaggattcaaatggaattatttgcttaattcaattaatgcaaaagaaaaagcaaatcctttcggatttgctatataagctgatatcaacctcagttgacaaagagccaatattaagtcagggggcttgtatggccggggtctgcttgctggtccacgttttcggctaagtacaaagttccacgagatattcccgattttggaatattaagtcagggggcttatatggctggggtctgcttgctggcccacgtttctgctaggtaacaagttcaacgagatattctgaatctgaatatctcgttgattcgggtacacgcctgaaagttacctcttgtccagcatgctcggtaataatcgtgattgaactgaactgaggctggaacaaatgacgattgtcccagcctcagtatttctttatttacatcagagtttttgcacaaactaccagaagtgcaattaatattgctgacattgccaacagcttgaaaccgtcattgcgggtatagtagccttcaggaaattcttcgcggcgtttcctgagcgtttgtcgatttaaccgttgcatattaagaccatcctttaacttgttgattgaaaagttatcccattaagattcatgattccgaaataccgcccattttgaccagaaataattaacgataaccacaatcacgttatcgataattttaacgatcaattcgtttccgcttaagagtgtaattccgacgtataggataaccatttcaagacctaaaactagtaaacgaccaccaaaaaatgacgccatttcttttaggtaacccaggactgacacagtcttggagtggaaaacatacgttttattagatagataggcaaccaaaacgctgataaaccacgcaatggcattgttaatcatataattccaattggtgagccagtgtaacccggcgaaaacaccaaggttgacaagagttgtaatgacaccccaaaaaagatatgaaatgacttcgagatattggttatagagcgcaactatttttttcattggcttaacgtctttcagcaatgacaaattttggccgatgcttggtttctaagtagattttaccaatatatttgccgacaatcccaaggcagaataactgaaccccactcagaaataaaataattgaaactaatgaggcccagccagcgaccgaccctccaaagaacaaggcccggatgacaacgaaaaataggccgaagatcgaaagaaagcaaatcccgccaccaactaatgttgctagtttcaatggaacatcggagaagtcaacaatggcttccaaagaatactcgaacagttggaatagtgaccacgaactggttcctgcagctctggggacgccttcatattcgagatatttagtattaaaaccaacccaagagaaaatgcccttactaaatcgattgtattcgggaagttcgagaatggcgtcaacgtattttcgactcattaaccgataatcacgaacattttgtttcatttgaacacgggacattttattaataattttatagaagctggctgataggaaagcccgaagatgccgttgctttcggcttgtttggacacaaccaacacagtcaaagtcttgttttgggtcttccaaaatgtcaaccatttgaagtaatagctcaggtggatcttgtaagtcaacgtccatgaccgcgacatagtcgccatgggcattactgaggccggctgcaaatgctgattctttgccgaagttgcgtgagaatgagatatagtggacttcatcgggatgttgtgcgtttaattttctcataatatccagtgttttgtccgcagagccatcgttaataaataaataatccggtttaaattgttcagtgtgcgtttggtttagtttatcaaaaaccttttccgttgtgttaaagaaaagttcaaccgttggctcttcgttgtaacaaggaacaattagactgatcgttttcaaaataagtcctccagtaaaattacgcccaattaccattcttcataatcgggacttgtttgccatcttttgtgataccatcaatcatcatatcgtctgatcccatcataaaatcaacatgaatatcagactgatttaacccgagttgggtaagctcagcatcgcttttagaagtgccgttttttacgctgaatgggtaagcagcgcccagtgccatgtgatccgatgcattttcatcaaacaaggtattaaagaaaattgtttgggcttttgcaattggtgaattctgaggtaccagtgccacttcacctaaggatcgtgagccggcatcggtatcgattagttgtctcaagagggactgaccagttgaggcgtttgcattaattaccttaccatctttaaaagttaatctgatatttttaatgagttgaccattgctgctgagtggtaatgttgagaaaaccgtgccgttaattcgctgattatcgggggcagtaaacacttcttctgtcggtatatttgggatgaaaaaatttcccgccgaatctgtggtaccagccgcctcccaaatatggtcctggggtaatcccaccgtgatatcggttttatcggaataataatggagatgatcaaacctttgttgatttagccagtcggcccgatcactgagaaaggtgatgtgagactgccaggcagatagtggatcatcactgatcactctggccatcttaaaaatggcgtgccataattgatcagtcgcttcatgaacaggtgaatttggatacactaaatgagcccactcaggaccggcggcaccggcaacgacccagctaatctgattattcatggtggcttttgtgacgggcacctttacttttgtcatcatttgttggtaagcttgaattcgtttagaatcgatgccatcgaattcggctggggattctgataataaggataagcgactggcttttttggccattagttctttagctgccagtttttcaaattcgtatggggtcgatagacgatcactagtggtgtgtaaaagaaaatctttttgtagaattgagtcgcgccatttaacaataacctcattggcaccaagtatgtacgctgagtgtgtgattaaccggactaaccgaaattgcctcacattggcatataggatgattgtctgattaggttgcacatttaagccaaccttagtcagcaagtcagcatatttttgaagtagttcatcaaaattgctgttcagtttacccaccttccattctaatagattatgtacatcaacagattataccatatgttgtttttgcaaaaataaaatcaatgttaaggtttatgtcgtttttgctataatgatgacatgtaaaggagaaaaaattaaatgaagccaatcaaagtcatgactatttttggaacccgtcccgaggccatcaaaatggcaccaattattttattaatgcaacaaaagtcatctgaatttcaaccgatcactgttgtgacggctcaacatcgtgaaatgttggaccaagtcatgactgtttttcatattaaaccagattatgatttgaatattatgaagaagaatcagactttgagtgatattacgactcgcgtgattacggcactggattcaattattgaaaaagaaaggccggatatcattttagttcatggtgataccacaacgacgtttgccgcaagtgtgagcgctttttatcatcaagttgaaattggccatgttgaagcaggccttagaacctggaataagttatcaccgtatcctgaagaaatgaatcggcagttaactgacgtattagcggacttatattttgcaccaactaatttaagtaagcataatttacttaaggaaaatcatccggaggcccatatttttgttactggaaatacggcgattgacgcgttaaaacaaacagttactgctgactatcagcatacagtttttgatgaactaagggctgactccaaaatgattttactgacgatgcatcggcgagaaaatcatggtgaaccgatgcgtcgaacatttcaggcaattaatgaggttcttaaaacacacccggatgttgaagtggtttatccggttcatttaagcccagctgttcaaaaagtggctcatgaggtttttgatcgtgtttcacaagttcatttaattgagccgcttgacgttttggattttcataatatggctgccagaagttactttattatgacagattctggtggggttcaagaagaagcgccctctttgaaaaagccagtcttggttcttcgggatacaacagagcggccggagggaattaaggccggtaccttgcgattagtggggacagatcctaaaattgtgaagcaggcaatgatttctttgctggacgatcctaaagcctatcaacggatggcagaagctaagaatccatatggtgatggccatgcttccgagcggatattaaaagctattcaggaccgtataaaaaataagtagcttcagatttggcttagatctcattgattttgagtaggctggttggcgggtttggggtgtggctggtttgaattgagacaacgccatgtttttaaatcttgaaaattaagtgagcagataattatgaaaccattattccgaaagaccaagcgttttattaaactgctaatcagtcattattcttctggaaacgtgtctgattctgcggttgttttggcattttattcattaatgtgcatttttccaattctatttgttgttggaagtgtttttaatcttgtccaaattaatacacaggatgttgaagtttatttacggccaattttccctgaacgcatttataccatgttggaaccgattattgattcgacactgcatagtggtggtaccagtcagctatcagttgggctaatcgtgacggtgtggtcggcaagtcgagcaattgcggcttttcaacgaagtattaataagacatatggggtagcagctgatcaaacagctatctcaaacagattaatttcgttcatttggatgctggtattactggtggcggttgtggcgatcatgctattatttgcgtttagtcaatttatttttaattggctgcagccgctattgcatgttcccaattcaattgttagtttgattggaacggtcaagtggccaacgacaattttaattgtttggttgttgcttaatctgttgttttattttgtgccaactgcgaaagtgaaatttcgatatgtttgggtgggcgcattatttgccacgattggtttgatgttattggcacaaggcttttcagtatatttgaaattttttgccaaccgaattgatgcttacaaaacaattggaacgtttattgtgttgatgttttggttagacttttctggaatcattatgttattgggcggtgtcatcaatgcaaccatccaagaaatgaggctcggcaaggttcaagaacagactgatgcggttgaaaatgtcatcaaaagagcgaagcgattgaggaaaagaaaatagagtgatcaaaaaagcggttagatcccagaatataaggcacttaaccctaatattccggtcttgaatattagggttaagtgccttatatggcagggatctgcttctttgatcacgtttccgccaagtagacagaagaatccggtcttgaatattagggttaagtgccctatatggcagggatctgcttttttgatcacatttcagccaagtaggcagaaggaatccggttttgaatattagggttaagtgccttatatggcagggatctgcttttttaatcacgtttcagccaagtaggcagaagaatccggtcttgaatattagggtgaggtgccttacctggccgggatctgctttttgatcacgttttagattggtagacacgtgaatttgggtaagcagccttgaccttgtgcggcgacgtattttggacgcataatagattcatatgatacagaaaattccaagcaaaataatcaatgcttggaatctttaacaatgagctttatttttggactttactgatcagttcttctgcaaatttgtctaaagtttcaatggcgtcttcatctggttccaaattgattttgacatcttcggcaccttttgtagcaccagcttttttgaaggcggcatcaaatttatcaacggcaacgttaaaaaattcttcgtagaaagtgtcaccggatccggcaactccgtaaattttaccctttaagtccagttcttgaaggtcgtcgtaaaaatcaagaccctcttccggtaaagcaccttcatcgtaagtatatggacaaacaacgcagatatcgacatcttcgaatacggatgggtcggtttgtgaaatttcactttctgctaccttgacgccagcatcttcaaaatgttcggtaataatatcagcaacgtcttcgttgttcccagtaattgttgcaaaaactacgtgagcagttatcattattcgtcatcctcgattcttatattgtgtttagtatatcaaattgccatgctaaagtgaatttacatccaggaggtttttatgactcaaacgatcactaagattgaatctcaaaaaagaccgggccggtttaacgtttatgttgatggtgcgtatgcttttccggtaagtgaagaagtattgattaagtatcggctttttaaagggatggaagttgacgagttactcattaatcaactaaaaaaagccgatgatgtttctaaactacatagtcgggcactggattttctggcgcatcatttaagaacggaccacgaagttcgtgaaaaattggctgaaataactgaggattccaacgcaatcgattcagtaattgcccagctgcgaaggcaacgattaatcgatgaccgcaagtatgctgatagttatgttcgaacggttgttagagaggctaaaaacggtcctgattggattcgtcgacatttaaaggacaaacgggttaaagccgacctgatcgaggcatctctggttcaatattatccagaagcgactgctattgaaattggtgctgaagttgcccaaaaacagttaagccatcataagcacgattcggccaaaatggcgataaataagactaaaaatttgttgatgcggcgcggctttaattttagtttaattgatgaaattatgaatgaagtggacacatctgaattggtcgtccatgatcaggagatcatcaatcaattggccgaaaaatattggcgaaagtatgccaaatatgatagttatgaacagaagcaaaaaaccaaacaggcactttatcgaaaggggttcttgattgatgatattgaggctgtcttggcacaattgtccgaaagctaaaatcattcggcaaataggcccccgtctgatataatgagcagtggattggcaacaatcgatgcgaatagcttaatcagaaagtgggtagctacaaatgccacgactggaaagattaccaaaagaaggggacttcattgcgattcaaagctataagcatgatggcagcttacaccgtatttggcgagatacaatggtactgaagactggcgaaaattcattgattggatgtaataaccatacattggttaccgaagatgatggtcgccactgggttacaagagaacccgccttagtttattttcacaaacattattggtttaacgtggttgcaatgatccgcgatgacggtattgcttattattgtaatttagcatctccatatgttttggataaagaagcactgaaatacatcgactatgatttggacgtcaaggtatttcctgacggtcggcgaaaattgcttgatgttgatgaatatctggaatttagtaaacgctggcattatggtccagaaatcgatcacattttgaagaaaaacgttagaataattgttgactggattaataacgagaagggacccttttcaaaagagtttgttgcgatctggtatgaacgctacttggaattatctcgtcaaaaaaaatgaagatcaccgtaggaatggggctgagacaaaagtaattttgtccagtcccgttttatgtcatcacgattattagtgagcagtaatagagagcgggcaactgcattctggagattaactgcctttggtctcgctttttttagataatattatttggtgtttgattgacacgttaattgcttagaaacggtgacctgatatgtcaccaagaagagattaaagtctttggcaaccttgcttaataaggatagcgcgtgacggctttggggcgatttcaacatggctaaggttgagatgtaaatgttgtcctatgtgtcatgagtagattgctgataacatactctatgttacaataacgctaacagattaaatcagaagggaactaaccatatgtttgaaagattaaaaaattcatcattgatgttttggtccttagaaattctgatcgttgttgcaattatttggggttgtaccaagattggttttttcttttctcccattgcaatctttttttcaacgatctttattccaatcttgttggccggaattttattctatatgctgaatccaattgtcggattattaacgaaacttaagttggggaaaaagcatgtttcgaggggatgggcagtgacgcttgttttcctgctgtttgtcgggattatcattttgctggcaacggtttttgttcccaagttgacgaaccagattgttaccttggctaaccaggttcccggtgccgttaatgacggtcaaaagctaatggagaaattgtttaaggaaatgaattctcagcaatatcttaagcaaattgattttacgtcgttgagtgaaaaattttcaaagaatatcagtggttatgccaacgcgttgtttaatggtgttactaatggacttggtggaattatctccgtagctgcaaatgccgttattattgctgttacggtgccggttgtgttgttttatatgttaaaagatggctataagctggcaccaaacattaaacggctgttgccggaaaagcatcgcgagcagacaatggaattgctttctgaaatgagtcgaacgatttctaagtatatttccggacagatgatcgaatgcttgtttgtgggtaccttcacggcaattggatatctgataattgggataccatatgcgttactgctgggcgttattgctgggatttgcaatattattccatatattggcccttacattggaattgccccggcattaattgtgtcgttttcacacggtggctggctaagcgttgtttataatattgttgttgtgattgttgttcaacagattgatggcaacttggtttatccaaatgtgattgggaagtcgttacaaattcatccacttacgattattatcattttattggcagccggtaatattgccggattaatgggaatgatcttagcagtcccgttatatgcggttgttaaagttgtcgtcgtccatatgtggaatatctatcaattggattgaaggcaatttaatgaaataagtgttgataattagagagactgggtcgttgtttccttaattctctttaaaaaatattgacgtgaccgttgtttatgctactatttaagttgtgtttatttctaattttaagataatagtgaatgagtaagtaggagagtttatgaaaaaagtaattacgtatgggacgtttgacctgctccacaagggtcacgttcgtttgttgaaacgtgctaaagcgcttggtgatcatttgacggtttgcttatcatcagatgaatttaacgccgaaaagggcaaaaaggcatatacatcatacgaagatcgtaaatatattcttgaagcaattaaatatgtggatgaagttattcctgaaactaattgggatcaaaaaattcatgatgtccaagaacgcaatattgatgtgtttgtcatgggcgatgattggaaaggtaaatttgactttttgaaggattattgtgaagtcgtttatttaccaagaactgaaggcatttccaccacaaagattaaagaagatttggggcttactgacgccaaaaattgggaagcataataatagtgagaataaaaagaggctgttagcaaaaccattcgttttgtaccagtcctcttttattatgggaggaaaaagatgaaacaagcaatctttttggtaacgacaattcaaggaatccggaagccgacgttcctaaagcaattattgtcactaattagtgatgattatcagattgttgtgttgttggcaatgaccgattttgacgaaatctggcaggctgaacgcgaaatcaaacttcttagattaagagctgatttagacggcgttcgaaccatatcattagcagatgtatatgcggatcacgacggtgttgccttgaagaatagtgattatttaacgactgatgtgtcaaatttggccagccacgactcacattccggtaagctgaaggtttctcgttatgttgatcatgacggcaacattgttgctgaaaccttatttgccgaggacgaaacgagattgcatactattttctttgataaaaatagccggattattcagattaacaattatgatcatcaagatcatttatttggcattgagaagtttactgacaattttcttgaagaaagtctgctattaaacgcaaaatccgatttgatctttagatttaccaactacgtatcgccattgaaatccagctttgcaattgcgtcaacttcggttattcctttacctcaagagcttactgtaattgccggtcagaagaacgatgctgctcagaaattatatgaaggtcaaggccagacaattgtcacgaaagcaatttcgtacagtgactaccatcgatatgatgatattaacgcattttatcatcaagtattgatgaatatggatattgagggcgtcagaacctatcttgacattaacgacattgttgacgcatcgaaatacttaccaggaaaacgaatctttaattactaaggggaaatcgaattgcgagcgatactatcaggagttcatcaaaaaaaggggcttcaagttttagaatttgagttgttggatgtagctggctcattagaacatgcttatatgctgtttgttgagaaaaatagtttagcttcattgatgaaaccaatttcaaaaattttaagccataatattattcgagttaacattaatgctcaggactttcactttgagtccgaagatcagacggaatttgaatggcagatctttctgattaataacagtcgaactcaacgagatgttattcaggttgaaagtgagtatctgagtgatcgtcatcaattagaattgaccagttattatcaatttaatagtgatgctcaaggaatggctttattcaatctgagaacccatcagtctgatgatgattttatgattaattcggtcaacttgactgatacagaccttgaaatcaccggctacaataaaattaatgggacaccgatcaagaatcaacgaattattttacgaaataagactaacgatggtaaattggattttccagtctctcaaacgatgtttgccggaatgttcaaggttgccattccgttgaccgatattcctcaagactcggttggtgagctattcattaaataccagttaaatggtaaagaaatcacgcagcgcttgattatccccaattcactggctggacaatctgttcaggctcaattacctggtaatcggatgattacgcttgagaaacgatttgataatggcattttggttaaggagtttttaggagcctcacttcttcaaaaagttgtcgcagcgggtggtaaagctcatggcatgattgaggtttgccgattagtccaagacaagctgaatttggcgcgaatgcgtttcttatttaaagcaggtcattcgccttatgaagggacaacaattgtctttgaaagctttggtggccgccaagtgagtgatagtccatatgccatttatcggctatttcaaacgctgtatcctgggattaacatgatttggtcaattgaccgctcacaaaaagctttttgtaaggaaaatcagattgcatacgtcattcggcgaactcaaaaatgggtccgggtattggaaaaatctcaattttggattagtaatgcgcggttcccatcctgggttaaaaaaccgaattatgtaacttatattcaaacctggcatggaacgccattgaaaaaattgggattagacattgaaaatgtttcaatgcccggtacaacaacggctaaatatcataagaactttgttcgagaagctaatcgttgggatgcactagtctcgccaaatgactattccactcagattttccgatcagcctttggattcaataaccaaatcttaaaaattggctacccgcgaaatgatgaattgattaatacaaaaaccgatgaaatagcacagattaaagaaaaattggggattcctttggataaaaaggttgtcatgtatgcgcccacatatcgggacaatcaatttgctgaaaagggaaaatatacgtttgaattaccctttgacttggatgattttagaaaatcatttgggaatgatacggttttgattttacggatgcactatttaatatctaatgcattggacatctcaaattattcggattttgtttacgatttttcagattacccaaatattagtgatctttatttagtatccgatttgttaattactgattattcttctgtatttttcgactatgcttatttaaagcggccaattttattttatccatatgattaccatttgtataaagaagaacttcgaggattttatctcaattatgagcgagatctgcccggaaagattgcccataactcaactgagttgctggcagaaattaatcatgcgttagctcatccggatatgagtgccaatgaacgctttatgaatttttataatcgattctgcgcgattaatgatgggttaagttcattgaaagttgttaattatgtcatgcatcagattgagagtggcgtttagtcagtcttgattaagtatactgggtactaattgaggaattataaaagggctgagacgaaagcaattttgtcccggcttttttatgtcatcatcattattggtgagtgagaaacagcgaacatgagagttaatcaatctttatgccatttggtttatcgtgaatcaaggaaaagtgttgtttgcatttttttgctgcattgttgttacttgggtgttgtcgaattgatatcgcgtcaaaacgtgcgccctattcacatgtatggtagaataaatgagttatttactcgctcgaaaggaagttaatatgaataaccaacagttagaaacgcaagacagcactcgcagaacctttgcgattatttctcacccggatgcaggtaaaacaacgattactgaacatctgttactttttggtggggtggttcgccaggctggaaccgttaaagcccggaagaccggaaattttgccaaatcggattggatggaaattgaacaaaaacgtggtatttcagtgactagttcggtgatgcagtttgattacgctggtaagcgaattaatatcttggataccccaggacatgcagatttttctgaggatacgtatcgaactttgatggcggttgattctgccgtcatggtgattgattcggctaaagggattgaaccccaaactaaaaagttatttcaaatttgtaaaatgcgtggcatcccaatttttacatttatgaataagttggaccgtgatggtcgggatcctatggatttggttgatgaattggaaagtgtcttgggaattcaagcatacccaatgaattggccaattggcatgggaaaaacacttaccggtatttttgatcgatataatcatcgtgtggaattgtataaacatggcgatgaaagccaaatggttaagttggatgataataacaatcccataaacgacgatcaactagcggaagatgaccaatttcaagatacaaaggatagtgttgaattactcgatatggccggtaataagtttgatgaagataaaattgctactggtgatttaacccctgttttcttcggatcagctctggttaattttggggttaagaccttcttcgatgcttatttaaagtatgctccagctccgagtccacataagactgaagaaggaaatttaattaatccagatgccagtgaattttctggatttgtttttaaaattcaagccaatatgaatcctaaccatcgtgatcgaattgcgtttgttcgaatttgttctggtgagtttgaaaaagggatggacgttaatctttatcgaactcagaagaaactacggctgtcaaatgtgaccgagtttatggccaacacccgggaaaacgttaaaacagcggtggctggtgatattattggcctttatgatacggggaactttcaaataggggatacgatctacactggcaagcagccggttgagtttgaaaagctgccacaatttactcccgagctgttcgttcgtgtttccgccaaaaacgtcatgaagcaaaagtcgtttcacaaggggattgaccaattggttcaagaaggggcggttcagttgtacacctcttatacaactaatgactatattttgggagcggttgggcaacttcaatttgaagttttccagttccgaatgaaaaatgaatataattcagaggtcaatatggaaccgatggggcataaaattgcccgctggattgatcctgatcaacttgatgaaaaaatgtcctcatctcgaaatatattggttaaagatcggcataatcagccgctgtttctatttgaaaatcaatttgctatgcgttggtttaaagataaatatcctgatgtgacattaactgctaaattataattttgttgaaagaagagatttataaaatggtttcaaaacatttatcagcatgtacaagtgttttagtcggtaaaaaggcttcaattgatgggtcaacgatgattgccagaaacgacgatacttttttgccattaacgccccaacgttttttcgtccaacccgctgtctctaatcaaaagggaacatggcaatccaatcaaaatgggtttacagcaccactgcccaagaaaggataccgatatcaagttacccctaacgctgatgttgataaagaaggggtttacgctgaaagtggcttcaacgaaaaaaatgtggcgatgagtgcaactgaaagtgtttatggtaatgagcggacgttggcttttgacccattggttgaaaatggtttggcagaagattctcttcagtcaatggtattgccctatattgattctgccaaagatggggttatttatctgggaaagctaatcaagcaatatggttctccagaaggaaacgcggttctcttcagtgataaagatgaggtttggtacatggaaattgtgactggccatcactgggttgcccagcgaattcctgatgatgcttatgccataactgctaatcaagttgcgattcaacaggttgattttaatgatcctgataattttatgtattctgacggcattcaagaatttgttgagaattatcatttaaacacggatcaaaccggttttaatttccgacatatttttggaacagataacgaaaaagatcgtcattataatacgccgcgggtttggtttggtcaacgagttttaaatcccgaaattaaacagtcgccgatttcttcagagttaccgttcatttgtcgaacaagcaaaaagattagtgttgaagatatcgagtacattttgagttcccactataatgagacagtttatgatccgtttagccgtggcaatgaagacacaaaaacattatttaggccaatttcgatgaatcgaacacagaattcacatgttttgcaaattcgaaatgacgtgaccaacgatagttcagccattatgtggctttgctttggagtaccggcattttcgccatacgtcccattctttgggaatgccaatgacactgatgagagctacgccaagacaccactccattgtgatgaccagagtgcttattggatgtatcgtaagctttcaatgctggtggagtcacattattctgagttcattcaagatgatattgatttcctaactgattcaaaagaaaaattacgacgacacgttcaagatgcaattgacgaagctaaagggttaaagggcgaagagttaacaaattatttgacgcaacagaaccacgaagttgtcaaaatgatgcgaattgcaacggagcattttaaccatcaattgattgaaaaagggctaacattatcgaaattaacttttaatattgataaaaatttgtaaaaccagtaatcatgtcagtaagcatgatggtacttaattattagaaaaaagagtgacatgaaaagcgtttagcctctcgggctataagaaaactgcttttcatgtcattctttttttgatataaaattatgaggtgaagccataagttaaccaagtaccagagttggatatgattttagaaaccaaatgatgatatttttgaagttttagccctggtcaattttaatataacccttgggaataacctggtgattttctaattcgtaccaaattaaattttggtcgtccacaatggtcgcaataatgctgattttagtcccatctaacagttttccagcttgtttaccatagggtttatcaaatgtgctgattgattgtccaggtacaaagtcaactgctccagtcaacatcacccgatttctagaagttttagtcattgaagcaattaaattatgaattggtggatcactaggttcgagatgttgattttctatccactcaaaaccaccgatattgagccagcttttgttgtttgatgtgtctattcgagcgaatactttaataataatgttggcaggtagtccggtttttaattgatacccattgggctcgttaaagactaaatgatgcttgtttaaacggacaaagtaagcaacgggttgaacagtttcccagtcctctttccgataataaaaaataatgccatgggttcgattatcgaaaaggccatatttctttccagtactgttgataactcgaaaatgatcaatttttggtgcagtaatctcgtatttttgacccattttatcagaaataattttgactggttgtagtatttggccggtatcgaaatcaaccgtataaaccatgaccggaagtccctctttaagtgcgaagtggagagtaacgtcctgatcataagctaaaaaatgattggtaaaatgatcaattgccactaaataatgattcttaaatcttggtagtttgaaatgaaaggactcgccctgattaccaactaaaatatcaggagacttaatgatttgatgattttcgtccaaataaaaaaaggtgacttgagattgaaccatggtaactggagaaacttggtcaactgactgtttgatttttggaagtgtcgttgctggattatcggcctgaattgcatatggtgatttttgatcattatttgtcttttgagactgatccaccaatcgttttcgttggtgataatcatggtggtgatcacgatgatttctttttggccgacttttatcaacggtcagtgtatgaaattgttgtttaatccagtcaaaaaatgtcatccgttttcccccatcatcaacacgttctactaaaaattatagcataaatgagtcaagctgttagccaaagagaatatcttcctagcaagtgaaatcgggtgattgatagaaggggatgctttttagaaatcgatattagtgaggtgcgatagtttttagttcataaacatcatgattgtagcaaaagagagtgggacgaaaggcggttacgcggcaggaagttgccttttggcgcacgttttcactcggtaataatcgtgattacacaaaacgagactgggacaaaattacttttgtcccagccccgtttgtaataagaatcgactatttaaaaagacaattccgatttactttttagttttagttgctttagccggctgaccagttttgataatgatgttaccatccttatcaacatcagcagtcaaactagcagcactttcatgatcaaggtagaagtcagcgactttatcctcgatttgttcctgaataactcttcgaagcggtcgggcacccattgcaggattataacccaagtcgactaatttttccttggctttttctgtaacattgataaacaagccctgctgtttaagcatgttattaacatcatcgatcattaacgatacaatcttctgaagatttttcttggtcagtgagtggaattcaaccacatcatcgaatcgattcaaaagttcaggcttaaagtaattggttaatttgttaatgattgaatgagtcgtgccggatgcggcagcaccaaatccaacgttagcttccgaatcgccttgaccagcgttactagtcatgatgatgatcgtatccttaaatgaaactgtccgtccttgactatcggttaaacgaccgtcgtcaagaatttgtagaaacatgtgaaggacgtctgggtgagccttttcaacttcatccaagagaatcagactgtatggatgacgccgaacttgttcggtcaattgaccagcttcttcatagccaacatagccaggaggtgaaccgatcaacttagccactgaatgcggctccatgtactcagacatatcaaatcgaatcattgcatctttagagccaaacagctcacgagctaattgcttagccaactcggttttaccaacaccagtcgggccaacaaataagaatgaaccaattggtcgacctgttccgttaaaaccaactcggtttcttcgaattgcccgagcaactttttcaacagcttcattttgaccaataacgtgtttctcaaggttagggccaagatttcgcaattgttgttgctcttttgcttgaagttcaccaactggaatttcagttttttcttcaacaatcttttccatatcttcagcagttacttttggcgtatcttctgaatcaggagtattagtttgtttattcttttccaacttggtcacttggtcgcgataataggctgctttttcgtaatcttcactctttagggcagcttgcttttgcttttcagcattttgaattttctcatcaactgtgtgaggatccacaacgttaatagtcaaattcttacgtgatccggcttcatcaagtaaatcaatggccttatctggtaagaatcggtcttgaatataacgatctgataacttaactgctgcctgaatggcgtcatcggtatacttgacatgatgatagtcttcgtatcgtttctgaatcccctttaagattttaacagcttcttcaggggatggttcatcaacggtaacaggttgaagtcgacgagccaatgcagcatccttttcgatgtcacggtattctttcaaagttgtggcaccaattaattgaaattcgcctcgagccaatgcaggctttaaaacattgcctgcgtccatgccaccctcggcattaccggcaccaacgatttcatgaatttcatcaatgaataaaataatgttaggattgtcctgcacttctttaatcagttgctgcattcgttgttcaaattgacctcgaatgccggttccttgaacgagtgagacaacatcaagtcggatgatttgcttgttttgaagttttgacggaacattacctgagacaatttcctgagcaaggccttcaacaacagctgttttaccaacaccagcttcaccaatcaaaactggattgttttttgttcttctgttaagaatttctacaactcgacggatttcattatcccgtccgataacaggatcaactttaccttctcttgcgagttgggttagattaattccgtattgaccaagtaatgaatttccaccctgaccaggctgccgattattagggttacgtggtccttgtggttgtgtcggtgggatctgttgggcgttttgaggatcgacatttccgccttgcattgcacggaagatatcgtccaaaccgccaaagccgaatggatcttgagccatgttttgagcacctcctgtgttacgttgcttgtttgagaggagttgatagcaattttggcaaaggttaatagtttgcttttgaccattcacattagtatataagtggatggttgctggatttttatggcaattttgacatagcattaattgctttcctcctttaaatttagagataaaaggttacagtttaatagtggactttcttttaaaagtactgaccaactttgacctttgaattttattatacaacttcaaaacgggtaatcaagtaattgcattcagcacgaaatgaaattaatggtctcattgaaagccaaacatcatggcgccccggttaacataggaaagcaggattcatagggatgtctgattgattcaatgactaatttcttcttaactgatacaacgatcttattttaaatccttctactaaataatcacaataaattgcttaatctcttaataatatcatgataagacgattgcttcttctaccaagtttgcccggcaaatcatgtcgagaagagatatagacatattgaccattcgcttttctaccaatggctggaaaataagttaggtcaagtgacatcgctgatgctctctctattttataagagaaaaagttaatcaagattggtattggcttgaatttaaatattggctgtctcatcatcaggtgttaaagtagttacattcagtttgttacaataattgtcaatctttggttgatcaagagattgcagtcttgtttcagacgaaggaggaaaaatgacagacaaaattgactattccgaacaattaaaaaggctcgaagccggtgatattgataaaattgtggtcaaaccagaacagtttatggattttcaatcgtcgtttatgaattatgataaacgaaaaagaattattggaactgcggatcaaggcggcgtggtgacctacatttttgagcgtgatgatcagcgcaatgattcttaagaaaaactgtaagcggttcatgtaacgcttgtattttcgttgatatattgctattcttaaatgggtaaggaataattttaagctttgaatgagatctttgatttcaaagtctataaaacgatcagaggagaatgatttaacatggaaaaacgtcagtataacattatcgcagaaactggaattcatgcacgtccagcaactttgctagtccaaactgcaagtaaatttaacgcagatattactcttgaatatcaagaaaaatctgttaatcttaaatcaattatgggtgtcatgtctcttggtgttggtcaaagcgcttcagttacaatcactgcagacggtgatgatgagaagcaggcaattgatgccatcactgaaacgatgaaggcagaaggactaaccgactaagttcatgacaacttacaaggggatcgcagctagtgacggaattgccattgcatctgcatttcggttgactgaacctgatctttcttttaagaagcactcaattgatgatcctgatcgtgagattcgtcggtttcacgatgcgattgatatctcgaaagaggagcttctaacaattcaacagagaactctggaagacctcggtagacatgaagctgaggtctttaaagcacatattgctattttatctgacccagagttattaacccggattgagacagtcattcgtcgagaacatgttaacgctgaagcagcacttggtgaagtgactgatagctatatcaaaatctttaattcaatgactgacaacgattatatcaggcaacgatctagcgatattaatgatgtcaccaaacgtgttttgagtcacttgttgggagttaagttaactgatccagcgcttattaatcgtcgcgtaatcattattgctcacgatttgacacccagcaatacggctcaatttgttccaaactatgtcaaaggaattgtgtctgatatgggtgggcgaacatcgcattcagctattatgtctcgaacattggaaattccagccgttgtcgggtttaaaggttctctagccgaaataaaaaatggtgataccgttattgttgatggattaacaggaaatgtcattgttaatcctcgtcaagatgagatcgaacaatatcaaaataaaattaaaaagtaccgaaatcgaaaaaaccaactttcttcttttaagaatcaaaccaccatttcttctgatggcaagcatccaatcttggctgcaaacattggaacaccggatgatttgaccgcagcaattgaaaatggtgcggaggggattggtctttttcgaacagagtttttatacatggattctgatcagctgccaactgaagatgagcaatttagtgcttataaagacgtgttacaaaagatgaagggtaagcctgtcattatgcggactgccgatattggtggagataaagatctgccgtatttggataccccaaaagaagccaacccgtttcttggctatcgggcaattcgaatgagtttggatcgaacagatatttttaaggttcagctacgcgcgcttttacgagcgtcggcatttggtgacctttcagtgatgtttccaatgattacaactattaacgagttgaagcgcgccaaaaatattcttgagcagcaacgtcaacagctcatctcagcggatgttgcagttgggcacatcaaaattggaattatggttgaagtgccggcagcagcaattttagcggatcaattcgctaatgaggttgatttcatgagcatcgggactaatgatttgattcaatatgttatggcagctgaccgtggtaataagcgggtttcatacctatatcaaccgtacaatcctgctgttttgcgattgattaaatcaattattgatgcatgtcacgaaaatgggattccggcttatatgtgtggtgaaatggctggcgatcaaactgccatcccaattttatttggaatgggattaaacgagttttcaatgagtgcaacatcaatcttgaagtcacgggcgctgatcaagggtctggattctcgtgaaatggtcacattagctaatcgaacggttagtttagccagcaccagtgaacaagttgttcattatgttcaccaggcattggaagctgagtagtagacttataaataacttaaaaaacgagttgtcagcggctttggatggtctgttgacggcttgtttttttgttgtaagccgtttgcaatggctcggttaaacaaatataataattttgataatgtaagtgtttcggctcgggtgtcattctcggctgtcagcacacatgtgggatggtttttctgcaagagtcaatcatgtagtcgtcatccgtaaaggaaacaactaatagaaaggggtattagtcgtgaatattggaattttcaccgacacctattttccacaggtgagtggcgttgcaacatcaatcaagacacttaaaaatgagcttgaacgacaaggacatcaggtctatattttcacgaccactgatccccatgttgataaagatacatatgaacaaaatattttcagattttctagtattccgtttatctcatttactgatcgacggattgcagtccgtggcctttttcaagcatacgaaattgctaaagaattgaatttggatattgttcacacgcaaacagagttttcgatggggatgattggcaagtttgtcgccaaaaatttaaatattccttgtgttcacacgtatcacacaatgtatgaggattatttgcattatgtggcaaatggcaaattattaaagccggttcacgttaaagaaggaactttagcattttgttatcatctctcaggtgtgattgctcctagcgatcgtgttttagataaattaactgattatggtgtgcatagccaaatgagaattattccaactgggatcgatattgggatgtattcaaaaaaaatgaccaccaatatcagggaaaaataccatattgccaaggacacaccaatgatgctgtcaattagtcgattggcatatgaaaaaaatctttctaaattggttgatttattgccgaaaataattgagcgtgtgccgacagcaaagctcatgattgtcggcgatggcccagccaaagaagatttgatcagccaagttcatcggctcaaaatggatcaacatgtgatttttactggcgaagtcagtaatgatcacgttaatgcattttatcgtgcctgcaatgtctttgtttcggcatcggagtccgaatctcaagggctgacctatattgaggcgatggcggccggattgccggtagtagtcaccgccagtgattatacaaataatctgcttagtagcccgacactgggccaaacttatactcatgaagctgaatttgtgacgattgtgaccaactatttagttaagcaggtagatgtcaacacagtgcaagcccagcaattactaaaacgtaagcttaaagcaatttcgtcggaaacatttgccaaccgggtcgttgatttttatcgcaatgttcaagtagaacaggaactgcaaaaggatcccacaaccaacactgaataaatacgtttgttaaaggagtttatatgcttaagattaatatgttctcaaccgccgacaaggtgaaaggacaaggggtgggcagtgcttatcttgaattagtcaaaatgttaaaaaaacactttcccaacgactttgatattaagattaacagttatgcttcggcggatattagtcactatcatacgattaatccgactttttatttatcaacattttcaaaaaagcggggtcgaaaaattggctatgttcactttattcccgaaacgcttgagggtagtttgaagattcctcagccatttaagggaattttgtataagtatgtgattgcattttataagcgaatggaccatatcgtggttgttaatccatcatttattccaaaattggagaagtatggtattagtgccgaaaaaatcacatatattcccaattttgttagtaaaaaggaattttatccggttgatttggcaactaaacaacaaattcgtcaaaatcacgggtatgagcaaaatcggtttactgttttgggaagcggccagattcaaacgcgtaagggtgttttagactttattaaactcgctaagcagaatccgcaaattcagtttatttggactggcggtttttcgtttggcagaattactgaaggatatggggaactggaaaaagttgttaaagatcccccgagcaatttgtcttttcccgggattatcgatcgatcaaagatggttgattattacaatatggcagatttgtttttactaccgtcatttaatgagttgttcccaatgtcggttttggaagcatttgccacagagacaccggtaatgttgcgagacctcgatttatatcattcaattattgatggttattatttgccggctcaagatgtgagtgagatgaatcgtaaccttttagaattaacaaatgatcaagccgaattagctaaactccagcagcaaacagtaattgctagtgaacggtattcagaggaccatttagcaaaagtttggttcaacttttacaatcaacaggctaaggaaggttattaatgtcacggaaaaacaaaattaccttgatggtgatggttttaattggaattgccatcattgggtattcaatgaaagatattaagcttagcgtcttgattcatgacttcttcacaattgatccctggtggttgttgattgcctttttgtgtatctgtgtttatttactaattgaaggagttgtcaccaaggtattagtgtccaatcgagtcgcaaattttacctttaaagacgcattgcgagtccctttagttgagcagctgtttaatggaattacaccattttcgtctggcggtcaacctggtcaactgattgtgatgttgcagactgggattgatggtggccgcgccagctcggttttattaatgaaattcgttgtttatcaagcgatgatcgtcgtgaatttttttattagtttacttattggatttcactatgtggcaactaagttacatttcttggcactgtttgttctctttggatttttgatccatttttttgttattgtgggtttgctgatgattatgtattggccgactttcaccaaaaaagtaaccaaggttttgtttcatccggccaaatggtttatgaaagatgaaaaattttatacaactcgtgaaatgctctatgacaaaattgataatttgtttgaagaaagcgttcgaatcggccgacagcccatgttactgttaaaagtggttgtcctcacctttttccaacttttgttttattacctcattccttatttcattatgcttgctttaggatatagcaatgtgaatctggtgatggttgtcagtttgcacgttatgattgttatgattatttcgttatttccaattcctggtggttcaggaggtgccgaatttagctttgaatcgttattccacagctatatttctagtaacagcaaactagtcttagcaatgattttatggcggttgataacatattatttcggaatggctgctggtgcctttgcattattattaaaaccagataaagttgatgattccgatgagcaggcttaatttgccggttgttggacatttttggaggaacaagaatgatatctgataagaaatatcgtatttcaaatctcttaaataccaggttgggcttttatcttttagcggtattgctgttttgtatcaaaacgtacattgtttatcaaactaaatttacacttggtgttaagggaggccttcaagagttcattttggccattaatccaattcccgcagccttattaacatttggggttgcattgtattttagtggccgcctgtcatactggctgatgatgataattgattttctcgagacagtgtggatttttgctaacatcgtgtattatcgagaattttcagattttctatctcttggaattatcaaagggagcggaaatgtacagaataatcttggtaaaagtttggccgaaattgttcattttagcgatttcttcatctttattgacattcttatcttaatcggattgttggtcttcaaagtgattcgagttgatgcgcaaccgtttaaaaaaagatatgcgcttctattaagtggactttcaattattctgatggtgggtgaatatggactggctaatagcgatcgctcagggctgttaactcggacatttgataataattatattgttaagtatcttgggctaaatgagtatgctgctttcaatgcctaccaaacacaaaaggaatctgccactcggtcacatgcaaaagccagtgatatggatagtattttgaagtaccttgatcattcacgggcgaagcctaatcctgtttactttggtaaagaaaaaggtaaaaatgtttttattattcatttggagagttttcaacaatttctaattaactataaagtggatggtaaagaagttacgccccatttaaataagtttttccgtaatcgaaatacgattagttttgataatttttaccatcaagttgcccaaggaaaaacatctgatgctgaaatgatgcttgaaaactctttgtatggattaccacagggatcagccatggtgacgtatggtagccaaaatacgtatcaagcagcgccagcgatcctagatcaggatggttataccactgccgcatttcatggagatgttccaagcttttggaatcgtgacagcacttataaatcatggggttatcagtatttctttagttctcagtactataagacaaaaccatcatacagtgttggttatgggctaaaggataagatcttttttaaggatgcagctaattatattcaacagttgcctcaacctttttatgcaaagctaatcactttaacgaatcattatccttatctgttggataaacaaaatactgattttcctgctactaaaacgggagacaaaacagttgatccatacgtccagactgcccattatctggatcaagcatttgcggagtttatgaattacctacgtaagactggtttaatgaaaaacagtgtaattgttctatatggtgaccattacgggatatctaacaatcatcgtccagcgattgcccaattgcttcataaaaagactatcactgattatgatcttgcccagtttcagaaggtcccatttatgattcatgccactgggctaaagggtggtattaatcatacgtatggtggcgagattgatgtattgccgacattgctgcatttgctaggtgacaaggacaataatacaattcagtttggaactgatttattgtctagacaacatgatcagcgagttgcatttcggaacggtgattttgtgacgccacgctatactaaagtggggagtaatgtttatctgactaaaacaggaaagctgctcaagccaaatagtaagcaaaaagcacagattgcaagcattcaaaaccacgtcacaactgaattgtcgttgtctgatcgtgtcatctatggcgatctcttacggttttacacccctaaagggtttaagaaggtaaatcgtaaagactttgcttatcaatacaccaagggtatggaacagcttaagcaggctgatcaaagacgaccaacaagtatcgaagctaaaaatggtaataaatccacgatgaatttatataaaacagatgctcctgagcttaagtaattgttcagtttaattgtgtttaatgctaaaagcagtcttatcttgaagatgggctgctttttttgtcccttaatttttcttggtaatcagttccttcaaagctgattagtcgtctatccttgaatgtgagttggtaatttgtcgatttgaagacgttaaatttgtaaaattggtttcaaagcaattctgaactttaatgctgataccataaattttgttcgtataatagtgcaaaaactgcagatataaacatacaatatggcgaaaatcttgttttataagaacaatccgacttgttattcggacttttatcaataattacgcctataccaattggcatttttacgaattcattcaaattaattctgattttctcttgacgaacgacgagattttcggtatatttatttatgctgtttcagtgagtgagcgcaacaagcaaatttagttctttgaaatttcttgttgacaccgcttgatcagcatggtatattt

SEQ ID NO: 691 - DNA, 517653 bp, Unknown
  Metagenome-assembled genome
tcttcgtggtagttggttttgatgaacggacaggaaatgcccgttttttgttcaataataatatacaaaaaaatctgtcattaataatagattaaatctattaccaacaacagatattgtacagcctgaattattggctaattcaatagtagggcgatgccctatttatatgcaaaaaaagattgataccttacggtatcaaccccaaaaattttagacccatttttttctgaaacaataggtattataaaagtttgtcagcaacaaagcagaattgaatgaaattagttaatggataattattacgtttttatatgtaaaacttttacagttttagtaaaatgtgttttgctgcacaaaaaaacagcttggcatgaaataccaaactgtttaatcattaagaaggttaagccaaattacttagtaaaatcgacaaccattcgaccaacaatcttgttggctttcatttcatcgataatgtcgttaacttcatctaagcgacgagtcttaacgattggtgtgaccttaccctcagaaccaaattggaaggtttctgccaagtcttgacgagtaccaaccaatgaaccggcaacttgaataccatccaaaacagtcttatcaatgttaagtgccatatcacccttaggaagagcaacggctaccaagcgaccatccggacgtaatgcattaacggaggttgtgaaagcttcagttgtaacggcggtaatttgagcgttatgaacaccgccaactttcttttgaatttgttcggcaacatcaggatcatgacgattaatcgtaatatcggcaccattttctttggcagcatttaatttatccggattaccatcaacggcaacgacatgtgcaccaaaaacgttgtgggcgaattggacagcaaggttaccaagaccacccgcaccaacaacttcaacccattgacctggtcgagtttggccaactttgagtgctttatacatggtgacaccggcacaagttaatgatgttgcttgaaccggatcaaggccgtcaggaactttaacagcgtagtcagctggaacaataacctgttcggccattgcaccatcaactgagaatcctgagttttggacattccggcaaagtgtttcacgaccagtggtacaatactcacagtggccgcatcctctataaaaccaagcaattgaaacccgatcaccaatcttcaaattatcaacatcatcggcaacttgaatgacgcgaccgacaccttcgtgaccaatgattcttcctggcacttttccaaagtcaccagcggcaacgtgtaaatctgtgtgacataaaccacaatattcaaccttaaccaatgcttcaccttcatggattgggcgaagtgtgacatctttaatgtctacatatccatctacaggatctcgtacaactgctgctttcatttaaaatcatcctttttgtaatattttttcaacacaggttcattataaatggaggtttcactttattcaagtgaaaaaatacacaattagcataaaaatgaaaaatatttccaaaccttaagattgcttcgatttattaaagtaaaacactataattctcataattatggtaaaatgagagttatgttaaaatatttcaatgcatataataaacaaattaagatactttaggagagctgattatttatgagtcgaattttgattattgaagacgaaaagaatttggcgcgcttcgtcgaacttgaattaaaacacgaaggatacgaaacccaagttgaattaaatggacgtacgggtttacaagcagcaatagatgataattttgatgttatcctgttagatttaatgctgccggagttgaacggaatggaagttgctcgcagattgcgggaaaagaagaacacaccaattattatgatgaccgccagagattcagtgattgatcgtgtttctggctttgatcatggtgctgatgattatattgttaagccatttgcaattgaggaattattggctcgaattcgggcattacttcgccgaattcaaattgagaatgatcaacaaaagagcaataaaaaatcggttacatttaaagatttaacgattgaaaaggaaagtcgcatcgttcgccgaggcgatgaagtgattaatttaacgaaacgcgaatatgagcttttattgacattaatggaaaatgttgacgttgttcttgcaagggatgttctacttactaaagtttggggatacgactcagaagttgagactaatgtagttgacgtctatattagatatttacgaaataaaattgaccgaccaggtgaaaatagttatatccaaacggttcgaggcaccgggtacgtgatgaggtcatgactgattccaatagcaaaggtaacaaacgaaaaatctcgctgaagtggaagtgggctttttttacatccattggtgttttggcgatcgttgttgttttttcggttttaatttttaacaggtttacaaatgttttacttgagcaagagcgtatgcatatcagtaacacactaacaaccgtttcctcaagattaacgaactacgcttcccctctgggacgtaaagatgttaatcgctatctgcgcccgcgaatctccggcgacgatggtcaagttttggatagttcacaagataatgatgacaatatctattcggattcgctcattgttaatttttcacgtgataatatcttagtgaatgtatacggggttaatggaaagcaactttttgagtctcgaaaagatgcagttgattttcattcttctgataaacgaaagattgccatgacaaaattaaacggaaaaaaggtcatggttggtactgagccgttattgtcgaaaaagaatggctcacttttagggtatgcacaggtaacagacaagcttagcagttatcatgctactgcgcgaaagttgttagccattttggcgattctggtattgatttccgttttaattgccatgatttttgcctacattttagttgccgagttgttaaggccaattactgagattcagaacacaattaataaagttaaaagtgatccagatgcagacgttcgagtaccagaattaaatactcatgatgaattatcagatttggctgatttactaaatagcatgttggatcaaacacagcgatatattgatcaacaacagcagttcgtcgaggatgtttctcatgaattacgaacgccagtggcagttattcaaggccatatcgaaatgcttcttcgttggggaaaggacgatcctgaagtccttaaggaatctctgaatgcctctttgcaggagacaaagcgaatgaagagtttagtttcggaaatgcttgatctgtcaagagctgagcagatcgagttgaattacggagaagaaattacgaatgttaatgaagttgtgggtcaagtgtacaatgatttcaaaatgattcatccagattttacgtttactttggatgatgatactcatgacggggtttatgttaaaatttatcggaatcatttggagcaagtattggttattctacttgataatgccattaaatattctgaaaaacgtaaagaggtccatttatccttgtcaacggcaatggcgactgttaatattgcggttcaggattttggtgaagggatttctcaggaagacattgataaagtttttaatcggttttatcgagttgataaagcacgaagccgggataagggcggtaatggattaggattgtcaattgcccacagattaattgaagcttatcatggtaacatcacaattgaaagttcgctgggttacggatcaattttccaaattaatttaccgatcatgcagaatatgcctgaggaagatgataatgctgaaaatccaattcctggaataaaaactgttaaacactcaagtgatcgtgattcaaaaaaagatttaaatcatgataatgaggatgattaagactatttttagcgaaaattcgacgtttttgattcggttagatactattactaatgggtttgcaaagaataaatgaaattaagaaaaaataacctgagcttcccatattgggaggttcaggttatttttggtgcagaatttaaattaacactggctaatctagctgctataactagcgatgcttattttcgatgttgtttgccggcatttcgattgcgatttgtcggcttgggctcaggtgtttcgctacttgtggttgtggtattttcggaatgagatcgattttgtggacctgcatttcgttgcttaccagcatttcgttggcggtttcggtgatgaattgttgtccccgaagtctcttggctgccctgattttcagcaacagttgatttaggtaacaaatcttcgactgagactggctttttgccatccatttcctttgcaatgttctttcgaattcttggtcggtacatgttaatgataacggtttgaacacaggcaaacagaccaccgataaagaagtaaattcctaaaccggctggagccgaaagagtgaacaccaggatcatgacaggactcattaacatcatcgcgcccatttgtttcttctgagctttgggagttccgagtaacgttaagtaaccctgaagtagataagatagaaatgatagcaaagctaagatccaacttgactgccccaagcggatgcccataaacaccgtatgggataattctggagaataacgaatggctgcgtaaagagcagcaaataccggcatttggattaacaacggtaaacagccaattccccctgtcattgagattccgttttgctgataaagtttcatcatggcttgattaacagctgctttttcttcttgagtttgagcttcgcgctgtcgtttttggatctcacgcatttgtggtcgaaccatctgcatcttttcttgttgaattgttgacgccttcatttggcgaaccatgattggcagcaacaaaattctgacaagaacagttagcacgataattgcccatccatagctccctacaaattgtgcgatcatttccataactgattgagcgggtcgagctagataatcatacacaaatccgtatggtttgccagatttggtcgtccgaacacaaccacttaggaataatgcaatcgttgataatattccaagggtcgtaaaatgcttaatttttttcattgataagacctttcttaatttagatgtaaacaagagtaatattactcgattatccactagttttcaatttaatattttacattaaagcccttttgctcataattggatatataattaattgtgacgtcatgaatccgggcgaacggcgttggtgaacttttaattttgttaataaatgaatctagtttatcttcctgaccactggcaacaatttcgactgtaccgtctaagttgttttttacccaaccagatatgttatagtgttttgccacttgaatcgttgagtagcgaaacccaactccctggacgtgtccagaaatgattattttaactgacttaattgtcttgttcatgatattaaccacctaaaattagtttgataaaggagaacggtatgcaaaaaattacttcaaatcaaaattcacgtgttaaagaatggaccaaaatgcagtcaaaaaagggacgggtcaaatctggccaatatgtcattgaaggctggcacattgttgacgaagcaattaaacatcataaacagctccaagccctgatggttactgatgagacgtacttggaaaacctaccggtcgactccgctacagaagtctatgtgattacacctgaaattgccaaacatattgccgcaactgaaacaccacagggcgtttttgccgttctcgcaactgaagattatcatgaaacgattcccgacgatttggacggttcatggttgttattagatagtattcaagatccaggtaatattggcacgatggttcgaacagcggatgcagccggaatgaatggtgtcgtttttggaaaaggatccgctgatatctataatcccaaagttgttcgttcaatgcaaggtagccaatttcacatgcggctttttgccggagacttgattgactggatgaccgcatttaaaaagaacggggtgcccacatacggaaccgaactcaatgatcaggcaatttcttactatgatgtccaaccaacgaagaagtttggcctggtaatggggaatgaaggaaatggtgtcgatcctgaaatccttagttggacaagtcaaaatttgtatattccgatgaatggtgaagccgaatcgttaaatgttgcggtggccactggtattttaatttttcatttttgtaaataatgttcgttttcattgctatttacaagtattcctagtatcatatcaattaataaagggtaaaggggtattatatgcaaaaggatgaatggaaaaatgattctgaatattgtgatatagttgccgatttgttagcaaataagactgtgaaaaaaatggccaattataaacaacaccatcactcaaccaggcttgagcattctctagcggtttcctttgatagttataaaattgcgaagcgacggaaattggactaccgtgcggttgcccgtgccggcttacttcatgatttgtttttctatgattggcggacaactaagtttgatttgggttctcatgcgtttattcatccacgagttgcccttagaaatgctgagaagataactgagatttctccaattgaaaaagacattattttgaagcatatgtggggattaactcttgcccgaccgaagtacgaagaaagtgttatcgtatcgttggttgacgattatgaagcagttcatgagtttctaagcccgttacgaactaaaattaagagtcgtttacaacgtattgaaaccagtaaataaatatcgttcaatttaaggaggggaaactatgcgagaaagtattggtttacgaaatccaatcaactattttctttgtccaaggtttgaaaagacgttctcatttttgggaaagaaatggaatggtttaattattgatgttttattgcaagaaggtgccttgcgttttcgtgaagttgcacgtcagattcccaagtgtagtgatcgcgttcttgtagaacgattgcgggagcttgaggaggacggggttgttgtccgaaaggaattccctgaatcatcattaatcgagtattcattaactgaacaaggaaaagaattagcaccaattatggatgcaattcattcatggtctgaaaaatggtatccaagcgacgaaagttagcttgaccatttttttgttttagattatcattcattaagtaaatgcgtttgagaaaaaagtagtagataattaacttggtcagcgaatctgtggttggtgtgaacagagaaggtcaattattcgaattcatttttcgagctgaaattgggagttatttataacgaaaaattttccggtaatcaccgttaacgattctaagtgtgtcatttcttaagatggcaaattagggtggtaccgcgttgcttcgtccctttgtgggcgaggctttttttgtggctaaaaataaattggagggatactatgtcattacgtgatcaactcactgaaattaaggaaaaagggttaactgatattaaacaagtcagtgatttaaaaaagctcaacgaaattcgggttcatttattagggaaaaaaggaccaattacggccgcgcttagagggattaaagatttgaaacctgaagaacggcctgaagttggtagttatgcaaataagattcgtgatgcaattgctcaggcagttacacaacaccgagatcaactggaacaggcacagttagatgctcagttggcagaagaaaagattgatgttacattacctggaaaaccggtttcacaaggccaaccacacgtgattcagcaaatcattgatgaatttgtcgatttgtttttagggatgggctatgaagttttacaaggtccagaagttgaagaggataagtataactttgaacggatgaatttgcctaaaaaccacccagcgcgtgatatgcaagatacgttttacattagcaaagaaattttaatgagatcgcaaacatcacccatgcaagcccgagccttagagaagcatgatttttcaaaggggcctttaaaaatgatttcaccaggaattgtttatcggcgtgatactgatgatccaactcattcacatcaatttcatcaggttgaagggttggtcattgatgagcatattacaatggccgatttaaagggcactctgatcacaatggcccaaaaaatttttggcaataaattcgatattcgtctcagaccgagttattttccatttactgagccttctgttgaagtcgatgtgacatgctttaactgtatgggaaagggttgcgacgtttgcaaacataccggttggattgaagtactgggcgccggaatggttcacccaaatgttttgaatatggctggagttgattcaaaggtgtacggcggctttgcttttggtgtcggtcctgatcgatttgcaatgcttaaatatggggtcgatgatattcgtgatttttatctcgatgatgttcgtttcctaaatcaattcaacaagagaggtaattaaagtaatgaaagtatcttataaatggctgaaacaatatttagatcttaatatgccagcaaaagatctgggtgaaaagattgagcggacagcggttgaagttgactcagttgacgttgctcaaactgggttgaagaaacttgtcattggtcatattttgtccatgaaagatcatcctgaatcagatcacttacacatttgtgaagttgatgttggtgaagatcagccattacaaattgtgtgtggggcacccaatgtagcagctgatcaaaaggttattgttgccttgcccggctctagaattggtggcaatgttaaaattaagcgttctaaaatgcgtggcgttgaatctgagggaatgatttgtgcacttgatgaaattgggtttagcaaagatgtcgttccaaaggagtgggcagacggcatttatgtttttgacgacagtgttccagttggcgaacctgtttatcattatttaggaatggatgatccgattattgatttggacgtcactcctaatcgtggtgacatgttaagcattttagggaccgttcatgaattggctgctatttatgatcaacatgccgatatcaaaacaccagttgctaatgaggactcacaaattgatgtgaatcaagaaatttcagcaaccgctgattcgagtttggctaaaacatataaattgagagttatcaagggtgtgaaggttgcaccaagtccatcgtggttgcaaattaccttatggaatgctggtgttcggccgattaataacgttgttgatgtgacaaattatattttattaaaatacggtcaaccacttcattcatttgaccaagataaaattgatggtaatattcaggttcgtttggctcaacaaggtgaaaaaattacgacgcttgatgaggaagatcatgaactatcaaccaatgatattgttattgcggataatgatcatccaattgcaattgcaggtgttatgggtggatttaatactcaaattgatgaccagacgactagtgtggtcttagaatcagctatttttgactcgattagaattcgtaagactgcgcagcgccatgttttgcactctgaagcctcacaacgatttgaacgtggcattaacccggacacagttgaggcagctattgacgaggctgctaatatgatccaaaccttagctggcggtaagatcgcaaccggaattgtcacggcagctgactatcatccagagttgcccacaatttttatgaccgctgaacgaacaaaccatgttttggggactaaattaaccctggctgaaattaagaaaatttttgatcggctgggatttacgagtgaggatcatgaagatggcttgaatgttacaattcctgctcgacgatgggatatccacatcgatgctgatttatttgaagaagtggcgcgaatttatggctatgataagctacctgcaaccttgccaactggtcgacaaacgattggtgttttgactcagcctcagaaggttcaacgggcatctcggcaaatactcgaaggtttggggctaacccaggctatttcatattcattaacaacagaatccaaagccaaaatgttcttgatgcgtcaaagtgaggtgacaaaactactttcaccaatgacacaagaccatgccgttttgcggatgaacttattaagcggcttgcttgacgatgttgcttataatcacgcccacaaggtcaatgatgtggcattatacgaatccggacgtgtcttttataaggacaatattgaccaagttcgcccagaagaggttgaacatatcgctggagttattactggtaattttgacaatccagcttggaataatcatattaacccagttgatttttaccagatgaaaggcattgtcaaccaatttctcattaaccttggcattaatggtgatattgaatatacagctactgatcaatattctgatatgcatcctggaagaactgcgaatatttcgattcatggtcattacgtcggttttgttggtcaagtgcatccgaaagtaaccaagcaatttaaaattaaagaaacttacgcgtttgaattaaatcttcaggaattgattgatttgccgaaaaatgatgaccaatatcaaccaatttcaaagtatccatcaattaaacgtgatatttcgattgttgttgatcgccaaattaccaatgatcaaattctggcagttatgaagaaacgtggcggagcctaccttagcgatattcaactttttgatgtttatgatggtaaaaatgtaccggacggtaaaaaatcaatggcttattcgctgacatatgtaaatcctcgagacaccttaaaggatgaagttgtcactacggcatttgaaaagattaaaaaacggttaacagatgacttaaaggcggaaattaggtagtttcaaacatataattgagtgtagcagataggaggagctatcgatgagtaacaactcaaatgaacgaacccccaaacccaaccgaagtctagggcatcggatcattatttccgtcataaccattttagcaattttaattgtggcaaccggactacttggataccggtattttcaagaggctttaaaaccaatgaatccacaaaatacgcaggttagtcaggttcatattccgctaggagcatctaataaacagattggatccattcttcagaataaaaagatagtgaagagtgggatggtttttgactattacgttaagtcaaataatatgagcaacttccgggctggttactatcagttaaaaccatcaatgagtttgaaaaagatcgcccaacaattacaaaagggtgggaccgatcagccgattcaaagtaccaagggaaaggttttagttcgtgaaggcgccaatgttgatcaaattgcttctcaagtagccttaacgactgattttgatcaaaatgattttttaaccttaatgaaggatcaaactttcattaagagtttggccagtgattatccacaactgcttaattcagcaatgaaggcaaagcaggtgcgttatcgattggaaggatatctatatcctgctacttatgaagtcaagaaaaacacatcattaaaggcattagttattcaaatggttgccaaaacaaatcaggtcttgtcaccgtactatcgacaaattaagaaaacccatatgacgatgcaagagttcatgacgttggcctccttgattgaaagagagggcgttaaccaaaccgaccgtcgaaaaatggcgggcgtattgattaatcgaattaatattaatatgccgcttcagtcggacgtggccgtattgtatgctattcatcgaaataacaaaacattaacgactaaagatttagaaaatgattcaccatacaatctgtataagtatgctggctttggtccgggaccgtttgatagtccaagcgttagttcaattgaggctgttttgcatccattagaccgcaagaaaaattatctgtattttgttgcaaatacaaaaactaaaaaagtgtattactcaaaaacgtacgaagagcatcaacaacaaattgctaaacatgcatcaagtaataattaactagagaggtttcaaccttaatgacaacgcaaaagaaacgaccagttgtgattggtgtcactggtggctcgggtagtggcaaaacaactgttagccgcaaaatatttgatcaactttcgaattattcgattatgattttacaaatggattcttattataacgatcaagcaaatatgtccatggatgaacgagcaagggtcaattatgatcatccaatggcatttgattatgatttgttgattacccaattaaagcagttgcttgattatcaaccgattgaaaaaccggtttatgattataatctgttgacacgaagtcacaaaacgactcgccaggatccacgtgaggtaattatccttgaagggatattacttcttgatgataaacgtttacgtgatttgatggatattaaagtattcgttgatacggatgatgatattcggctcattagacgaattgagcgtgatatgggcgaacgaggcagatcattggatagtatcattaaacagtatctaacaactgttaagccaatgtatcatcaatttgttgaaccaacaaaacgttacgcagatatcattgttccagagggtggcgagaatcaagttgcaattgacctcttgacaacgaaggtccgttcgattttaataaaacgtggcaacaaacaaattaagaataattttgattcatcgatttaaaatcattcagaataaaggggaacgtattaaatggctaaagatgaaacatatccaatgactgcagagggccgcgataagcttaagaatgaacttgaagatcttaaagttaatcagcgtcctaaagtagttaaacgtattaagattgcacggagttatggcgatttatcggaaaattcagagtatgaatctgccaaggatgaacaaagtatgttagaaagtcggattacaacgattgaacacatgttgcaatacgctgaaattattgattctaacgcaagtgataaagatgaagtgacggtcggcaaacgggttacattccaagaactacctgatgaagaacctgaaacgtatcaaattgttggagctgccgaagctgatccaatgtctggtaagatttcaaatgattcaccaattgctaaaggactattgggtcaccgtttaaatgatcaggtaaccattcaaattcctgctgggaatatgaaggttaagattaccaaagttgaatagtttgaatgaactgatgaatttgcttataacaaagttctaaacagattcatttaaagggctaaggtaaacatgaagtttactttggcccttttttgttttgaccggatcatgatttttatacgtggggagtgacagatgcttgaataattgattctatgggcggttgatctcgagcgcggttaccgaataaatacgcttattagctgaatagcagccctttatctgaaagattggattgtgattgtttgtgaaatatgagaacgatgatataattgttgtaagcgaattcagaagacgcagaaaaacaatttgggagagtgcggaaaatgaaaattgaagtaactgattctgcaagcaaatggtttcaaaatgaaatgggactggccgaaggtaatggtgttcgtttctatggaaaagtttatggaaaaacaccggttcatgatggcttttcgctcgcattaacccgagatgaccatccagaggaagtttatactgaaactaaaaaggatggcattacttattttgttgacgccggtgatgagtggttctttaagggatacgatttaactgttgattttgattccaaaaaggatccagacaatgttgtttatacgtacactgaaaatggtgaactgtaagaactatgttttgcgatgtatggttaaaacgttaatatcagtaagcaaaaagaggattcagaccacttttaattttggtcgaagaatcctctttttatctgcaagtagcatttaaaaatttagtcgtactttttgcgcttttttaagtaataatccgtcccgatccagatgcaagtcattccagtaattaagataccaggaaataacccaactggccaataggtgaatttaacttgatggtgtcccttgctgattggaatatataggaacattttggcccattgtctaggtgttacagtatgattatcaactgttacgtgccacccttttgaatatgggatggtcgttgtaagcgactgattatttgctttgacattaatcgtgccatttaatgtgtggttattccattttttaattgaaaaaggttgtttcttaagtgaatgagtcattttactgaattttgcttggttgaactgataaatgttaacatcttgcaaccaaacattatctgcagtagtcataaattcaacgttgacggttcgatcatgatctgtcgcgttagcaatatttgcaacaaccattttctttgacggccggaactgaaccagattttgaccatcaaccaaaatagtaagttgtttatcagaaatatcaggaccaagtgtcatgtagtatgatgtatgtttttttattggaactttaattgtgaaatatgattgcgccatcattttctttttccgaatgacagagttatttagcttcatgatggggtaaacgttatgatatttaatatcactataattagcaatttgaaacagattgccaatatttggagataattgacgagccaacttattttggtaagcaataggattattaggaacgcgactattctttagtcctttactaggcgttacaaagccgattggcaatgcataaggatttttatatgttgaaatcaatttattttgtgaggttaactgataatttcctaaatccggtttagttgttagagcgttcaaaaattgtgttaattttactttcccagggttggttgtttgaattggtcgctgattaagaaaatacttcatcgacaatagtgagtcggtaaacagagtgccgttagaatagaaaacgtaggcatcgccattaggttggccaatatcacccataaaatttgaggtatcggattcaagcgttgaagaaaaaatggaaccgccgttaaagttaccggttaatgcatcatttttagttcgagaaaaagtcgttcccattcgatagaaacttctatctgtttccttgatattgccaacagtttttctaacgatactggcaaagtttgtgtaatccgaattattgaggtaggaaatattgttaaacgagttgataaagttaagactcatttcgcccgtcattagaaagaagatagcgagtgccagaatgaggttctcgtgatacaatcctaagaatgtaattatgccggcacttaaaattaagtaaacccatccccaaagataatttgactgattcaagtattcaaattgcttcataaatacgccgaggtatgtcattgccaacataactacaaccatactgacagcataacctttccagtggatgccgttttttatgatatccatcaaagcattaaaagcagtgtaaatcatccaaaacgaaaagataaacgagaagcgatatgggtaccatactggtagttgcatgccatgccaaaacaaatcgagaggttgaaaacacatcgagaggataaaaaaggttgttagtgcaaggtttgcaattttaaaatttcgcttagcttgtgagccaaagaagtaataacaaaacagaataacaactaagctggcaacgaatacattggcagttccatttggcagctgtttaaaatcaaatgccccgtttacaaattttcctaaaatttgtaaaggattgtattcaaacctgatacgaaattcatttttagaatactgtgttttactgcttaacaacgaaatgaatgttggaattaatatccaggctgataacccgccactaatgatcgaacccttcagccattgaagaattcggcggcgagaggtttgattacttttggggaatgctttagcgaacccaaagattaacatgtatgctgttagaaaaatagcgatcatccagcccatgtagtaattaataattaacatggctgttaagctgattatgtatagcttaatcgaaccaccctttaagatgcgcaggaatcctaagaaaataattggcagcagaatggctgcatcaatccaaagtgtattgagttgattggcgaccatccagcccattaaagcatatgtagtggcaaatccaataaccggccagtttgtcattgctttttctttaatgataaaatagccgaagctcaatcctgacaagccatatttaagaattgtgataatagcaatgacactgggaagtttttcgacagggaacaacagtatgattaggtttagtggactcataaggtaatagctccaggtcccaaacatatcaccacccagtccctttgcaaacgagtaaaggatgccacttggatcatggagcagcgtatcgtgataatgagcgaaaaagtctacgtattgttgacccatatcgacagttaaaactgaagagaatccaaaaggagcaaagtgcctaaaaataaaataactggcactaattatgattgggactaaaaagcacatgattaatgttgttcgtcttgatttcatattttaatcgtccttttcatcaaaaataaatgtcaacatctagaatatcataataagttaaagattgaccaacggttctagtttttgctcgaaaaatttgatagaattaaatccatggcaaggagtaattactttgaaaatttttaagaaacgaaatcgaaataaaaaggtaaagaagagcaaagcagcttcattaccttttagaatcaacattatttttattgtggttggtattttatttattgcattactgacacaattggcatatctacaagttatgtatggatccaaatttaaagccgaggttaatcgttcagatacgtcggtcgtaagcggcaatgttcagcgtggcatgatttatgattctgaaggaaaggtattggttggtaattctgcacaccaagcaattgtgtatacaaagggtgttaacgagttaacaactgatatttacaagacagcaactaaacttgctcagtatgttaaagttccaaccagcagtttaaccaaacgccaactagcggattattacctatcagagccagaccgactaacaaatattgagggcaaactttctggtttgagtggctatagtgctgatgcaaagtacaacaaagcattggcatacgttgaaaagatgccatcagttacgtttagcaaatcaatgaaaaatgccgcaacaatttttgccaagatgagtggtgcttatcaattatcaacggttaacattaaagatgatcacgtttctcaaagagaagttgccgaggttggtgagcatctttcagaaatgtctggcgttaatgttggtacaagttggagccgtaactatcctagtggaacagccattcagggaattaccggtaccgtatccaacgaaaaaaccggattaccaagtgatcgggttaatgagttgctggcacagggttattcacgaaacgatagtgttggtcaaagttatttagagcgacaatacgagccggttttacgtggtactaaatcacaaactcaagtcgtactaaatagtgataatgaaattaagaaagaaattaaaaaatacggtgggcaaaagggagataacctgcagctaaccattaacggtcgttttcaaaagaagcttcaatcattggttcattctgcggaacaaggtgccggcggcaattcgacgggaacctatgcggttgtgatggacccagacaacggtgcaatcattggaatggccggagttaaccgaaacccatcaacttccaagattaccgataacattttagggacaatcaatagttcgattgttatggggtctgttgttaaaggagcgatggtatccggtgctttgatggatggtgtgattacaccgactaacagcacattgactgatcaaccgattaccaccggtggggttaaaaagtcatcgtggttcaaccacggtgggagtgccaatattgctgttgacgcaagtacggctttagaggtttcttccaactcgtacatgatgcaattagctatgaaggaagggcactttcactacgttgagggtggtgccttgaccatgaaaccgacggtctttaacacaatgcggggctactttaaccagtttggactgggtgttgatacaggaattgatattcctggtgaatcaaccgggttgaagggggctagtggatcctctcatattggaagtgctttggatttagcatttggtaactatgatgcttatacgacaatgcaggttgctcagtatatgtcaaccattgctaacggcggttatcgaattcaaccacacgtcgttcaagcaatccgtggtacaagcaaagatggtgaactcggcaaaattaaagcaacggtcatgccacatgttctaaatcaaattaatatgacttcgtctcaaaaagcggtggttaaacgtgggctgtatgatgtggttcacgggactaacacatataagactggtgggatgttggacagtatcaaaccagagatttccgctaaaaccggtactgcccaaaccttttataagggaaatgaaacggttacgttaagtttagcctcatacgcaccatcaactcatccacaagttgtcgttgctttggcaatgcctaatttgggcgttaatgctgagagcaataacatggcgcttgcaaagcaaatttatgctgcttattggaaatatgttcagtcaacgtcaactgttaagtaaaaatacttaacatttattgaattacgcctagtaattttgcgtaattgatgataaaatactttaagttgaggctattaagatagctacatttttaattaaagaaagtttggaggtagtattccatgcgagtacacattacaatggaatgtactgaatgccacgaacgtacttacttatctagcaaaaaccgtcgtaacaatcccgaccgtttggagcttaacaagtattgcccacgtcaacgtaaagtgacattacatcgtgaaaccaaataaggcttggggaatttaacccaaaccttttttatttatcatgaagccgtctctttgaccatcatggcgacagtctctgagtttttctgtaacgtcatatggcacaaatggccttttcacgggcttataagtttcgtcattcaaattgaggtaaactgaattatccttggttggatagatcgttaggacacgcttttcaacggcgtttaaaacgaatggtctggcttccagccgatggataattaactaattagctagctggtggtgatagtgttggaaacaaaaaaacaacttcgaactgcacaactgaaaagaattcatcattttttacggcgtgatgatgccgatcaattacttgaaagcctttaccagcggttatttgtcgatccagactttttgaatagtcaaatgatcgggattacgttaagcatggctgatgagctcgatactcaaccgattattaaccgggcacttcaaagtgaaaaacaagttgttatcccaagaacgttgccaaaacggcaaatggaatttgttttatacaatggccattcaaagcttgaaaccacgaaatttgggacaaccgaaccagtcggtggtcaagtagtttcaaaaaatgagattgatgttttaattgttccgggattggcattttcaaaaaatcattatcgtgttggttatggtggtggattttatgaccggttcttgaagggatttaatgggacaagtatcgcagttgcaatgccgccacagctttttgaagcgccatcttggacgcctgaagacttcgacgtgttaattgataaaattatttattagtagatttgtttggaggaaactatgagcagattaagaggcaaaccatatatcacgtatggcttgttggcaataatggtgatcgttttcatcataatgtctttgatgggcggtactgaaaacggcgtcactttgttcaactttggtgcaaaatataatcccgcaattcgtgctggtgattattggcggctgattacaccggtattcatccacattgggttcactcacattttgatgaatgggatcacattgtactttattggtcagtacgttgagcagatttttggtcatgttcggtacctcattattttcctggtttccggtgttatgggaaacctcgcaagttttgcgtttagttcgaatttatcagcgggcgcaagtacggcaatttttggattgtttggtgctttcatgatgctgggagagagcttttcgaataatccagcgattgtctcaatggccaaaacattcttactattcattgtgttaaatattggaacggatattttcgttcaaggtattgatattgccggtcatattggtggtctagttggtggctttttaattgcctatctcgttggtgtttcttttgcaaaggtgagtccggttaagcgagttattgctacaattatgctggtggttatcgccgtcgttctcttttcggtgggaatgcaaggtaatttttaaatatttttcaaagtcctaagaaatttaactgaggatgtgagataatgaaaacgctgtatgatgtgcaacagttattaaaacagttcgatatttatgtctacgttggtaagcgactttgggacattgaggtcatggcgttagaattggatcatctgcataaagctaaattgatcacaaatgaccagtttattcatgcaaagctaattttgacccatgaacatcgaattgaagaaaaacatgaaagcagggggaattatcgtggtaaagcagaaacgactaatcggaattgatcttggtggcacaacaactaaatttgccttcattgacaaagatggtaatattttaaccaaatggcatattaaaactgatataagtgatcatggtagtcatattgtgccaaatatgattaagtcaatttcagatcaaatgcgaaaagaggactacaattcacaagacttctatggaattggcatgggaactcctggagctgttgatcgtgacaaaggaacggttattggcgccttcaatcttggctgggacacacttcaaccagttggcgcaacattatctgaaaaccttaatttgcctacgatgattgataatgatgcgaactgtgcagcaatgggtgaatattggaagggtgctggtgacaaagccgacgatgttgtcttcgttactttaggtaccggcgttggtggcggtgttgtgacaaacggccacctagtccacggaattaatggtggtgccggtgagattggccatattactgtccaccgcaacggatttttatgtacctgtggtaaacggggatgcttagagcaatacgcatcagcaaccggtgttgtgaaagttgccaaagaaattgctaagaaatttactggtaagtcacgaatcaaagaattaattgccggggatgaggagttaacctcaaagatggtgttcttcttggcagataacggtgatattctagctaatcaaattgttgatcgggtctgctcatatttaggtctagcgttatcgcatgttggtaatactttaaatccggaaaacattattattggtggcggtgtttccaatgccgggaatacgttgctccaaccaactactcgttatttccaagagaatgcctttccgtcagttcgagattcaaccagattgaaattagcacagttaggaaatgatgcaggtgtaattggtgccgcttcattagcccttcagtttcgaaataatcagccattgaatgtaaaataaaagagggatattaattaatgaataatgccaatacttggatgacaattattttaatcattatgatccttgcttgggtaggttacacggttgtccagaatatgcgcgtaaaaaaggtcgctacatatttgacgaacgataaatttcagagtggtatgagaaaagcccaagtaattgatttgcgagaacaaaagtcttttaaagacggccatattctgggtgctcgcaatttgccatattcaacaattagaaacttttatcatcaaattcgtcctgatttgccagtgtatttatatgaccaaggcaaaacgattagtaaaagagcagccctttatctaagcaaaaaaggttatcatgagctgtatatcttaaaaactggttatcaaaattggaatggtaaagaaaaaaagagtcataattgataaaatagggctgaccgcaaagggatctgattttgcggccggtcctattttttaataaaaattgtcattattgataagttgtcgcttttttgacaattaattgaagtttgctaattattagaataaaaacagaatgagacaaaagtcggttaactttcagagtgcaattagattattcaaatatgctccgggtaaaatagtgggatgattcggttgcacggcagaaagttgcctttggcgctcgtcttcactcggtaataattgtgatgacacaaaacgaggctgaacaaaattacttttgtctcagcccctaccgcttagtcaattagtcgactcttgtacttagtccatttggataccggtctaggttcgttgactaatcccaactgtccttaggttacttgtgttaattcattaaccgttgtgagcggctcggctttttcgcagtgcccgtttacggttatcttcaaatttctgttcttgatcctcaattggatcaacaacggacttcttaaaagtaaataatgcgccaagccctgcggcaactgttcctaaaacgccgacaactaaaccactggtaaaatgtttcataattaaatacctccaatgcaacttttatactttcattatgcgttatttacgcgaagatatctagtttattgattaaaatttcacaattatgaggagaacaaaatggaaattgatacaaaaattattgcccaccgtggcagtcgggggacacgcccggaaaatacacttgtttcatttcaggcagccatcgacgacggttgcgaagggattgaaacagatgttcatttttcaaaagatcaacaattcatcattatgcacgacgagaccgttgatcggacgaccaatggtactggcttggtaaaagataaaacgctggctgaaatcaaacaactagatgccggctatcgatttagtgaagaattcaaaggaacaagagtcccaactttgcaagaagtagttgcgctattgctaaaaaataattttacaggaatttttaatcttgaattgaaaacaaataaaattcattatccaggaattgaaagggcgatttatgaatatttttcatcaattcattatccattccaactcatttattccagttttaatggtaaatcgctggagattttaaatcatattgatcctaaagctgttgaggcccgaatttttacaacagctgcaaaacaagccaaaaccctcaaacgcagcaaagtgattgaggactttcatccagatattaagtggctaaaacgacatcctttttttgccccggctcgccacttgaggccatggttagttaatgcaactgaggatatgcagtactgttttgaaaaaaacatggccggaattattacggactatcccggtagagcggttcaattaagagcagagatgcgaggtgaatgaatttgaaaaaagtattagcgatcgttggaccaactgcggtcggcaaaaccgacatgtcaattagactggcaaagcaatttaacggcgaagttatttctggagattcaatgcaggtgtatcgaaaacttgatattggaacggccaaaataactgaatcagaaaagcagggagttgtgcaccatttgattgatattcgcaatattgatgagcgttattcggtagctgactttgtgtccgatgcgactgagctaattaatcaaatttccaaagctggtcgtttaccgattattgtcggtgggactgggttttatcttcaggcacttttggatggtttggaacttggcggggatcattacactgatgatcacatcaggaaggaactatttaagcgggcggcagaccaaggaaataatgaattgcatcgccaacttgcagccgttgatccggtttctgcggccgcaattcccgccaataatgttcggcgagtcatccgggcattagaagtttacataaagaccggccgtaaattttccgaccagactaatcattcccaaccagattttgattcattcatcgtggggttaacaactgatcgccaaaaattatatgatcgaattaatcaacgagtcgatctgatggtaaaggcaggtatcctagatgaagcacgatatctgtatgatcatggtgccaccgggcttcaagcgggaaagggcattggttatcatgaattctatgattattttaacggatggatttctttagacgaagcggtggcattagttaaacaggattcaaggcattacgccaaacggcagttgacttggttccgtaataaaacgcatcctaattggtataacattattgaacaccatgccgatgttacccgcttaataagtgacgtctccaaatggctttctgaaggtgtttagaaaatcaatgtcataaaatataacattagctattgacattgcccttggtaatggtattatagttacaagatttaggaggtgaacaatgcgagagaaggaactacggcgttcaatgtcagttctgccgattggaaccgtaatgaagctgactgacttaactgcacggcaaatcagatattatgagcagcaggatttaatcaaacccgttcgtaatgaaggaaatcgaagaatgtattcattaaatgatatcgatcggcttctggaaattaaagactacttggatgacggcctcaatatttcagggatcaaagaggtctataaaaagcaatctcagttggaagacgagcgaaagaagaatcttaaaaagggtctgactgatagtgatgtcagaagaattcttcaggatgaattccttaatatcggtgggctgaagccaccttcttcgacgtttgataatccgaataatttcaataaatttaatcactgataggagcgttataaatggcgacaaagcatgattatacaaaagacgatattcgcagcatggtaaaggacgaagacgtaaaatttttacggctgatgttcactgatttatttgggacaattaagaacgttgaagttccaattggtcaattagacaaattacttgataataaattgatgtttgatggttcttcaattgaaggatttgtccgaattgaagaaagtgatatgtacttacacccagatttgtcaacttggatgattttcccttggagtactgatcgcggcaagattgcccgggttatttgtgaagtttacaccccaagtggtgagccttatgctgcagatcctcgaaataaccttatccgagtacttggtgatatgcgtaaagctggttttactgcttttaatatcggtcctgaaccagaatttttcttgtttaagatgggtgaaaacggcgaaccaactttgcacttaaatgataaggggagttacttcgacatggcaccaatggatcttggcgaaaattgtcgtcgtgaaatcgtcctaacacttgaagaaatgggatttgatgtcgaagcagctcatcatgaggttgcccctggtcaacacgaaattgatttcaaatatgcagatgcactagctgctgctgataatatccagactttcaagttagttgttaaaactgttgctcgtaaatatggtctttacgctacctttatgccaaagccattgagtggtattaacgggtcaggaatgcacattaatatgtcactatttactgatgctggtaatacattttatgataagaatggtgaacttgaaatttcccaagaagcttattacttcttaggcggattattgaaacatgcccgttcgttcacagctgtatgtaatccaatcgttaactcgtataaacggttagtacctggctacgaagctcctgtttatgttgcttggtcagggtcaaaccggtcaccattaattcgaattccaagtgcccgtggtaattcaactcgattggaacttcgaagtgttgatcccactgccaatccatatttggcaattgctgctgttttggaggccggccttgatggtttgaagaataagattcaacctgaacacagtgttgaccgaaatatttatcgaatgaacgaagaggaattagcaaagagtcatattcaaaatctcccagatacccttcataatgctttgaaagatttggaagcagatgatgtaatgagaaatgccctcggcgagcatttgtttaacagtttcattgaggctaagaaccttgaatatgattcatatcgaactcaagtttctggctgggaacgtgatcaatacctcgaaaaatactaatatttaatttgttattaggtaatcaggtactggctttgctaaagaatggttgatttagtaatgagtgagaaatcgcaaatattagaattaataaaaatcattctttacaaatgatgttttggcggttaactaccgttcataacagcaactatataagttatagcaatttgtgttacatgttataactgtaatgagcccgcaaaagtacacttaccaaattggttagtgtacttgtgcgggctttttgtatcaaaaaagcatctaattcaaatttaattaaatgatattttaacttgaatttgattagttttaagtgaaaatccgtattaatcaaagttcagaaacaggcatcgggtataaattttggttgctaggttaggaatattaggagtgagttaaaatatggaaaaaaagcatttacgtaagctaatgtgggtagcttctctcggattaatcttggcaggctgttcgtcacagcaaagtgggtctggaaaattagcagataaacaggaatttaccacagcaactgattctgaattgtcaactgttgatctttcaaaaacaacatctctgcaaacctttgaaattttgaccaatgttgacgagggactttatcgattaggaaaaaatagtcacgcagataatgcattagctacaaaaacggttgtttcaaaacacggattacaatatacgttcaatcttcgtaagggaaccaaatggagtaatggtgatttagtaacagctaaggattttgtctattcgtggcaacgaacggttaatcctaagactgcctcacaatatggctatttattttcagggattaaaaatgccgacgccattcaggatcataagaaatcgtatcgaagccttggaatcagggcagttggtaaatataagttagttgtaaatctcgaaaaaccaattccgtactttaaagttttgatgggctttcccgtgttcttcccacaaaatcagaaagtggttgaaaagtatggaacgaattatggaactaagggtaaccggatggtatataacggaccatatcggttaacaaattggaatggaactggaatgacttggactctggccaaaaataaaacatattgggatgaaaaacatgtcaaacttgataagcttaattaccaagtaacgaagaatccatcgactggctacaaccaatttaagatgggaaagctccagtatgtcggcttgactggaattttagcgaaaaacttgaaaaataataaagatttagtttcgcgaaaatcatctggttcctattatttagcgttaaaccaaaagaagcggatatttaagaacttgaagatcagaaaagcaatttctatggcaattgatcgtgatcaattgacgaataaaattcttggagatggttcttttaattcacaaagttttgttgcaagtggtttatcgattgatcccaacaccggaaaggactttaccaagtcgacaaataaaccacagtcaatgacatttaataaggatcaagccgcaaaattatttaaggagggactcaaggaacttggaattaaaaaaatgaaatttacaatcttgaactctgatgaatactcttcaaaacgagttagtgaatatttacaggcagaacttgaaaagtatttaccaggcttgactgttcaattaagaaatgtgccatttcagactttgctttcccgccaaaaaacgcacagcttccaagtaactgttggagattggtatgcagactttgctgatccaattacctatttaaatattttaactactggtaatcctagcaacgtttctcaatggtctaacaagacatacgatcgcctaattaagaaatctgcttcaacggatgctggaaatgctaaaaagcgatttaatgatttagtgaaggctcagaatgtgttacttgaacagcaaggaattacaccactttatcaacagggcagcatgagtttgttgagtagtaaggttaaaggcttagtttatagccccgctggttcgaataattataaaggtgtttatattagtaaataatttctttggttaattttcaaagtctagtagagaagctgagcagatgctattttgcccagctcttttgttggtcattgtgatggaggtaatttaaaaaggttggaaatttgatgacattaacatgaattcatcatcttcttttaattgatgaatttaatgtcttcttttcttgttgaatgttcaaatggcctttattgatttttaaaaaataaaacattatgaaattattagattagggctttatttatcatgacttttccgataccattaaatgtataaataacggggaatgaggcaatactatggacagacaaactgaaacggatcagttcagtcagaatgatgatcaattatcttccgcgcttaatcagaagataacatatcttaatgatctgaatgattccgttaaaaatggtaacgatttaaagatctatgagttaatggatcccaatcgttttgcgactgagttaaaaggcgaagattctgatcagtcaaaagctagtttttttggattagcatcagatttgaacgcgcagcttagtcatcatttaagtgataagttaattgattatttgggggcgacatatcctttcttttattatcacgaatacgaactgggcaaattcaatgtgtattttggaaattggtgggatcatcggttattcggtcaacttgatccgattaatgtgcggtttgattttgccgaagacgaatacaataaattatcacaatcatttagtctagagactgacaataaacgcgttaatgatgatgaaatgcgtcaattagcagagaaaaacgagtaccttaccaaactgattcaagaccaagataaacgcgatcagcgtaaagaagccattcgtcaacaacttaaggaaaatgaggaaaagtcaccgatgccctgggaggctggcaaagtaaaggaagagcgtcaacgattgaacgatgagatgcttgagctcacaaaaactgatgagcaggcaaccaacggtcggtcaaccattaaacaaaacgagaatgagattcttgttttatctaaggaagaaacgattttgagtcttgaaaaacagaatattagagcaacttttgggagctttgaagcctttatcgataataataatcacctctatacaaagtatctgcagagtttagataaagaatcgcaggtgagtgatggtgagtaatgaaaatgaagaccggaaaataacaactaatgaacttttagctaattatagtcatgccattcaaagcggattggataacgggacagcgtatatcaagtcgtttaatgttttaaatgaaactcaagatacccaggaattattatctgccgctgtaaaactcacaagttttcaattggacactgattttgtgacgttccctcataaattctctgatgaagatattcagcttgtctttttggaacgtttgttaacgctttctggtattgaaaatgaacttgtcattagtaacccagaacatgttcaaaaattgctatgtaaatttagtgagttgggtgataaaacctttactttttcacgatcaagtaaaaatccagatggctttttcttcggaccaacaatgatgaatcgaccgcttttttatgttaacctcaaggccaaagaattaatgtttcatgggtcgtcactaattgaatactttgtggttgaccttgaagggattaaaactgatgaaattaagagtgctttgcaagttatggtaaaggcggctcaaattttgaaagaaagttttggttttaaaattgactttaatgtcctcgacagtgttaatggtgaattttatgcgtttgcctccggtgacttaccagattcaattatggatgaattattcgtaaaatcggctgaaaatcactttatcctgatgtctgcccaaaatggtggtgcatcgttaacattggacgataaaacagaagtgaccgtttatgatgctggggatgcatctcgaccaaaatggggtgctacgattcatgatcaggatcaaaaagagagctggctgtgtcttttgttggattatccatttattaaagaatggtatttaagaaaccaaaaacagctggaaattctctctaatcaatttatttttggataggagattttcatggatttacaaagcttaatgacatcatcagtttttttaaaccggcaaattgaagagaaaaaacaattacattggtcaaatgaagctcgaattaagaacgcatttgtttcgttggatgttgaattgtcagaaatggcgaatacgtcagaatggttcaaagtttggaaaattcatcgcggcaagagtgaaccaaataagactccaaaggaaacactgctgtatgaatacgttgatgcccttgatttctatttgctcatctcaaatttgaagaattggaatcattttgttttgaattctcaagatgatctttcaaaaattaagcagttaaaaaaggaagataatttggataagcaatatttagcgatgaagcgaatgctatttgatgcctattttaaccacagtggtgatagctttaatcattcatggcggttgtttttgaaatttggtttagttgatttcgggtttaccgaacaggaaatcgaaacagcgtttaatgataagaatcagattaatcaggaacgacaaaaagacaattattaattagcatcgtgggagtccaggcaaaaaacaattttacctggactcttttttatagaccaatttcaatctaattaaaactggtaagttcaagcgagttaaactggatttttaagtgacatgataaaggctgatcaaactttacagacggcaatcattttttgaaaataaaaaatcagccgttctcacagctgaaactttgatggataattgcacagacacttttccacggttgattttttattttcgttgagctaaatgcttgccgttctctttcatggatgttggagaaccgacaaaatactgaatcaatccacaaactataaatatgaagacaataaatagaacgaatcccacaacttccacctcctaaaatatagcggcagaaaaaccgcctaccttgattatcttttcttaatacttgtgattcaaatatttcgcatgagtgcgtctctaatttaataaaaaataaattttcttaaggaaatcataataaagccattccgggttttatcgaattaacattgactagcttgttaatatttcatataattgtccttgttgatttgtcgcaatagctcagctggatagagcaacggtcttctaaaccgtaggtcgagagttcgaatctctcttgcgacataacactagttttgttgatatagagtaaacggctaaggcaattatgccttagccgttttgtcattcataactataaaaagttggtgctgtcctcaccttaatggatttaagaattatgattcttgtgaattttgaaaaggtggtttatctactagaatttttagaccctttttttaactggttctccaagtccttcatttccaactttaaagttatattttcactttcaatatgtttcagtgttttaaagattttgtttaatcgatcgtcactatcctttttagtgaagaatgtggtcattgtacttgttaaggaaccaatgaaaccaataccaatgaacattaaaaggatagcggcaattttaccaataaccgtatgaggtgaaatgtcaccatacccaacagtcgttgcagttgtaattgcccaccaaagcgattctccccaagagacattttcggctaaggcatacaatgtagttgacagaagtaaagttgccaaacttgtccaaactaaatagataaatccattggtttttaaaatattatgagaatatttttgaattttaccaataaaaccaacgaatcttatgaagcgaaaggctcgggcgactcttatcaatctcaaaatgcgtgcgaaacgaaaaaaactaaaaatcgagtaaaaaggtaaaattgctagtaagtcaaaaacattatgtttaaagaaatcccatttgtcattgcttaaaaataatctgatgaagtaatcagcggtgaaaattagcaatatgccattatccatttcgaaccatggtgattcgtctaaattgattgtttttgaaaagtcactgatggctaaaactattgagaatagtgctagaataacaatggttacgttatacatttttacagtgtgcttattcattggacctgcctcgatttttaaatgattttgtaatacggttcagatgtttttctgtcgtttacataacccatcacatctgaattgtaagatatagtccgtaaaagtaaagtgtctcactttgaattggcgacggttggatagtcatcgttacctaatgattgatacggcttaacaattaacaaaataaggggtaatagattatcttcaagctttctattgacgaaggtcagtcaattatgtatacttgtatcgttgtaattgtggcttccacagctacaaccgctcgattcgagctatcaagttcctttttaaagggcgctttgtttcggcgagtctaagcaaaaatacaaggaggtgcacaacatgtacgcagttattactacaggcggtaagcaatacaaggtttcagaaggtgacgccatttacgttgaaaaattaaacgcaggtgagggcgacaaagttacttttgatcaagttgttatgctcggcggtgattcagcaaaatttggtacaccattagttgatggcgcatcagttactggaactgttgaaaaacaaggacgtcaaaagaagattaccatcttccgttacaaacccaagaagggttcacgttcaaagaagggccatcgtcaaccatataccaaggttgtcattgattctatcaaggcttaatttaggtttgaggtgactgataagatgattcaagcaaccattcaccattatcgtgatcacgtgagcggctttacgatcaccggccatgctgatgcaggggaatacggacaggatattgtttgttcagctgtttctgttctaagtatcacaactgttaacggcttacaagaggttgttggtttagacgttagcgtcgatagcgatgataaaaatggcggctatttatcagttgaaatccctgttattgctaattcaaaaaagggtctccaggcagatgccattttgaagacctttgaaaatggcatggcggatatcgcttcaagttatagtgattatattaagttaaaagtagctaattaaacaagttaaatctggaggtgtaaacctatgctagcaatgaatttacaattcttctctcaccataaaggtggtggatcaactgctaacggccgtaactcagctggtcgtcgtttaggcgccaaagctgctgatggctcatcagtacacagtggttcaattatttatcgtcaacggggcactcatatctatccgggaaacaatgttagtcgtggaaacgatgatacgttgtttgctttggtcgacggtgttgttcgcttcgagcgtaagggccgcgataagcgccaagtttcagtttatccagttgctgaaactgctaagtaatcttttagttttttcaaaaagggccggttagggtcctttttttgttcgaatgaatgatatccgaattaaaacatttttataagttgattggatgtcagggtaagatgttaagaatttaaggttattcacgaaaaaatggatatttgacattaaagtattatataattattgtatgttactttatatttaggaggaacaaaaatggcaatttcaactgctgattttaaaaatggattaactatcgaagtcgatggtgcgatctggagaattttgagttttcaacacgttaaacctggtaaaggcggcgcatttgttcgttcaaagttaaagaacttaagaacgggtgccgttcaggaaaagacattccgagccggcgctaaaatggaacaagctcaaattgattctcgtaatatgcagtacttgtatgctgacggtgaccaacacgttttcatggacacagatacgtatgatcaaatttcaattccagctgaagaaataaaatctgaactcaagtaccttcaggaaaatatggatgttaacgtcattcaatatggcaatgagacactgggaattgagctccctaacacagtgacacttgaagttgctgaaaccgagccgggtatcaaaggtgatacagcttctggtggttccaaacctgctacgatgacaactggtttaaccttacaagtaccattttttgttaaccagggtgacaagttagtgattaacacaactgatggaacttacatttcacgagcatagtaatttgatctgatttaaaacggaggctttttataatggctgaagatacgaatattattctccacacaaatgatcctgaattgggtaagattgaaattgcccccaatgttcttgaaattatcgctggcgttgctgctgctcaagtggatggtgttaatcggatgagaggatcattttcatcgagtgttaacgaattgcttggtcgacgtaaggaacatggcaaaggcgttaaactcacttatgccaacgaagaattagatgtggatatttatgtttacttgaattacggtgtttctgttccaaaggttgccttagaaattcagagccaagttgaacagcaacttttgtttatgactgaaattaaagttcatgaagtgaatgtgcacgttcagggcgttattccggagaaaacaaccagtactgttgaccccaataacccgtttgcagatgatgaagagaatggtgacgaatagtggaattaaaccgacaccaaattcgtgaactcgcctttcagacgctgtttgcgttaaatacaaatgaacagactgatcgagaaagttttttccaggttttgacggacggtaagtatggcgataagtatcctgattatttagaacaattaatcacgggtgttcttgaccataaggataaaattgaccaaacgattgaaaagtatttaatcagtggttggtcactaaaccgaattgcgaaaactgatttaattattcttgaaattgcgctttacgagatgatgtatgttgatgatttaccggcaaaggtttcaattaatgaagcgattgaacttgctaaaaaatttagcgatgatcgttccagaaaatttgttaacgggattttgtcacatgctttagaagaactggtaaaatagatttacatatttgtaagtctatttttttgtatcctgagtcaatcagtggcttacaattcaaaaggagaggtttcgagatggcgacagttatcgatggtaaagcacttgctaaaaaaataaatgaacaaaccacccaacgggttgaaaaattacaagcagattatggcattacgcccgggttagttgtcctcattgtgggaactgatcaagccagtgaacgttacgttcgcaataagcatcgaacagctcagcgtttaggaattaattcgatcgttcgacaattgccggtcgatatttctgaagctgagctgcttaaaatcattcagcaatataataatgatccgacaattgatggcatccttgttcaagatccgttgcctgatcagattaacgaaaaagatgttactcgcacaattttgccagaaaaagatgtggacggctttcacccggttaatgttggtaagctctttattgatgattcaacaaaatatccggtttcttgtacccctaagggaattatgacgatgtttgatgaatatgggatttccttgaaaggcaaaaaagcggtcatgattggtagaagtgcaattgttggtaaaccgatggctgctttaatgattaacgctggcgcaacagtttcaattttgaatcgttacacaccagatattaaggattatacaaaggatgctgatattattgtctctgcaactggtcaattacatttgttgggtcctgatgcaattaaatcaggtgccgtcattattgatgttggtcagaacatgaatgaacaaggtcatttggtcggggatgttgactatgatgatgtttttgataaagctggctttattacacccgttccgggtggtgttggtccaatgactattgcaacattgatgcagcaaagtgttgatttggcagaatggggcatgcaacgtggaaaatgattatctgactgttagtgcgttaacaaaatatattaagcgtaaatttgatgtggatccttatctgaataagatttatttaacaggtgaaatttctaactttcgtttacggccaaacgcacatcaatattttagtttaaaagacgatcatgcaaaaattagtgccatcatgttcaagtctgcgtttaataagattaagtttacccctgaagaagggatgaaggtccttgttgtgggtcacatttcagtttatgagccgtctggaagctatcagatttatgtggagcgaatggaaccggatggtgtcggtcagctgtaccaagcgtacgaacaattaaaaaagaaattggcaactgaagggctgtttagtttggaaaaacaggagctgccaaagtttccaaaacaaattgccgttgtgacatccccaagtggtgccgttattcgcgatatcattacgacggttcggcgacggtatccgattgctcaaatcgtcttgtttcctgcattagttcaaggaacggaagctagcgccgatattgttcaacaaattcaacgggtaaatgaaattggtggttttgatactttaattgttggccgtggtggcggttcaattgaagacttgtggccatttaatgaagagaacgttgccagagcaattgttgccagtaaaattccgatcatttcttcagttgggcatgagactgacacaacgattgctgatctggttgctgatgttcgcgctgcaactccaactgcagccgcagaactggctgttccccgattggatcaggtgttggttgatctaaagacctcgcaaaatcgcatcgtgaatgctgaataccaaattcttgaacagttaaaattgagactcaaacggcttgaacaatccccagtcttgactgcccctcaacgaatttacgaaacattctcacagcgtttagacttactgacccaacgcttgtataatcaggcggataagattaccggtaagcgaaaggaccagtttgctgatcttaaaatgcgattaagacttgtagcacccacgtatgcgattaaacaacaacaacaattgttgacgactttacaggcacggcttgaacgggcaaccaatcagaattttaaaaatatttatcaacattatcaagtgttggttggctcactggatcatttgagccctttgaaaatcctaagtcgcggttatacgtatacgactgacgatgcgaaccattttattagcagagtgagtcaattaaagagtcactcagttcaagttcattttagtgatgggatattaaaggctcgtgttgatcaggtaatacctaaggaaaaagaggaaaagaataatggctgataagcaacaagataaccaaacatttgaacaaaaaatggaccagttggaaacgattgtgaaccagttggaacagggaaacgtttctttagaagattcgatggacaaatttaagactggaatcaaattaagcgaacagcttcaggacacacttaccaaagccgaacatacaatggcaaaaatgatggataaaagtggcgatgaagtttcgtttgaaaatgccgatgataaaaaggatgatgctgatgggaaccaagctaagtaagtttatccaaacatgggtaccccaaattgatacaattttagaaaatgatatccaaagagataccgatcaacaacgattagccgaatcaatgagctattcggttaatgccggcggcaaacggttacgtcccttattgacgctggcgacgcttcaaacagttggtcatccaattgatcacgttattttgaaagtcgcttgtgcgctggagctcatgcactcttattcactgattcacgatgatctgcctgcgatggataacgatgatcttcgccgtggcaaaccaactaatcacgtcaaatatggggcggggatggcaactcttgccggggatggcctgcagactcttgcttttcaatggctcgtggataataatttgaattccagtaaacaggctgaattgactctcgcactttccaaagccgccggcccgcatggaatggtttctggacaggcggatgatattcaatttgagggcactcgattgtctttaaaaggtcttcaaaaattagatcggaataaaaccggtgcattgattcgttatgcggtggaagccggtctgattattgcggcaacgcctaaaagcgatcgaaaattgttactccaattcgctgaattgtttggatcggcctttcaaatttatgatgatattttagacgttgttggcgatgaaaaagcaattggtaagccggtgcatcaagataatggtaagaacacctatcctaatttgcttggcctggatcaatcttattctgttctaagccagacagtcgctcgagcaaaacaggtcttatatgacgctcaacagctatctgggatagacacttctctattagtggatttttgtagttattttaaaattaaggacgaaaaataagaatggaaaaacaacgtgttgatgtattattagtgacccagggcttatttgatactcgagagaaagccaaacgagcagtgatggcaggagagattcttggtgacaatgaagaaagattggacaagccaggcatgaagattccggtagataccgatcttcatctcaaaggaaaccccatgccatatgtcagtcgcggaggcttaaaacttgcgaaagcattaaaagtctttaatattgatgtcaaccatctaactgttttagatatcggttcctcaactggtggatttacagacgtcatgcttcaaagtggagctaaattaagctatgccttggatgtcggcagcaatcaactggtttggaaacttagggaagatccaagagtggttgtgatggagcatactaactttcgttacagtaagctgagtgattttacccatgggcaaccacaatttgcttcgattgatgtctcattcatttcactggagttgatcttaccaccacttaagcagattctagttaaagatggcatagttgtggcgctaatcaagccgcaatttgaagctggtcgagagaatgttggcaagcacgggattgtccgagattctaatgttcacaagatggttcttgaaaagatcctccattttgccgtcaaggctggttattcagttgaaaatttggattattctccgattaagggtggcgccggcaatattgaattcttagtgcagcttaaatcaaccgataagccaacaatgggtgctaatatttcaattgaaaaagtgattgagaacgcttattctgaactcaagggttaacaatcccaatgcgtacttaaaactttttggagatgacgatatgcggaaaaaagaacgacagcggcttattaaacagctacttactagtaacaacattcaacgtcaagaagatttcgtgagtttgctcggcgatcaggggattcgggtcacccaagcaaccgtctcgcgagatattaaggatatgcagctggttaaagtcccctcggtgaccggtggctatcggtacagtttgccaactcaaaaaaatgttgatacagagaaaaaattaattcaaacgattcgtgattcatttgtctcagtagcttcacaggacaagatgatttttatgaaggttttacctggtagtggcccagtcatttcgagcctgctttatcaaatgaattacagcgggatatttggaacaattggcgatgacagtactgttttgattgtttgtaaaaccgaagaaagcaccgcagattttcgtgaacgaattgacaacatgttaagcaattaatgattatcattgaaaggatttatttatgttacttgaactatcaattactgactttgcaataattgaacatttagatattgaattccaatctggaatgaccgttttgacaggtgaaacaggtgccggcaaatcaatcatcattgacgcggttgggttgttggtcggtggtcgtgggtcgcatgatttaattcgaactggagccaagaaatcggtaattcaaggaaactttattcttcatgatgataatcctacatattcggttcttgataaattagggattgatcactcggatggaaacgttattatcgaacgagagatatttgccaatggtcgtaatagttgtcgcgttaatggcatcatgattaacattgcgaccttaaaacgaattggcgaaacaatggtcgatattcaaggccaaaatgaacatcaggaattgatgagaccagaaaaacatattcaactattggatgattttgctgatgatcagctccgagctattatggctaagtatcagcaagaatacgatgaatttgtaaagcttcgtgatttaaacgaaaaaaagcacgagaatgaaaaagaatgggcgcaacgagttgacatgctaaaatttcagattaaggaaattgaagcagctgatcttcatgaaaatgaagacaccgatttagtctcagagcgtgatcatctcactaattttcaaagaattcatgattcattggtgaatagttatgagggtatcaatggtgaacaaacaggatcgttggattcaattggttcagcaatgagtgctatgcaggatattgaagatttagatccccaatataagcaaatttctgatgatttgtcgggtgccttttttacattgcaggatgttgccagtcaaatttcagatcaattaagtaatcttgaatttgatcaagatcgtttagatcaggttgagcaacgattaaatacgatctatcaactaaagcataaatacggtgattcggtttctcagatattggattatcttcgtaaaatcaaagatgagcttaacgagatgtctgggaatacagctgcccatgatgatctagaagctcaactgactgaaataaagttatcactggttgaacatgccaaaaagattagtcagattcgtcgaaaagtttctaagaagttggaaaaggcggttcacaagcagctggccgatttatatatggataaggccgtctttgaagttcgaattcgccagaacacatctctgaatcgattgggagctgatcacgtcgaattttatattcagacaaatccgggtgaaaagatgctgccattggttaaatcagcttcaggtggtgaattatcgcggattatgctggctttaaaaacgatgtttgctaaagctgccggagtgacgtcgattatttttgatgaggttgataccggtgtgtctggccgagtagcccaagcaattggaaacaaaatctatacaatttcaaccaaatcacaggtcttatgtattactcatttaccacaggttgcggcgatgagtgatcatcattactttatcgaaaaaaaggtgcatgatgatcggactacgacaacaatcactgaattaactgcggctcagagtgtcagtgaaatttcaagaatgttatcgggaacagcaattaccaaattgaccaaggaacatgctggtgaactgcttagattggcagatgaagaaaagaagaaaattagcgtgtaaacgataaataaacgcttggcttataaaagtttcctttgaatggggaatggccaatattttgtgataattgggtgatcaagttataactcattctgtgggtgatgggaattggattctttttggctatattaaattaacttttcctggatataaaaaagactgcagcaaattgattgcagcagtctctgtggatgatggttgttagtttcgtttaattgattgaatttctccaagactaaaaagtcggttcatacttccatcactagaagtgacaagatatcggtcaccggaaattctatttaaaattcccgtggcggccggagtttgatcattaaactgaatggtgacctgaaggtttctggataatgcctgatcaataaaaaaattaagttggaaagtcggcatctgttttaattgagtgtgtggtgtgatttcgaagaaacgatagtaattatctttaactgatttactgatctctgagagataggattgtttgttttgcatgttttgttcaccccgaacgtttgtttgtaatttcattatacgaacattagttctaaaacgcaacccccaattttgaatttaatcaaattcccataaaacattgatttaacttgtcaaacgggggaaaaagggcgataattgttgatattataaataattgaagggattttatcaatggcaaaaagaggaatgttgattgttttatctggaccatctggtgttggtaagggaacagtgcgaaaggcgctttttgaacaaccagacgttgattttgaatattcaacttcaatgacgaccaggaagcctcgaccgggagaaaagaacggcgttgattattattttgtttcaaaagaacaatttgaaagtaatattcaaaatggtgaaatgttagaatatgccaaatacgttgacaattactatggcacaccattaaaatacgttaatgaaacgttagattccggaaaagatgtttttttggagattgaagtgaatggtgccatgcaagttcgtgcaaattgtcccgatgctgtgttcgtatttttgaccccaccagatcttatggagcttaagcaccgacttgttggtcgcggaaccgataagatggatgtcatcaacaaacgaattaaaaaagcggttggtgaaattagcatgatgcggaattacgattacgcagtgttgaatgataaggtaccatttgccgttgatcgaataaagtcaattattcgaagtgaaaggttaaaagttgcccgggtaatgcccgactacgaatcgatgttaggagacgattaaactatgttactttacccatcagtagataagttactagataagattgattcacgatattctttgattatgcttgccagtaaacgggctcatgaattggatgccggtgctaaaccactgttagatagctataaatcacaaaaatcagttgggaaagcacttgaagagattgcagccggcgttttgaagattgatccaaacgaaaaagactttaattagcgatttgtttatgaatctgagactgggacaaaatgaaaaattttgtcaccagtcttttttacatttagatcattaattgataacaaccgaattaatagttgagaattaacaaggatattgcaattgtcaatgtgtgggattattcctacctaaattaatcgagaataaatgtcaatcggtattgattaaaataaacgggattggattacgaattcaggttgtcttgaattattggcttatctgcttgtgcttattaattgattttcttacaattagatttgtattaagaagaaacggcggtgaacatattgtttcaaaacaaaaaaattacattatttgtgactggaagtattgcagtttacaaatctttaattttgacacggttactggttaaaaataataatgatgttcaggtagttatgacggaagcggcgcaaaaatttgtgacgcctttggcatttcaaacactcagtaaacatcgagtggtaacagatgacttcagttccgatgatcctaaaagtattcctcacgtcaaattggctgatgaaaccgatttggcgattgttgctccggctacagcaaatacgattgcaaaaatggctgatggcattgctgataatgtggttaacgcaacacttctggcgacggcgagtccaatctttgtgataccggcaatgaataaccatatgttcaataatttcgcgactcaaaataatttaaccaggttggcaagcgctgggattcatgtaatgactccagaaaccggttttttagctgaaggttattctggacagggacgaatgcctgagccagaaacaattttaaactgggtgatgtcttcatatcaaccggtgccaacagcgttaactggtaaaaaagttgttgtaactgccggtggaactcgtgaacctttagacccggttcgatacttaacaaaccattcttctggaaaaatggggtatgcgattgcccacgcagcccaattggcgggcgccgaggtgacattaatttccgcaaattcatctctacagatacccaatcatgttagactaataaaggtagaaacggctgcggatatgttaactgcagttcaaaaagcttttcaatcagcagacgtgttgattatgtcagccgcaattgctgatttccgaccggctcatgtggccgatcgaaaaataaaaaagagtactgataatcaaaggatgacgttggatttgattcgaaatccagatattttggagacggttggtcaaacgaaacagaaagatcaagtaatgatcggttttgcagccgaaacaaatgatttaattatgaatgctcaaaagaaaattaaagccaagaacttggatatgattgttgccaatgatgtttcaaaaaagacaattggttttaattctgacaacaaccaagtgacttttctatttgctaatggcgatcaaatcaaaacagatgtcgagagtaaacagcaaattgccaatcgtttggttagactaatcgctgataaatttctttgattgagaggaggattaaacttgcagattgctcaagtcattgtcgatattccgacaagtcagacgaataatccgtttagttatcttattccggataacttgagtggtcaggtaagtccaggaatgcgggtccaggtgccatttgggtcccgaaaaataactggattcattgtggcaattaccgatcgttctgaatttcaggggaaattaaagccaatcagttcgttggtggatttgtatccggttattaatcaagaattgctcgaactggcaacctggatggcaggtcagacgtattcatttaagattaattgtttgcaaaccatgcttcctggtgggatgcgaacaaaatttaagaagaaattaattgctaagagtgatcaaattagggatgacaacccccaaatttttgcaggtcaaaacgaggttgactatgatcgtgcccattattcaagcaaccttttatcgcaaattctcaatctgcagaagactgatcaaattaaggttgaatatgaattgaccactcatgccaagccagtcatgatggcggcctttaaacgtcaaatgacgtctgaagcccttaaggccgagagtcaacatgttcgcagtaatgccattgcccaacagcaccttttaaaactattattagaccatcccgacgaacaatttttgcagtcaaaattgaaccagaaggggattagcagttcaacaacgcgggtggctgaacagcgcggctggataaaaaagacgcaggttcgccaaattcgtaatccatttttaaggtcggttaagaaaagccaaccgttgaagcttaatgcggatcagcaagctgctgtgagccagattaattcagcaacttccaccaaacaaaatcaaatctttttactggagggcgttacaggatcaggaaagaccgaggtttatttacagtcgattgcccatgccctttcattgggacggacggcgttaatgcttgttccagaaattactttaacccctcaaattgtgggtcgaattcgcagccggtttggtgatcaggtggccatgctgcatagtgccttatcgaatggcgaacggttcgatgaatggcaacggattaatagtggtcaagccaaagttgttgttggagttcgttcggcagtttttgcgccgttaacaaatttgggcctcattatcattgatgaggaacatgatagtagttacaagcaagcagataatcctcgttatcaaactcgtgatgttgcaaaatggcgggctgcctatcaccattgcccggttgttctgggaagtgcaacgccatccttagaatcgcgtgcacgtgcaatgaagggcgtttatcggctgttgcgattgccacatcgaattaatcgccatgcgcttccccatgtttcaattattgatatgaaaatagaaatggccaaacaccatagtgcattatcaacggcactatcaacggcaattagtgatcggttggctaaacatgaacaaattattttattattgaaccggcggggctattcctcatttctcatgtgccgtgactgtggttatgttccccgatgtcccaattgtgatatttcgttaacgatgcataaagataccgggacattagattgtcactattgtggccataaagaaccgatcccccgagtgtgtcctcaatgtcatagcaagcgaattggtcattatggtatggggagccaacagttggaagaacaggttaaggaaatgtttccgactgcgcgggtcttaagaatggacgttgatacaactcgtcgaaagggatctcatgaggcgattattgataaatttggtgctcataaggctgatattttgttaggaactcagatgattgccaagggattggatttccccgaggtaaccttggttggtgtcttaaacgctgattcagcgttagcttttcctgattttcgttccagcgagcgaacgtttgaattattaacgcaagtatccggccgagccggtcgagctgataaaaccggtgaggtatttatccaaacctttaatccggatcattacgccattcagctggcacaaacccaagattatgagcggttttatgcaactgaaatgcgtgttcgccatgatggtaaatatccgccgtattactttacagtgaaactgactggtagttcaccaaatgaaaatcaaacagctgcagagatgtatgcgatattaaatttcctaaaggcgaatttatcaaagatggcaattatcctagggccaacccctaagactattactagaattaacaatcgttactactaccaaatcattataaagtatcaaaacgagccacatctaaaagcggttcttgaccaagtactgcttaaatcgcaaaaaagacagcgtcatgggcttcagatcgccattgataatgaaccacttgattttatgtaaaaaatgaaagaaggaaacattactttgacaacagttgtttttatgggaactccgagctttgcagtgccaattttgcaaggtttggttgattcaaaatataaggtgttggcggctgttactcagccggatcgtccggttggtcgaaagcatcgaatccagcaatcaccagtgaaacaattagcacttaagttagggattccggttttacaaccagaaaaactgagtggcagtgaggagcttcagcaggtgatcgacttacatgctgacttaattataactgctgcattcggccagtttttacccaccagaatgttacaatcagttaaggttgccgcggttaatgtccatgggtcactcctacctaaatatcggggtggtgcgcctgttcaatacgcaattatgaacggtgatcatgaaaccgggattagtttaatctacatggtgaaaaagatggatgctggtgatattttggcacaacaggccatccccattaccaaaaacgatgacactgagtcaatgtttgcaaaattaagcattgttggtcggaacctgttactcgatacactgcctaagctacttgcaggggatgtccatccaattgaacaggatgaaagccaagttgttttctcgccaacaattaaacccggtgaagaacaactggacttttctcaacctgccgctttggttgatgccaaggttcgagcgttgcgtccagatccaggggcttatacggtgatcggcaataagcggactaagatttgggtgactgaagtgattgatcaaacgactgacgatgaagccgggacagttgtctataaagacaagcatcatttatatttgtcagcaggtagcggatcggtcctttcagttttggagctccaacctgctggtaagcccaagcaaaaaattacagattatttgaatggaattggtcagactttaacagtcggccaaaaggtgattaattaaatgaaatatacaacaaacaatccacggcaattggctgtggaaacattggttcggacaagtagtggttcttattcgaatttgcagattaatgcagttattgaatcaacgactatgaacgcggctgatcggggactattcaccaatattgtctatggcgttattcagcatcggttaactcttgagtttcagctcaaaccatttcttcgggatcctgaaaaaacagaatcctgggttaaagagctgctgtacacagccatgtatcagttggaatatttagatcgggttccaaaacgggcaatttttgatgagaccatcaagatttccaaaaagatgggtcatgatggtacccgtcgttttgtaaccggtattttgcaccaaatggatcgtaagggaatgcctaagattgccgatattcaaaatgaaaccgaccgcttgtcagtgatgtacagtgtaccaacctggttgatttcaatgcttcaggttcaacttggtaaacctaagaccgctgcaattcttaaatcacttaataaggccccaaaacaatcggttcgatttaatgcggctaaaattactaaaagccaattaatggatcaactaactgctgatggatttgatgttgaggcaagcaaagtttctgaaagcggcatcgtcattgatggtggtcagattatccacagctcgttttttaaggatggcttgttaaccattcaggatgaaagtgccatgttaccagttgaatcaatggcaattcacccaagtgacctcattttagatgcctgcagtgcaccaggaggtaagacaacccaaattgccagccatctgacagacggtaaagtgttcgcgttggatattcataacaataaattgaagacggttaagcgcaacgccagccggttgggtgttttgcctcaagtagaaacatttgagctggacgccaggaaggttgatcagaagtttaaggacgggatgtttgatcaaattttggtcgatgccccttgttcgggactgggacttcttcgtcgcaagccagagattcgttatgacaagacccctgaagatatcgaacgtctcagtcacatccaaatgcagatcttagaagcggttgcacctaaagtgaaaaccggtggtactattacatatagtacttgtacaattgtgaagcaggaaaatcaggacgtggtgagcgaatttgttcgtcgccatcctgattttcaaattgataaaaccaaaacagctttagaccttcatcaggatgaaaccgggatgcttaagatttatccggatgattatgaatcggatgggttctttgtctgttcattggttaagaaatcttaacggagttgattaacatgcagattgcttatcaatcatcaactggcaaggttcgcgataaaaatgaagatgccgtcggtgtatttaaaaataagcacggtttgattttagctttgattacagatgggattggtggcaataatgccggggaagttgcgtctagaatggttgttactcacattggcgctagttttgaaaagacagccatcgatactttggatggtatcgaaggttggtttgaaaaacaacttgcggaagctaatgcagccattattgatgagtccaataccgatttacggctaaaaggaatgggaaccaccattgttgcggcactggttgatgggggcaagagtattattgccaatatcggcgatagccgtggctacatttattcaaaccagcgtctatttcaaattacggaggaccactcttacgttaatgaattggtgaagcacggtgatttaactcccgaccaagctaaaaacaatccatataaaaacattattactaaaagtctgggcattaataatgattcggcagcagattttaaatcgtatgctgttcaaccaaatgatcaaattttgctctgtacggatggcctaaccaacatggttgatgatccggaaatcgaaaaaattttggctcgtcaagaaccattgcaagctaagtgtaattcactagtggccttagcaaatcaaaatggtggtttggataatattacagtactgattgccaaagccgattcggaggtgaaacccgatgaataaaggctatgtattaaacggtcgttatgagattattaatcggttaggtgaaggcggaatggctgatgtctacctggctgaggatttgattttgaaacggaaagtggccgttaagcttttacgtttggatttccgtgataacccgaaagccaaaaagcggtttcagcatgaagcgatggcggcaacggaacttgataatccacacattgttgggatttatgatgttgatgaagttgaagggatgcagtacctggtcatggaatatgtcgatggcgaggatttaaagcagtatattaaagaccgatttccaattccttacgctgaagtcgttgacatcatggaacaaatttgttccgcggtcagcgaagctcatcgtcataacatcattcaccgtgatttaaagcctcaaaacattctggttgacaaaaaagggtatattaaaatcactgattttgggatttcaagagccggaaccgaagatactatgactcagaccagatcaattatcggctcaattcactatttatcgccggaacaaattaaaggcgaaatggcaacgcaacaatcggatatctactcactggggattattctctaccaaattttaacaggaaaagtaccatttaatggtgatacggctgtttcaatcgcaattaagcattcacaagaacccatgccgtctgtccgtgactttgatccgcgaatcccccaggcactggaaaatgtggttttaagagccaccactaaggatccaaaagatcgctatcggactgttaatcagctggcagatgacctaaacacatcacttgataaatctcgagcaaatgagtcaaagtttatcgttcctgatgaacggcaaaaagttgatgaaaagacccgggtgatgccttttaatgctttaccgagtagtagtgcttcggcaaacgaatctgatgcccagcgtccgctgcctaacgataacgagaatcgttcagccgataaacggccaaaaaaaaggatgtcgaaacgtaagcgtcgttggttgatattggggggcattcttgctttcctggtattgctgctgactctggtaatgattgtgacagctaacggtaaaacgaccgttccagtgattaccggtacagaggaaaatgaagccagccaaaaaattaaatcagctgatcttcggttggggaaagttcgttatcatagtagtgatacgattgatcgtaaccgggttatttcttctaacccccatgaaaatacaaaagttaagaaaaatacgaaagtttcgttagtcgttagttccggacctcgtaaagttcgagttgacaactatgtcggccaaaattacgatcaggtaaagcaacgactggaatctgaaggattcaaagttcgtcgtcggaatgcaccgtcaagttcatttcggactgggcgtgtgctgcaacaagatttcgaagctggtaagaaaatgaatccggccaaacatacgctaacttttgtggtgtcaacgggtattaaacaaattactctggaagatctaacgggaatgagcaaggcacaggttatttcatatgcaaataaggaagaaatcaatccaacgtttgactacgtttattctagtgatcaacctaaaggccgggtcgttaaacaatcgccggctgcgaatacgagtattcggcaggggggaaacgttgcagtttccttgtcacgagggtcaaagactaaaaagaatgacgacttgaagagctttgatgttcgcgttacaattccttattttgatggtaatcaaggttcaagcagtgccagctcggcatttaacaattcccaggggacgcaagcaccagcatcatcttcaagtgcggaatcggcgactcccgaaccaaccagtgccgaaacgccagaaaacgtggttttaatttatttgaaggaccatgatcatgatttcggaacggtttataagcaaatggtgattactaaagatacggcggtgtcactgccatttaagttaactaaaaatgaagttggtcgttataagattgtccgtgatggtcaaactattttacgggataataatataacttacgactcacattaataaattactgcaaattaaagttacttctcttataatgaaagatgaagtaactttttttgatagaggtgattaattgacccaaggaaaaatttatcagtcactgagtggattttatgacgttcatgtgggtgataagatttatcggacccgagccagggggaattttcgaaagcggaaaataacaccacttgtcggggatgacgttgaatttaagattgaagatcaagatcaaggatatattttaaaaatcttaccgcgaaagaattcgttggttcggccgccggtggctaatattgatcaggcaattgttgcaacagccgcgattgaaccggatttttccagcaacttattagaccgtcaattgattgggttggaaattagtcgcattaagccgattatttattttactaagactgatttgttaactaaggatcagtggcaacgattgtcacaaattgctacggattaccgagcaattccctacgatgttatttttcctaagcaggcatttgatgacgcatcattaaatgaattgcggcagctgtttgctggaaaagaaaacgtgatcatggggcaaactggggctggtaagtcaactctgttaaatcatctggcaccaggacttgatttagcgacaggtgagatttcggctgctttaaatcggggaaagcataccacccgaaaagttgcccttttaaatgtcaatgatgggattattgctgatacaccgggattctcatcatacgatacatttgatattgattatcgtcagttaggaagttattttcctgagttcaaacgagcttcagtaaaatgtcgattcaggggatgtgcgcatgttaacgaaccaggttgtgaagtgaaacggcaggtaagcgcgggcacaattatgacaagtcgatatgaaaattatttacaattgtatacggatattaaaaaccgtaaacctatatataaaaagtgaggaagttagttatgattaaagttgcaccttcaattttgagcgcggattatgttaatttacaaagagatattgaaatggttgataagggtggtgctgaactgctgcatattgatatcatggatggtgcttttgttccagcattgtcatatggtccaggttgggttaaagccatcaagccgattactggtttaacgttggatgttcacatgatggttcagaatccagagcgctatattgatacgttcgctgatgccggggctgatattattggggttcatactgaagctaccccccacattcaccgagctttgcagatgatcaaaaataagggtgttaaagctgaagttgttattaatccaggaacaccggttgctgcaatcacaccggtcttatatatggttgatcaggttcttgtaatgacggttaaccctggttttggtggtcaaaagttcttacctgaaacagtcaaaaagattgccgaactaaatgatattaagaaacatcagggattggactttgatattgaaattgatggtggtgttaatgaaaaaaccgttgttgatgcctatcaagctggtgcaacggttgctgttgccggatcgtatgtatttgatgctgatgatccagtttcaagaattcaagccttaaaggatgctacgaaataaatgaaaattttaaatttgttagttgggggaccaattgacttatggccggatacattgaaagctggtcaaattaaaggtgaatggattgggattgaccgaggcaatttgcatttaattagaatgggcattgacccaattgtggccattggcgattttgattctttaaagccccaagagcttcaactggttcgggatcatattcctgatatccggcagtcaatcccagagaaggatgatacggatactcagttgggacttaaagttgccattgaggaacatcaggcggatcgcttggatatctacggcgcaactggggggcgtcttgatcattttttggcaaatctatggatggtcttggagccacggtttaaaaagtacgcgccaaagattcgaatgattgaccgccaaaacacgatcaccttctttttgcctggtgaatatgaaatcaacaaggaaccagacaaaaaatatttagcctttgttgccttaacgccaatggatcatctcacgttgtttgatgaaaaatacaagttgaatgactatcaggtaaaacgaccaatttcgctggccagtaatgaatttgtcggccaaaccgcccgcttcaaatttgccagtggtatgatgtgtgtgattcagagtcgcgatgtggaccgctttagttaaatggactctcttttccatgccgtgagattacggtatgtggctaatttaatttaaaacagaaagtggctgggacaatagtccaaatttgtattatggcgtcttaacttcaaagtaaaaatcccgtaaaatcagttttttttgaaaactgattttacgggatttttgaaaagtaactatttttattgacttatgtcccagcttttttgcacgagcacaattattaccgagtaaaaatgtgggaagaaagacaacttccagagcgtaaccgcctttcgtctcactctcatcgttttggctttattgaagatggtagacgctgctatcggaattagggggcgatgatgagtttctggaataacggcaattggccaccaatttggtcgtgttggctgatgctcagcttttttatcagtcagaattgagcgtacaaaaaaagaccgacatctcatcgatccaattaagcaattatacccgagtaactttacctgatttaagagtccgggctgaaatccaaactttctttggttttccgtcaactaggatccgaactttttgcaagtttggcttccagctacgacgacttgagttcaatgcgtgtgaacgtttgttaccaaagtgagtccgtttaccattaataaaatctttagccatggataacaaatctcccttctttgcaattttagtgttaaatgtctgaatcattacacttgaataatttatcatagttaccctgatattgcaacacttttctttcaagtaattatacttgacaggattgtttgaacacattaagtttactttggttttttaggggtttgtggtaatattaactatcgttaataataaaatagaccattttagataaaattcaaggaggctgttaacacatggccgtcaaaattaagacgaagtttggtacagttgatattgacaatgatgtcattgcaaatattgttggtggtgccgcaactgataattatggtgttgttggtatggcaagccgaaatcaacttcgcgacaatatgaacgatattttaaatcgagaaaattactttaagggcgttgaggttaagcagcgtgacaatgaaattgtcatcaatgtttatattattgtcagttatgggaataagatttccgaagtttcaaagaatgtccaatcaaaagtgaagtataatcttcaaagcatgcttggtgtcaccgcaaattcggtcaatgtaattgttcagggtgttcaggttcaaaatgactaactaattactgtaaattgaccaaggaggaaaagtagttgaaagtaacaaaaattaccaacgctgaatttacggcaatggttcaagctgcagctaataaattaaataaaaatactgattttattaattcactgaatgttttcccggtaccagatggtgacaccggaaccaatatgagtttgtcactggctagtggttataagtatgttaacaaggataccagttcggatgttggcgacttggccgggtcattagccaaggggcttttaatgggtgcccggggtaactctggtgtcatcttgtcgcagatttttcgtggcttttcaaagtcaacggctggcaaggcgagtctgagcgcacaggatctttccgatgcctttgtggctggtaccgaaaccgcttataagtcagtgatgaaaccaactgaaggaacaattttgacggttgttcgaatggctgcccaagctggcaagaaagccgcagctacaactaacgatgtcattgctgtgatggatgccatttttaataattcaaagaccgcccttcaaaagacacctgatttattacctgtcctgaaacaggttggtgtcgtggattccggtggccagggactggtgttcgtattagaagcatttgatgatgttttaaatggtcgtgatgaagcacaaaaagattcatatcaacctaatgatgccgaaatgactgaaatgatcgatgctgctcatcatcaaagtgtccaaagtaagctaaatcctgatgacattgtttacggctactgtactcaaattatggttcgaatcggcaagggtaaggaagttgaccgtaagtttgattatcaaactttctatgattatttggcaaagcttggagattcgttattagttgtcaatgatgaagatattgttaaagttcacgttcacactgagcatcccggcaaagtattagcctggggacaagaattcggtgatcttgcgacagttaaagtggataatatgcgactgcagcaagagacaattattgaaggcgatgaggatgaaggcgagagctcagataccgccacaccaattgagaaagccgagaatttaaatacccagcagccaatttcagatacggcgattatttctgtttcttctggtaaggggcttaatgaactctttaacagcttaggtgttaactatattgttaatgggggtcaaacaatgaatccaagtacggaggatattgcaaacgccattaagaacacccatgctaagcaagccatcattttgcctaacaataaaaatatctttttggctgctgaacaagccgcacgagtggttgatattccaacagtcattgttcattcaaaaacaatttctcagggaattactgctatgctgggatataatcccgaggattcgttaactgataatcaaaaagccatggaagataatttaccaacggttaaatctggacaggtaactactgccattcgtgattcaaatattgatggactccaaattaaaaaaggccaatatatgggaattgctgatggaacaattaaaaccgttgataacgatttggtcgcaactgcaatttcaatggttaaaacaatgctcgatgatgatagtgaggccatcacaattatttggggtgatggtgctgacgaaaaactggctgatcaggttcaaaagggaattacagatatcaataatgaccttgaagttgaagtccatgaaggggatcagcccgtttatccgttcttaatttctgttgaataaaataggcaaaacaagttgaatcaagctggagaaataagactcagaatcatcggtttaagaaaaccaatattttaatacatgagtgattaactttccttaaaattggttttggtgtttgttttaattcagcaatcgttgttattaaaaaaagaagagtggaacgaaagggttgccttacttactatgtttctacttgctaataagcgtgatcacactaaaagggactgggcaaaattacttttgtctcagcctcctttttatattttataaaagatgggggttaaaaatgagtagtcttagcgatccggtatcggtacttaaaggtgttggtcaaagacggcagattgcactgaataaactgggaattgacacgattaacgatttgctaacttattttccccgacgttatgatgatctgtcactcaaagacttgtcaacggctctagacggcgaaaaggtaaccgttaaaggcatcgttattacagcgcccacagttgttttctttggtcgtaaacgtagccgacttagttttcggttaaaaatcaatgacgatatttacaatgtgacattttttaatcaaccctggttaaagcgccagttatctcttgaatctgaggtcattgtttttgggacttttaatcaatcgcgaaatcaaatccaaggaatgaagattttgagtcagaatcaaaacgatgcttatgattcaatctatccagccaacaaagaagttaaacaggcaacgatcaaacatttaattaaattagcttttgaagcttatggtggtcaattggttgatattgttccaacttcgttacgaaaaaagtaccgattggaaagctttcatgatacgattcaaaacattcattttccagagtcaccgattgcggctaaaaaagcatttcgaactgcaaaatttatggagttctttttgtttgccatgaaaattcaaattttgaaagtcactcggcggcaggaagatccacaagcgcagatcaagtataatcctcagctgattcagtcatttaaggatcaattgtcctttcagctaaccgattctcaaaataaagtttcccatgaaattttgactgatttgcaacagcctctggcaatgaaccgattgctccaaggtgatgttgggagtggcaaaaccgttgtttcagcgattgcaatcttggccacaattagtgcacacaagcaggcagctattatggcgccaactgagattcttgctgaacaacatgcaaataattttgccaaaatgtttgcaaaatttaacgttaacattgctctgttaactggagatacatcagctgttgcaagaagagcaatgttgccgaggattaaagatggggaggttaatctaattgttgggacacatgcattgttccaagatcaggtgacttacgacaatttaggattggcggtcatcgatgagcagcatcgatttggtgttcatcaacgtcaagcactgcgcaagaaaggaaccagcactaatatgttggcaatgacggcaacgccaattcccagaacgttggccattactatgtacggtgatatggatgtttcaattattaatgagctgccaaagggtcgtaagccaattaagacttcttggatcacgtcagctaaaacggaggctgccattagatttgtcaaaaaacaacttcaaagtggcaatcagatttatgttgtaactcccttgattgaagaatctgaagcagttgatatgaaaaatgcagttgccatatatgaacggtttaaggcaatctttgaaccgaatttttcggttggcttattgcacgggcgcatgtccaacgatgaaaaggatcaggcaatggttgatttcaaaaataatcagtttcaggttttagtggccacaacggttattgaagttggtgtcgatgttgccaacgccaatacgatgttaatttttgatgccgatcattttggattagctcaactgcatcaactacggggacgagttggccgaggatcaactcagtcttattgtattttgattgctgatcccaaaaacgaaattggcaaaaaacgaatgaaagctattgccagtagcactgacggcttctttttatcacaaaaagatttagaattgcgtggtcagggcgatattactgggcttaaacaatcagggatgccggattttaaagttgctgatccggttggtgacttgaatatcctaacggttgcgaatcaagaggctcgagaaattgccattgatcgaaattggcaaaaaaagccagaaaatgtacaattagcacagtatttaaaatttaatcaaacaataacaactgattaggcggaaaggttaatgattaatccaatttaaattgattaaattctgccaataattcagagcgagtgttattagaatcttacattgtatcatcgtgatatctaatcaggaaaggaacgatttcattatgaaaattgctgttgacgctatgggcggcgactttgcccctaaagaaattattgaagggattgaattggcgagggatgcctatccggatattacctttcaattgttcggccgaactgaccaaattaagaaatacctacacaacgataccagaattcaagttgttcaagctgatgaggttattgagatgggggatgaaccggttaaagctgttcggacaaaaaagcagtccagtattgtcctggccgctacggctgttaaggaagggacggcagatgcctttttctccgctggtaatacaggtgcaattttagcggccggattattcattgttggccggattaaagggattgatcggcctgggttaaccactactttgcccgttattaataatcaggatcataaaaactttgtcatgattgatgtgggtgccaatgcggatacgaaggtgttgaacatatatcaatatgcgctgatgggaaagtattatgcgcaaaatgttttaaaaattgatcagccacggattggcttgcttaataacggaaccgaagccgacaaaggagatatgaatcaccgcaaagtccatgacttactagcggctgataaagatcttaattttattggcaatgttgaatctcgtgaactcttaaatggtgtcgctgacgttgttgtcactgacgggtttactggcaatgccgttcttaaaagtattgaaggaacggcactttccatgcttaaattgattaaagggagtatcatgtcgggtggtgttaaatcaaaaatgggtgcggttatgctaaaaagtacctttggagatattgccagctcaatggattattcaaagtacggtggggctgttttgctaggcgtcaaggccccagttgttaagactcacggtgccagtaaagcgccaactgttaagaacacgattgggcaaattaaggacatcattgattctaaaatgatcccacaattaaatgactatgtgactgaccatgctgaggaattacagcaaattaaagacagtattaaaagtaaccgataatttgatataataaatgttatgttaactaataaatgaaataggtgtagaaaatgagcaaagaagaagtttttaacaagattgccgatttggtagctgaccaatttgatgttgaccgtgcaaaaattaccggcaatttaaattttaaaaaggatttagatgcagattcaattgatttcgttgagtttgttttggatttggaagatacgtttaatgccgaaatttcagacgaagacgctgagaagctaaatacgattgacgaagcagttgattttgtaatgaataatcaaaagtaattttaagatgcctgatgaggtgttttgaaataggaaaagaaccattaatttatggaggcattaatttgatagcaggtttaaatgagatgttgaagcaggattttaacattcatgtagacaatcaggatttgttggatgaagcatttacacaggcatcttatgttaacgaacataagggtgagggtctcaaattttatgaacgactcgaatttttaggtgacgcggttttgcaattaattgtttcggaatatatttttgttcgctaccctaagttgccccaaggtcgactaacccgcttaagggcagcaatggttaatgagcagagttttagcacatttgcccgtgaatgccattttgataaatatattcgtttgggccggggtgaagaaaaagccggtgctcgcaaacgggactccctcttatgcgatatttttgaatcgtttgttggcgcattatatctggatcagggtaaaaaaacagttgaagcttttgctcagcaggttatttttcctaagttggatgaagggatgttcgctgagttttttgatcataaaactgaactccaagaattagcccaagctgatggccccgtcgatattgattacgaattagttgacgagtatggcccggacaacgaccgttcatttaaggttaatgtgtcaattggcggcaaattgtttggtgttggtattggtcattctaagaagggtgcggaacaaagggcggctcaacaagcacttacccactatgacacagccggagataatttagtttagattggagaaacattgtgcaactgaaatccattgaaattattggctttaaatcatttgcagataagactcgaatcaattttccagctggaatgacgggaattgttggccctaatggaagtggaaaaagcaatattgctgaatcaattcgttgggtgcttggggagcagtctgctaagaatctacgcggatcacggatgccggacgttattttttccggctctactgatcggcgttctttgaatatggctagtgttactttaacgcttgataatacagatcaatttattaagacgccctattcagaactcaaaatttctcgaaagctctttcgaaatggtgatagttcatactacattaacgaaaatcaatgtcgtttaaaagatattacagatttatttatggatacagggattggtcaggggtctctttcgattatttcgcaagggaacgttgaaaatatttttaatagcaaacctattgagcgacgttcgattatcgaaaatgttgccggcgtttataaatacaagcagcataagttaaccgctcaaaaggaaattgatcaaactgttgataaccttaatcgcgttgacgatattattcatgaaatcaaggaacggctagatccgcttgaagagcaaagcagcttagctaccgattatttggatcagactaaaaagctccagaggcttaagaaaaaacaactgatcattacagcgactcgtctcattactgatactgatcaattacgtcaaactgttgatcagaaggagcaaattgttgatcggttatctgcccaaatccataaacgtgaacaatcgcgggcacaattaaaggccactattagccaacagaggtcattaattgaaaaaacgaatcaaaaattgttggatttgactcagcaggtccaaacgcttaaaagccaacatcaattgtctgagcaggctcatgattataaaagtgcggattttacgcgcattaaccagcatatcaactcaaataagcagcaaataaaggacttacagttaagattaaaccactcagcggatgatcagcaaaagttggcagaaacgctaacaactcatcagcaacagttcgatgagttgattcaaaaggaaaggcaaaataatccgggtgcacttgaaaaaaagatcgagacgcttcgaaatcattatgttgatttgcttcaggagcagacatctgtaaaaaatcaaatcaatttgaatgagcatgacaatcaacgattgagcgagcagctgcgttctcgtcatcagcgcattgatttagctagcgaccatttaacaaagactaaagagcagattgttgaaaagaaaaaagaaatttcaaaaacacaagttgacctggctgatatcaatcaacagttgacggagcttacggctactttatcagctaagcaatcgacaacagaccattctcaagcaaattggctgacggcgttgaaggttgccgagcaggccaaggctaagttaaattccctgcaatctcttcatgattcttatcgcagcttttatcgcggagttgctaatcttttaaagtaccgaaatgaaatatccggagttattggcccagttgctgattacctggatatcgagcccaaatttgttaaagcaattgatattgcactaggtagtcagtctcaacatgtcattgttcaagacaattcggccgcttcaacagccattcagttgttaacccgtaagcggctgggacgagtgacactattacctatttcggtgatttcggcgcgaacgttatcaaatcaacttgtgcagttagcttccgagatgactggatatattgggatagcagccgatttggtctcaatgccggcaaagatgacctcgatcaagaaatttctgttgggaagaacgattattgccgatcaattagataatgcaattctaatcagtcaaaagatccaacaccgtaccagagtagttactttggatggccaaattgtgaatgcaggcggttcgctgacgggtggtgccaatcggaccgagaatgagggcgtccttgttcaaaagactgagttaatatctttgcagaaggcgacccaggaaatggcacagcgtctaaagaaaagagaaagtgatctttctgttgctaagcaggcgctttctgacattaaagcttctttggagcgtggtaaacaaaagaaattccaggttagccaaacattaagcagccgacaagctgatcttgccaaattagagacatcttttaaaaatcaacaacgggaagtcgatacgcttaaactgtcattatcgaattcactacgagatacggcttctgcagatgatgcaactttagaatcacaagctgacagcattcaacatcaattggacgaaacggcttcacaggtgtcgcaaaagcgtgatcagctaaaccatgttaaggaactggcttcccaatatgcggttcaaaaacaaacgatccaaaaaacgctaattgtgacgcgtcagcagttaaaacagtctaaagaaaaagaagttgaactaagaggccaaattgatatgctgaaagctgatcaacaaaagcagcgatgcgagattgaaaaattgagcaaacaacttggcaatcaaaaagcaaccgagactttgaagctaaaaattaagcaattaatggatacgcaaataaagttaaatcaacagttgaccgcgacaaagcaacaagttgctacggatgagcaacaacttgatcttgttgatcggcagctcaatgatcaacgtgaaaatcttaatcatgcgacttacgagttgacggttgatcgcgatcagtatcgggatcatgagcagcaacttcaaactaatttggtagaattaaagacaaagcatcaaattgatagggatgcattggagcagttaaaacttgatttggattcctcagacgttgaacggcagataaaagttctccaaatggggattgctgaaattggttcagtaaatgtgtcggcaatccaagaatttaaggaagtttcgaagcgttatgattttctatcgcaacagcgtcaagatttgattgatgctaaaaatcatctaacggcaacgatgagtgatatggataccacgattaatcaaaaattctccaaggcgttttcagaggttgccgaaacgttttcaacagtgtttgttgacatgtttggtggtggtgaggcaaagcttgttttaactgatccagctgatatgttaactagtggggttgaaattatggttaagccgcctggcaagaactatcggagtttaagtcttttgtctggtggtgagaaggcgttaacggcgattactctcttgtttgcaatcattaaagttcggccagtcccgttttgcatccttgatgaggctgaggcggctttggacccctttaacgctgatcgttttgctaagtatctgaaacgttttggggatgacactcagtttattgtgattacccatcgtaaagaaaccatgatttatgccgatcagttgtatggaattacaatgcaggaatctggcgtttctaaagttgtcactgttaacttagataatttaaaaacagaggtgagttaaatatggggctctttgatatattcaagcgtcgttcaaagaaaaacgaaaagaaacaagaaaaagaacagcaacaagaaacacaaaaatcatccaaacgatcttctactgaaactgaatcgaatcaaacaattgaagatactggaaaagtaacccaggcaagccgggaagatacgagcgataaacagagtcaaaccagtaaacagcgacaagtggaggcaccaacgaatgactcacaggaatcggccaatcgttcggttcctcaggttgatgatcgcaatccaagtgataatgtctcacaggcttcttctgaggtaaaaccggaaattggatctaatcagaatgagtcaactaaagctactgagaaaagccaatcaggtgagcctgatcaattagtggctaaagagtcgtcgcgtgatcatcccgaatcagtaccagctagtcaagatgacgagcaaaaaaagactgacgagaaagtgcaacgcacattgccaacggtggatgaggcagcatctcccgctgaaaaacatcgcttagatgatgaagaggcatcaagtgagactacctcaacccaatcttatgagcgtggattagaaaaatcgcgttcttcatttggcgcaaaattaaacgccctgttagcaaattttcgacatgttgatgaatcattctttgatgatttggaagatatgttaattgaatcagatgtcggctttgactcagctatccgaattacggatgaactccgtgaagaggttaaattgcaaaacgctaagaagtctaaagatgttcaaaacgttattgttaaaaaattaattgacatgtatgatgctgctggtaatggcgaaaatgcaagcattaacatggctaaaagcggaccaaccgtcatcctaatggttggtgttaacggtgtcggcaagacaaccacgattggtaaaatggcaaagatgtataaagaccagggcaaaaaagttgttctcgcggctgccgacacttttcgggctggggccattgagcaattaaatgtttgggcagaacgcgatggtgttgatattgttaagggtaagcccaagagtgatccatcatcagttgtttttgatgctgttaagaaggctcgcgatgaaagttatgatattttgatggtagacacagctggtcgacttcagaacaaagttaacctgatgaacgagctcagtaagatgaaaaaaattctgaccagagaaattcctgaggcgccacatgaagttttgctggttctggatgccaccaccggccagaatgcgatgacgcaagcaaaaatgtttaaagaggcaacagatgtcaccggtattgtattaaccaagcttgatggtaccgctaagggtggtattgttttggcgattcgcagtgaacttcatttgcccgtcaaatatgttggtttgggtgaaaaggtgaccgacttaaagccgtttgatccaaatgactttgtatatggtttatttaagggattaatttctgaatgatgttatttcatgatgttatttcgcaagatgaaagatatgcttttaaaagttggtgggccaaaaagtagattttaggtggataaacgaataagccaaatcttcgaattgaaatgttcggcttacccatgggcactttgaaatctaatcgctttttggcccaccttgtcttatctcgaacttaattgcgattgaataaatgatagttgacattgactaccatctgaaaaatcggtaatctagagaacgtattcatatggctaaaggagtttcaggatggaacttgaaaaaaataattatattaattctttatttgaattttatgaaccgttgttaactaaaaagcaggcgaattatattcaactatattatgccgatgatttttcgctaggtgaaattgccgaggaatatgatgttagtcgccaagcagtttatgataatattcgcagatccgaaaaaattttacaacaatatgaaagcaaactggatttgtatcacagttttgtagatcgaaatcataaactagataagattcaggcctatgtgaaggataattatccaaaagatcagaagctcaatcaaatgattagtagtcttgaaacaagtgaagaagaatgaaagtggtggaataatggcttttgaaggattaactgaacgattacaaaatgccatgaagaaattacggggcaaagggaaggtttcccagtctgatctgcgcgagacaatgcgtgaaattagattggcgcttcttgaagccgatgttaatttccaagtggttcgccaatttgtcaagacggttgaacaacgcgcaactggtgcaaaagttctagaagggttaaatccatctcaacaaattgttaaaattgttgatgaagaattaaccaagatgatgggggacgaggctgtcccactcaataaatcagagaaaattccaacagttatcatgatgtccggattacaaggtgccggaaaaacgacgactgttggaaagttagctttaaagttaaagaacgagcagaatgcccggccgctgttaattgctgatgatgtgtatcgaccggctgccattgagcagttgcaaacggttggtcagcaagttgatgttccggtatttcaattaggaactgatgttgatccggttgaaattgccaagcgtggattagctcaggcacaagaaaatcataatgattatgttattattgatacggctggtcgtctgcaaattgatgaaaagttaatgggcgaattaagtgatattaagaaggcagtcaatcctgatgaaattttgttagtaattgatgcaatgaccggtcaaaatgctgttgcaactgcccaagggtttgatgaaacattggacgttaccggagttgttttgacaaagcttgatggtgatacccgtggtggtgctgccctatcaatcagagcagtgactggtaaaccaattaagtttgttggtcaaggtgaaaaaatgtctgatttggacgtctttcatcctgatcgaatggcatctcgaatccttgggatgggggatatgctttccctgattgaaaagacccagaaagaatatgatcaaaagcaagctgccgagttatctgaaaagattaaagaaaacacttttgatttcaatgactttttagaccaaatgagtcaaattcaaaaaatgggacccttggatgaaataatgaagatgattccgggaatggccaacaacccggcccttcagaatgtcaatatggatccaaaggacatcgagcatatcaaggcgatcatttattcaatgactgaacaagaacgaactgaccccgatgtgttaaatccgtcaagacgtaggcgaatttctcgtggatctggtcggccggttcaggaagtaaaccggatgatcaaacaatttggtcagatgaagacaatgatgaataaagtttctaaaggtaatatgtccggtatggaaaatgtaatgcagtcgacagggatgggtggcaaattatccaagttggcaatgaagcaatttagtcggaagatgaaaaagaataaacgacgccgtgccaagaaacggaaaaaacggtaatcaaatcgagctcacgacaacttagacgtttaatgatttttatatgatagttaattacaggcataaaagaatgtctgtaatgtttcaagggtcgttattcaaggttgcttgtagcaggatttttatggtgtaaagaaaaaaacctttacaaccattcgaattactggtatattattaatcgttaaatgattataggaggtaaattgcatgtcagttaagattcgtttaaaacgaatgggttcaaaaaagcgtccatactatcgaatcgttgttgccgactcacgtagccctcgtgatggccggtttatcgaaaaagttggtacttacagcccattatcagaaccagctaaggttactcttgaagaagaatcaattcttaattggttaaataacggtgctcaaccatctgatacggtgcgtaacttattatcagatgctggtatcatgaagaagtatcacgaagctaaatactcaaaaaagtaaagtgagtgatcagcgtcatgattaacgtcgacggattaattaaaaagattgtgtcacccttagtagattatccgcacgaaattgagattttacatgatgagtccgatcgatttatggaatatcaccttcacttgaatgaagatgatgttggtcgaattatcggtaaacacggtcatgtgattcagacaattcgaacagttgtttatagtgttccagttgtaggtcgcaaaaaagtgcgattaattgttgatgatggcaagtaataagttcttaagcgaaacggccgttttgtttaagagcttttttcgtattcagcattggtggaggtttttgaatgaaggttacgtattataatgttggtaagattgtaaacactcaaggacttaaaggtgaagtccgagtcattccaattactgacttccctgagaaacgatttaaaaaaggcaataaagtttacgctaaacttgacaagaaacctgatttagtaacgcttgtgattgatggtgttcgaaaacataaagggtttattttattacatttcgagaaccatccctcaattaatgatgttgaatatttaaaaccctctcttttacaaattaccgaagatacattatctgatgatgatttgaaaccaggagagtattattatcatcaaattatcgggttggatgtgtatgaccgggatcaacaactgattggcattgtcaaagagattctttcaccaggtgccaacgatgtgtgggtagtggctcgcgatggaaaatcggatttactattaccgaaaattgattctgttattaaacaggttaaccttgatgctcaccgaattgttgtagacattccggaggggttggacgaatgagaatagatgttttaagcttgtttccagagatgtttcaagtgccaatgcatgattcgattttaggaaaagcaattgataatgggatctttgacttgagggtcaccaacttccgggaatttacgcaggataagcatcgtcatgttgatgattacccgtttggtggtggtgctggtatgttactgcaagcccaaccaatcattgatgcttatgagcacaccaagcgggccgcagaagaagatggactacctgttggaaaagttattttaatggatcccgcaggaaagcagttcaaacaacatgatgcggaaactttgtctaagtctgagcaccttacctttatctgcggtcattatgaaggctacgatgaacgaattcgctcgattgtgactgacgagtactcactgggtgattttgtactgacaggtggtgagttgcctgcgatggtaatgattgacgcactgacacggttgattccaggcgttttgggtaatcaacaatctaaggtggaagaatcattttcaaccggcctgctagaagaaccgcagtacactcggccagcagattttcggggaatgaaagttccagaagttttaatgaatggcgatcataaaaagattgctttatggaatcaaaaagaagcacttcgtcgaacatatcgtcgtcgaccggatttgattgaccatcgtaaactaacgagtattcaaaaaagattgttagccgatgttcgaattgaagaggagcaaagacaggcgaagtcaccacaatagctgacaagaaaaagccctttacacagttgtggttattatgttacactaatttttggcgtaagctgcaaaacaacattccgctgtcagacaagataatgaatgttagtgaaaggaagatttatttatgcgacaaaatcaattgatcgaaaaaatcaatcaaggacaacttcgtgatgacattcctgatttccgtgctggggatacagttagagttcacgttaaagttgttgaaggaactagagaacgtattcagttatttgaaggcgttgttattaaacgtaagggttcaggaattcaagctacatacactgttcgtaaagttagtaacggtgttggggttgaacgaatcttcccacttcattcaccacgagttgacaaagtcgaagtaattagacatggtcgagttcgtcgtgccaaattgtattacttacgtgaattacaaggtaaagctgctcgtatcaaggcttcactgcgaactcgttcgtaattataaacattctggactggaatcaagggttagccttgatccggtcttttttgttgcgacattttctttgaatcttgagaaaggataaagaaacttaatatccttttaaaagttatctaaaataggttacctttaccaaatcgtgagtagaattacgctaatcgccgctaattaaagttgagcaagcgaacatctttttaaatcagatttaaaatccacaaatattagcgtttccatgggcatttattaaacatgtctgatatgataatagatgtgcgataattaggctcaaactataattcctagttgcaaattttgaagcgatcttgtttaattttgggataaatggatgagtcgcatactagataacggattaaccggtaataccgattgaggttctgaatttaaaagaggttgaaattatggaaacagatcagaaaaatattgattggtttctcaaatatcttcgaagtgatcgacattattctgtggacacaatcactgcatatcagttagcaatttctgaatttgtgatttttttaaatgaggtccccaatgatcgaaagtccttaattaaggttgatgcgtacgatgtcgaggcctttttaactaatctgtatgataaaaagtatgctcgcaattcaattgctcaaaaggtttcggcgatcagatcattttataattttatggtcaaaaatgacgtcatgaaaaccaatccatttgaatatgtacatttgaaggctcagaatcggcacttaccacgctttttctatcaaaatgaaatgcaagcgcttttcgcgggtgccaagaagggaaaccgagagcttgcactgcgaaacacagccattttggaacttttatatgcaactggtattcgagttagtgaatgtgcgggtattcggttgaaagatattgattttgagaataagatgttgctagttactggaaaaggtaacaagcaacgttatgtaccatttggtcaggaagctatgagggcgattcaacattaccaaattgactctcggacaaagctgatgactaaattccatcaaaatcatgatgtcttgttcatcaaccattatggtcgcccgatttcttctcgagggattgaatatattatggatgaaataattcaccaaagtagtttgacaactaatattcatccgcatatgttaaggcatacttttgcaacagagatgctaaataatggggctgatatgcgatcagttcaagaacttctgggacatagcagtctatcaaccactcagatttatacccatgtaactaaatctcacttgatgagtgattatcgaaaattttttccaagaaataatgaatcatttaaatctaaaaaataaaaggggtatcttttatgccagttaaatttgaagcaacaacgatttgtgcagtccgtcataatggtcatttagcaatggccggtgatggtcaagtaaccatgggtgaaaaagtcattatgaaaggaactgctagaaaagtccgtcgaatttataatgataaggtagtggtcggctttgccggtagcgttgccgatgcctttaaccttgaagaacgttttgaaaaaaaattaagccagtttgatggtgacttgaaacggtcttcagtcgagcttgctcaggattggcgcggtgatcaacaacttcaaaaattagaagctttgctgattgtcatgaatgatcatgatctgttattagtatcaggttccggagaagttattgaacccgatgatgatatcctggcaattggttcaggtggtaattttgcccttgctgcggcgaccgcaatgaaacaccacgcttcggatatgagcgcccgcgaaattgcggaagcagctattcatattgccggaaatattgatatctttactaaccaacacgtcatttctgaagaaatatagagaggaattcaaaaattgacagaatctactcaaacacctaagcaaattgtcgaagtattagaccagtatattgtcggtcagtctgaagctaaaaaggctgtggccgttgctctccgtaatcggtatcgacggatgcaattgacaaaagccatgcaggacgaaatttcacctaagaatttgttaatgattggacctacaggagttggaaaaactgaaatcgcccgtcgacttgccaaaattgttaatgcaccgtttgttaaagtcgaagcaaccaaatttacggaagttggatatgttggtggtgatgtcgaatcaatggttcgtgatttggttgaaaacgccattcaacttgagcgtgaagatgaatataagaatgttcatgtcgatgctgaaaaacaagccaacaatcaattggttaaattattggttccggctaaaaagaaagaaaatcgtcaaaatgatatgcagaatttaatgagcatgtttactcagatgcaaaatgggaaaatgccttctgccaatgatgattccaatcaagaggaagtaactgatgatattcgcgaaaagcggatgtcgactgccgaaaagcttcgagccggccttttggaaaacgatgaagttgaaattgaaatggacgacccttcgcaacaactatcaggtcaaaacagcatgcttaatcaaatgggcattgatttgaatgatacgttatctggattaatgcctaaaaagaaaattaaacgaacggttcccgtcagtgaggcccgtcagattttgcttcgccaagcatccgaggaattgattaataaggcagatctttatcacaatgccattgttcgcgctgaaaataccgggatcattttcattgatgagattgataaaattgctcctggaaaatcacaaaatagtggtgaagtttctcgtgaaggggttcaacgtgatattttgccaatcgttgaaggatcccaagttaatacaaaatatggtccggttaacacagatcacgttttgttcatcggttcaggggcttttgcggatagtaagccatctgatctgattccggaattacaagggcgttttccaatcagggttgagttaaatgatttaactaaagatgactttgttcgaatcctaactgagccaactaattcattaaccaagcaatacatcgcaatgattggaactgataatatcaaagtaacattcaccattgaagcaattaacaaaattgctgaaattgcaactgatgttaatcataatactgacaacatcggggctcgaagattgcacacaattcttgaaaagcttctggaagatatcctttttgaggggccggatatgcaaatgggtgagattaccattactgaaaaatacgtcgataataaggtcggcaaacttgcccagaataaagatctttcacgttatattctataatgattgttggaggcaagtttaaacatgattactttgaaaaatcagtatttaactgttcttattaatgaatttggtgcagaattaacaagtgtcaaggacagtaagtcgattgagtatatttggcaggcggatcccagtttctggaagcgtcacgcaccaattttgtttccaattgttggtcgcttgaaagataatcaatattcctatcacggacagcaatatcagatgagccagcatggatttgcacgtgatcagcgatttaaaattgaaaagcaaaatgaagattccgtgactttactgctaacggatagtgacgaaacgttggcgatttatccattttcgtttcaactgcgagttacttacgaattggttgatcatactttaagagtgagtttcctggttgtaaatccaaatactgaagaaatgctgttttcattaggtgctcacccagggtttaacgtaccgttaacgtctgaaggtggtcattttgaagattcgtttattcgggtggcacccaaaaaagaatatcgacggattccattaaaacccccatatagtgatccaagtgatccaagaactctagaccttacgaaaccgttgggattaaatcaccgtttatttaacagtgatgctttggttcttgatttaggaggtaatgagacgacagtcatgctggcaaacacgcttaacgatcatggtgtggccgtcacgctctttaatgcaccatatgttggtatctggtccccttatcccaaacaagcgccattcgcctgtatcgagccttggtgggggctggccgatacggttaatgctgatggccaatttgaaaacaaatttgccattaatcgactcaatgttaatcaaacattcaaagctcagtacgagattagtttcttttaggaactacatccagcatgattacagctaatgaagataataaaaacgagtgattccaaaaatgaatcgctcgtttttattggtagtcctattcttttgattgttgatgttttctaattaaatttccaagtccaaacggcaccatactttcagttccgttcatgattcgaccaatgtttgatcggtgacggtaaaatataaagatcgtcaggacaattgctaaaatactaagaaataaatcattaataaaaaatgtcgctagggttgtacatgtgaaggcaaccatactagctaaactaaccatgcttgtcagcaggattaatagtaaccaaattccggcggccaggaaaaagaaagatggtttgtacgcaagtaacatccctgcgcttgttgcgactgctttgccacccttgaatcgatcaaagacagaaaaggtatgtccaaatatggctgcgaggccaaatacaagtggattaatcgtaaaattgtgaaagaaaaatggtagcagggttgcaacagccccttttgaaatgtccatcgccatgacaatggttccggcaattggacctaaaactcgatatgtattggttgtaccgatgtttccagatccgtggcgacgaatatcgatatgaaagaatcccttaccgatccaaacgccgctgggaattgcccctagtaaataagcgataactaacattaatataatttgttcgatattattagaattcatctcaggccccactattatcgtgttttattgatacaacagcgcctattattttagcatgataattgctttccgccaacaaaattcgttttcaaagcggttattttaggttattatgaagtagattgttttaaaaaggagtcatacaacgaaatggtaaaacaaaagcaaaagtacgatgattcctcgattcagattcttgagggactcgacgcagttagaaagcgcccgggaatgtacattggatccactgattcacgtggcttgcatcacttggtttatgagattgttgacaatgctgtcgatgaagtcttggcaggatatggtgatgaaattaatgtcgtcattcataaagataatagtattactgttaaggatcatggacgtggaatgccggttgggatgcatgcttctggaaaaccaacgccagaggttattttaaccatgctgcatgctggcggaaaatttggccagggtggttataaaaccgcgggggggctacatggtgttggtgccagtgttgttaatgcactttcaacttggttaaaagttgtgattgtcagagatggttataagtacgaggaagactttaaaaatgggggccatcctgttggtacgcttaaaaaagttggcaaaactcgtgatcatagtggcactacgcttacttttaaagcagattcaaaaatatttacgagcgttgtttacaatttttcaacattatcagaacggttacgagagtcagcctttttactaaaggggactaagattacactcactgacgagcgacctggtcaggaacaagaagccgtttatcattatgaagagggaattaaagagtttgttcggtacctcaatgaaggcaaacatactttaggtgatgtgatggactttgacggcataaaagatggtgtcgaagttgaggtagctgctcaatataatgacggttattccgaaaccatgctctcgtttgttaacaatgtgcgaactaaagatggtggtacccatgaagccggctttcgaaatgcttggacaaaggcgtttaatgattatgcccgaaaagttggcctactgaaggataaagataaaaatctcgagggtagtgacgttcgtgagggtttatcggttgttctttccctgagagtacccgaagaaattcttcaatttgaaggacagactaaggaaaagttgggaacccctgaagcccgttcaattgttgacggcgtggttagtgaaaaacttggctattatttgatggaaaacggtgagtttgcccagaccctggtacacaaggcattaagggcacgtcaggcacgtcaggcggccagacgtgcgcgtgatgaaacgcgtagtggtaagcgtcataaaaagcaagaacggttactatctggtaagctaacgcctgcccaatcgaaagattatagtcgaaatgaactattcttggtcgaaggggattctgccggcggttctgctaaacaggggcgtgatcggcgttatcaagctattctgccgttacgtggaaaggttttaaataccgagcgggctaaattgcctgaaattatgaaaaacgaagaaattaacacgatgatctatacgattggtgctggtgttggcagtgactttaagattgaggatgcgaactacgacaaagtcattattatgactgatgccgatgatgatggtgctcatattcaaattctgttattaactttcttttacaaatatatgcgaccgatgattgatcaaggccgaatttttattgcattaccacccctatataaattgcaacgtggcactgggaagcgagcaaaaattcagtatgcttggactaatgaggaacttaacaaagtttcaaaaacgttcggcaaaggatatagtttgcaaaggtttaaaggcttgggtgaaatgaatgctgatcagctgtgggaaaccacaatggatcctgaatcacgaacgttaatccgggttcgaattgatgatgctgcattggcggagcgccgggttacaacactaatgggtgataaagttgaacctcgacgcaaatggattgaaagcaatgttaaatttaatttagaagaagaaggcagtattctagacaatactactaaataattttagggggaaacgactgtagtgagtaaaatagaaaatctaaccctcgaagatgtcatgggggaacgcttcagtagatattctcgttcaattattcaagaacgagccctaccagacattcgtgatggattaaaacctgttcaacgccgaattttgtatgcaatgaataaggatggcaacacatatgataaagcgtttcgtaaatctgccaagtctgtgggtaatgtgatgggtaactttcacccgcatggtgatagttcgatttatgaagcactggttagaatgagtcaggactggaaagttcgagaacctctgattgaaatgcatgggaataatggttcgatggatggagatccgccggccgccatgcgatatacggaagctcgtctgagcaaaatttctagtgaaatgttgcgggacattgataaaaacacggtagattgggtactgaattttgatgataccgaatatgagccaacggtactgccatctagattccccaacttgctggttaatggttctacgggaatatcagcagggtatgcaacagatattccgcctcataacttaggtgaggtcatcgatgccgttttgtatttacagaagcatcccaaggcaacattagacgatttaatggggttcgtgaaaggccccgatttcccaactggggctattgttcaggggattgacggcattaggaaggcttatgaaactggtcatggaaagattatggttcgttcaaggacgtcaattgaaccactaaagggaaataaatctcagattgtaatcaccgaaattccttacgaagtcaacaaggcccaacttgttaaacgaattgatgaaattcgacttaataaaaagattgagggaattgctgaagttcgtgatcaaagtgaccgtgaaggactgagtatcgtggttgaattaaaacgggaagtggattctcaaggtattttgaattatttatttaagaacaccgatctccaaatctcctataatttcaacatggttgcaattgatcatatgcggccggttcgattatccttaaaacggattttaactgcatatcttgactttcaacagaacgtcgtcaagaagcgaacccaattcgatttacaaaaggcaatggatcgacagcatattgttgatggtttgattaaagccttatcaattttagataaggtgattaaaacaatccgtgccagcaagaatcgaaaagacgctcgtgataacttagttaacgaatacgatttttcagaaaagcaggccgatgcaattgtagccttacaactttatcgattaaccaacacagatgttactgaacttaaagcggagtccaaagaactttctgatcaaatcgccggctttcaaaaaattctaaataaccctagtgaattaaacaaagtcttggctaaagaactacgacagttagccaaaacttatcgcaatccgcgtcgtacggaaattcaaaacaaagtttccaatattaaaattagtaccgatgttatggttcctgacgaagatgttgtggtgatggtcagtcacgatggctatattaagcgaagcagtctccgatcttataaggcgtcatctagtgaaagcgggcttaaagatgaagattatccgatctttatggaacaattaaacgcgcgtgatcatctgtttatgtttacaaacaaaggtaacttaatttatcggccggttcacgaaattgctgatgttaagtggaaagatactggtgaacatatttcacagacaattggcttggattccgatgaagaaattattggcacgttcgccttcaattcattaaaggaattggggaactttctgattgccaccgatgacggtcacattaaacaaacaagttttcaggatttgaagccgggtcgaacgtataaaaatcatgcgtatacctacgaaaaattaaaagctgaaaatgcgaaagttgttgccgttcagtatttggcaaatccagagcaatcgagcgaattattgttaatttcacatcatggattagctttaagatatggtttgaatgaggttccggtcaacggcgcccgaactactggtgttaagtcgatggggctacgcggcgatgacttggtaaccaacctgcagcttattcagccgaatagtgttgtggctattgtgacgcagcgaggcgcattcaagaggttagctgttaaggaaattccagctacttcacgtgctcgcaaaggggtgatgattttacgtgagttgaaagcccagccacaccgagttgttgattttgttgtgattgaccatgaagatcaaccattggaagtgttgacaaatcgagaacgcagccatgacatattacccaaggaatattcagtgggtggtcgctattcgaatggttcttttgtgatcgatgtcgattcagaaggtattccggaacaaatacgggtaaagccttcagaactaactgttaattgatctgaaaatattaaacactttttaaataaagcgctatattaattgattgtcagctggtttcgaattattattaatgttaaatgataatgaaaagggtatctaatggtcgaaatgagaccactaaggagagactgaatgaaaaccactcaggaaaatattttttcttccaagaccttgtcatattttcttcagttagccgatacaatgaattatactcaggccgctcagatattggggatcacgcaacctgctttaacgcaacagattaagaaacttgagcgaacggtcggaacatcattgttttattcggtgggtaagaaactacggcttacggacgcgggatacattatgttaaagacgactcatcagatttatgatttactaaatgatgcaacggatgaaattcaacaggcgactagttcaacgaccggtgaaattaaccttggaattttagcctcaattgaaactaaagtttttgaagattttgctttggcgttatacaaagaaaatccggatttggtgattaatttccatatgttgactcgtaaggaaatctgggagagtttggaaaataataagattgatctggcaattatgtacttgccggatgaatcaatcaaaaactggaaaccatatagctcaaagaaaatcatttcggacgacttactatttattcaccataatcaagacctgtccaagcgcaaaaaggttcgtttgaaagatgttaacgatcgaccgtgggtcatgtatccacaggattattatcttaaccaaaccttacgtgaaacttttaagaatcagatggttgattttccaacaacggctgccagatataccatgcccgagcaaattcttaagttcgcgattaatacgcgaaccaacacagcattacctaagtcatatatgctcaacattgatcttaaagctttaacagatgaggatatttgggtaagtgaatttgacccgaggatcaagtttgatttaaaatttgtttatcggaaaaataagaatgaaatccctcgaattggccgtttcttaagtaagtttgatgaatttctttccaaaaaagactatttagaccgattagcaaaatagtttttaaaaaaattaagggagataatgttaatgaataaagaattagtttttggtcaccaaagccccgatactgatgccattgtggcagctaaggcgttttcatatctacaaaataaattaggctatgatactgaggctgttgctttgggtgaacctaattcggaaactgcttttgtgctaaattattttgatgaaccaacaccacgaatcattaaaactgctaagaatgaagtggactcagtcatgttggttgaccataatgaatttcaacagagtgtctcagatattaaagatctgacaattactcacgttgttgatcatcatcgaatttcaaatttccaaacccaacaaccattatattatcgtgcagagccggttggttgctgcagtacgattattgtaaaaatgtttgatgaaaataaggttgaaattccggttcaattggctggattgatgctttcagcaattatctcagatacattattgttaaagtcaccaactaccaccgatgaagatcgaattgctgtcaagacattagctgaaatcgccgacattgactatgaaaagtatgggattgaaatgcttaaagctggaactaatgtttccgctaaaagtgatcaagagctaattgattcagatgccaagtcctttacaatgggtggcaagagtgttcgaattgatcaaattaacgttgttgatttcgatgatattgataaacgtcaagatgatatcaaaaaagcaatggctgctgaggctaaagccaagagttatgatttgtttttagtcttagtgactaatgttttaaacagcgattctcgattaattgttgttggcgagcctaccgaggcggttgaaaaagcatttaacaataagcttggtgccgatgctacaatgccgttacctggtgttgtttcacgtaaaaaacaagttgtgccaccattaaccgatgcattgagctaatttaacagttcatctttacaagtaaatgatcataactaataagaaagtattggttatgatcattttttgtttacattaaataacatcccccatataatatgaggtagatacattgtacacaatgtattcgtatgacaatctggaggtatgagatgaaagataatgagttgaaaaataaattaacaccaaaacaatatgaagttactcagcaaaagggaactgaagcacctttcagcggtaagtatgacaacttctatgaagatggtatctacgttgatgttgtgagtggagaaccattgttttcatcgaaagacaaatatgatgccggttgcggatggccgtcatttactcatccaattgatctcgaccacattgaccaacacactgatttgtctcacggcatgattcgccaagaggttcaaagtaaagacgccaagtcgcatttaggacatgtttttcctgatgggcccaaggatgccggtggtcagcggtattgtatcaattctgctgcattaaaatttattccggttgatcaattggatcagaacggctatggtcaatataaagaaatctttaagtaggggtgtttgattaatggaagagacagcaatatttgcaggtggttgtttttggtgtatggttaagccattcgatacaatgcctggtataaaaaaggtaatttccggatataccggcggtcacgttgccaatccaacgtatgaacaagtttctagtcatacaaccggccatactgaggcagttaaggtgatttttgatccggaagccattagttataaacagcttgtccagatttattggcaacagactgatccgacagacgcgatgggtcagttccaagatcgcggtgataattatcgaccggttatctttgttaaggatgatgtccagagaaaaattgccgaagcttcaaggaatgccttagccgaaagtggcatgtttgatgacccaatcgtgactaaaattgaggacgtcaagcctttttatcccgcggaaccggaacatcaacagttttataagaaaaatccattgaggtttcaaatggaagaagcaggcggacgagcaaaatttgtcaagactcattggaacgttaataaaactaattaatgaaataagccgaaaccactttctctagaagaaaattggcttcggcttatttaaaaggagaatcaagatgattgaatggtcacccgaaaagatcaagggatttcaaaaagcgttgctgaattggtatgatcaaaataaacgcgatttaccatggcgtgtggatcacgacccgtatcatgtttggatttcagaaattatgctgcaacaaacccaagttcaaacagtcattccatattatcagcggttcatgaaactatttcccactgttggccagttggcacaagcagacgaatcggtgctcttgaaagcatgggaaggactaggttattattcgcgtgcccgtcatttacaaacagcagcccgtcaaatagtgaccgactatggtggccagtggccacagacaattgatggtcttaaatcgctttccggtgttggaccttataccgctggggcaattgcaagtattgcttttaatcaacccgttccggctattgatggtaatgcatttcgagttttttcccgattatttaaaattgatgctgatattgctaaaccccaaacccgtcacctatttgaaaaagtcatccaaaatgttatttccagggatcgcccgggcgactttaatcaagcaattatggatttgggtgctagctatatgagtgctaagaatccggatactgtccattctcccgttaaacagtttgatcaagcatatttagatggtgaagaggataagtatccggttaagtcaaagaaaaaacgaccggttcgagtgaactactttggactaatcattcattccagcaaaggattcttatttgagcagcgccccagtgatggcattttaagccattttttgatgtttccattaattaaggccgacgaattggatagtcaaaagcgatcagtccaaaaaatatcaagtgatgaaataattgatactatttttcaaaattgggtatcgacttatcaactccagttaatcaatctagcatttgtggacagtcagaaagtatcgcatacgtttactcatcaaaaatggcaaatcactttattggaagcaagtttaacatcaaacagtgatttgagttattttccaggtaaatgggtgccccaagaccagtttttgacgattgcattttcaaaggttcaatcaaagatgtgggctgcataccaacaaaagataccagagacaaattaaataaatttggttacttatggtcttctttgtgcaaatcatccaaggcttttttctgagttgtgtcgacaatatgtgtgtataatccagttgctttggttgaggattgaccaagttgagtggcaacaagatgttcgttattggtttccaaatacagctttgaggctagtgtatgtctaagtttgtgaggggtaattcgcacgtgattgaacgcttgcgagtattttgcgactagtagttcgacagttgctgttgatattcgcctaggttggtccgccccttttgttaaaaagagggcaggggtatccttagttgcgtgataatgttgcttgcgaatagcgagatatggttcaatatatggcattacccagttcgcaattggaacagaatcccgtttgccacctttacgctgaaccgaaacggttgccttagtgaggttgatatcctttacgttagcgttaacaagttcagagactcgaatcccggttccaagcattaaagcgttgattgccacgtcccgttgacggtcacgttcatacatcttgtgaacacgtttccctttaatttgtttcggataatcattcaaaataaaatccaggtaatgaacatccgcgttgccgagcattaatttatctttaatattacgagcacgcgtctgataggtttcactatcagaaactaaagcaatttttttcattacatttcgataaaaatatggctcgccgtcagcgttttccgattcttcagtcagatacctaaaaagtgctgaaagtgcatttaacgatcgattcacggttcgatgggataatgttccttgtgggtttttagctgtttgcttaccacgattgagtagagatgctttgtataactccatgtcctgtttacggaacttttcaaggtcagttaatgggatcatagccatagtggaggcatttgttatgccggtttcaatcatccaggcgaagaagcggtgaaattcattgaggtattgatataaggttgctggagataagggaatcgttgatttttctagatagtaatcttgaacatagttgggcatttcctcaataagtgtctcattattagcaatgtagctggattttttcattgtaaaactccttaattggatttaaatagaaacggctaaaatcatgttttttggtggggcgtttttatttttataatataacttgataaaaggacaattttattaagttatattatatcatattattaccgttattttggataattaaagatcaaaatatttgaccatcaagttaaaactccataagatagcatagacgaacaaaaaatagtcgaaagaggtttttaaatgaaataaggattaataaattaagggggctttcatatgatggttgatatgaagcaaattcacggaattcagctggaaatattgaagcaagtcgcacgtttgagttccaagcaccatatcaaatattttatgaccggaggctccgcaatcggcgccgttcggcatcaaggatttattccgtgggacgacgatattgatatcggatttactcgacatgattttgaaaagtttttaagagttgcaccaggagaattcagatcaaccaactattttgttgaagaaaatcgtttgaatcctgcttatgaatatgattttgccaaggtgatgtttaaaggaactgaaatattggagcgtggccgtgaaggagcaaaatcatccaatggtatttttattgatgtttttccgtttgacaaaatgcccgcagccaaacatcagcaagtggctcaaaaccaggcacttcaagctattttacaggaaattcgccgtcgattttacccggacctatacccaaatatgcctttagaccctaaatacgttgacatgacaatagatcagctatataaattacgtttgcagatcatggttaaatatgatcgtgatccgtcactcgcatacgtcaatttatcatcaccatataaatacggcaaagaacgaattctgcctgctgagatgcatcgttttactgaaatgaaatttgaaaatttacgagttcctgttttatcagcatacgattcgtacttaacacggctttatggtaactatatgaaattaccaccggttgagaaacgcgttcagcgtcacattttaaaagcttccgttgacgatccacaagaactgtcggagaatgaaccagatagtcaaacagaaaggcatcgaaatggatttgaagccgaagcaagttaagcgtataattttagacattaaagtaacttttagtcatatttaataggaacgtcagttggtcgtatttttgaccgtctgaacgtttctttttgattatgcacttacttcgtataatatatattatgtaaagtagaattgaaatagacatttagactatcaattacctgtatttaaataattaccctctcttagatctgttccaatttaaatcgtgtttaattaaaaaagattatccaatacatcagataatcttttttaaaactgatttggttcaaatgattttatcaaaatgttcaatatcagttcgttttgcaaattttaatttttgccaaaataatttaccagcctgattattaatcattaccacaactgaaattttatggatgccaacttcttgaagttctttaatgaccttattaactaattgacttccaataccatcgtgttggtaattagtagccactgctaaatggtaaattttcccacgacgcccatctgttgcgccaagaattgttccgacaatttgttgatcaatttctgccacaaaacaaaatcctggattgcatttaattaatcgggcaatttcttcaaaactgtcctcagattctctcagatgcatacccggtgttttttgccaaagcgcataggcatctggatagtcttcagcaaccatttttcgaattaaaatttgagaatctttattaattattgccatgatgctcccttcatgcgccattgtcatatcgttaattatttaacgatatcgttaaagtgaacccgaccttcgtttaaatcgcttgccagtaaccagtaattggaaaatttgttgaagcttggattttattttaaaaagcaatttcggattccagtgatcaataatttcctcgctaaaataatatttttcgatactggggttataacacaattttaaatggatgacactgaccccatattaccataatgatgagtgatatgcccgaaccagaaaattatttgagatactttggttcaaatctgaaaattgacgttgaaagttcttcaatagttacttaggcgatgtttaattaaaattgctaccaaagacaacaccgttagttaacctgactattggtttttggtattggtaaaactttgacaatcaagttaattaaaaactttccccaaaaattgcccatttatgcataaactaagtatcacaatttttctgtgatatggacaattaatattagcaaggcttaatggtatctgaaccagcggatggttaaatatattacttgtatataccaatcagcattagttttttattgagtccatatctagtgcccgattcggatcaattaagtagtgatttaaattattttcaagaatcgcaaaataacagctgggtaaaaagtcatgtcattctcaagaaaatcagtccgcatttgttacaattgtatgatgcaaaaactcgtctgaagcctctgaacaagctgatccccactgtacatacaattgattgtgttgactataaacaacaaagtttggttccgtggcatgacggtgtcccttcggatatttccaatctattgtaaaaaatccaattaactgacgttataagtcaattaattggatttttctatcctaaaaggcgatttttaatgatttcaaattgttttgaatttaaaacaaaatacaaaattgccatttgaattggtgtaacgataatttctttaaatattctaattggaagtaatccccaaaacggtgttttaacaagaattgttaaccacaatgtgtttaaaattgcatttacaaaaacagcaatgattaattgtgaaataataactcgcttccaagtaatttgctgattataaaaaaataggccgtaaatagtggctcctaagatggcggatattgtaaatccagggaaataaatattgccagaaatgaccgttccgatgatatctcccagtgcagcaattgttgaagaccataatgggccgtaaagataacttgcaatggcggtaataacaaacccgaagcttaggcggataacacttgtgccaactgtaaagcggccaacaaccagtgccaaggccattaagacccctaaaacgacaatatccaaaacccgaagctttctaaaccctaatgacaatgacttcatgataatgacatctcctcaaaaggagctcaccatatatttagtatcctaaataaattggcgaatgcggaaacaacaccgcaagtaattaataagtcgcatcattacttttcgttcgaagttcacattccgttccttcgacacttaacgcgttgaatcctactccatattttattttaacaactcttaaagtttagcacattaataataaaaagcaaccaccatattgcttgtttccgaacaatatggtggttgctggtgatcaatgttatgaaattagatttgatcctggtcaaaatcacgaagccatgcaagtgccaaggccttgtctcccaagtgggttccgatctctggcccaaaataactttgttcaattttcatattgggatatagttcgtgtattttagaagcccactcttctcctgccttcggatcatcaccattcaagaccaaagcgcgcaacgggtaattggctttctgataggcttgcgcgaataaagtttcaactcgttttaaagccttttttcgagatcgaattttttcgatcgcgacaatttcgtggtttgtatcatcaaatgttaataacggtttgatttttaaaataccaccgataaaagctgatgcatttgatagacgaccacctcgaaccaagttttgtaaatcgtcaacaacgaacaattcatcaatcgttgctcgtaatccatttaagtaattaataatttgatcgatgcttcttccaagacttgccattttactagcctgaatagctaagtatcccattaatttaacagtaatctgcgaatcgtacgggataactttgatgcgatcaatggttggtgcaatttgtttaattgaattataaaagccggaaattgtactagccaaatgaatacttattacagcatcgtatcccttatcggcaagtgaattgtataattcaatcatttcccccattggtgcttgtgacgtacttggaaaggagttggaatttcttaatttctcgtaaaattcctcggttgtaatatcaacaccctctttatattcatggccatcaataataactggcatggggacaacggtgatgtgatatttttgttcctcttctttggttagataagctgtactatcggtcacaattgcaattttcatcaaattccacctacttgtatttatattctatcaaggcttttttcgagtcggttaattaaaatcttaagcaaattcttttcttcatttgtccaatgattaaaaactaattcagttagactttttacctggttgctaacatactcactagaatccagccctttttgagttaccgtatagattaattgtcgcttgtcttttccaattgcagttttcttgagcatttctttttcaactaatcgctttaattgacgtgaaagtgttgaaatatccaaattggtaatctcagacaaaacttcttgagtcttattacccgcgatcacttgatttaagagtttccattctgagattgtcaacccagttgctttagttattttaaataattgcgtcgtatgatttttagctgcggaattgagcgctacaagaatatccttcattgtgaaaagacctccgaaaaaatagtatacgctatttgattatcagttacaaacagcgttcgaaccttcgcatctatatgtaaagtgcgttatactagtaagtgctattctatgatgaaagtgagtgatacgatgtcatttgacggttcttttacccattccatgaaaaatgaattacttggtttattaaagactggacgagtaagtcgaattaatcaaccatatcctaacgaacttattttaacgattcgtgctcaaagtacgaatcaacaactattattatccgctaacccgacgtatgcaagagtccagatcacaaaaattccttatgttaatcccagtgttcccagcaattttacgatgattctgaggaaacacttaagtggtgcaattctgactgatatcaagcaacttgataatgaccgggtcttaagatttatgtttacctccagaaatgaattgggagatcagacaagtctatgtcttaatgttgagattatggcacgacatagtaatattattcttattgatgaagctaatgataaaattattgatgccattaaacacgttggttccgatgttaaccgatatcgaatcctgcttcctggagcgacttatattaatcctcctaaacaggatttacaagatccatttgttaaaactgaatttgaagatattgatcatttgattcgagaatatccaaacgttgatgttttagctaatggtttaaaaaagataattcaaggattgggcaatgacacatctttggcacttgcaaattacttacatcgtgattccaatacggcagctaacttccataacttttttgagcagttcaattcgcccaagcctacctttagccatattgctaataacaagattaattttaccgcatttccttacccaggtacacaaaaagataagcattattcgaccttaagtgaattactggatgcctattatgctagtcgtgcccagcgtgatcgagtccgtgaacaaggtgctgtcctcattcaagttgtaaaaaagcaattgaagaagaatcgcacaaagctcaaacgacttaatcgcgatatgaaggagactgacaatgctaatgaataccgtgttaaaggagaaattttaacggcgtatttgaataaagtcgagcgtggtatgactagtatcgaactgccaaattattatgatcaaaataatctgttgacgatttccctttctaaccaacagtcaccatctgagaatgcgcaacgttattttaaaaagtatcaaaagttaaaaaatgcagttaaatatttgactgagcagattaagctaactagagccgagattgattactttgaaaatatccaatcacaaattgaactcgctaaacctgaggacttagttgatattcgatatgaattggaacaaggtcattatctgaaggatcacgagcacaataataaaaagaaaaaagccaaacgacgtaaaattaataaacctgaagtgtttgaagcctctgacggtaccgaaattttggttggtaagaacaatttacaaaatgagcgattaaccatgcataccgccgataaacgtgaaacatggctgcatacaaagaacattccgggctctcatgtgattattcgaagctttgatccttccgaccaaacgattaatgaagctgcgactttagccgcctatttttcaaaagcgagagactcaacgaaagttccagttgattttacaaaagtaaaacatgttagaaagcccaatggcaccaaacccggttacgttatttatgacaatcaacaaaccgttttagttgatccatccgaagatattgtgtctcaattacaaaaataatattgctctcataaagaaacggcaaccaagacaaatgtaattgtcttggttgccgttcttttcttataaaatgctgaatgaatttagttttgcaattgaaaaaatgccatctgtataaactatagttacgtgtttgacatgttcttgaacgataatgaagcgccaacttcctgcctagttgtcccatcggttcgacttgattgcaattcccggaaaggaaaatgggctttcataattgaatatcgttgatgcgtttcagggattaattgcttttcgagttgattgaaatccaaaattcccagatattttttgactaaagcattgacccaattaaccccggtagtcttggttaaaaaagcagtctcagtgattctgattggccgaatgccagaaaaatgataatgcgagtccaccttattaaataatacctgaaccaacccctgccacttacttgtatcaagcaattttagagccttgctgattaattctgtctcatcggtctgccattgttccattggttgctgatagtcgttaatgtaacgcacttcagttcgatcgcttctggtaaagaatgaaatacttgtaattggaatgattttatcctgatcaataaaaacatcgattgctgttgtcgcttggtgattcttgtatttagcaactttctgatctggcggtaaaacaatcatatttaagtcagcaaatttctctaactcatttgataaataatgtcgatttcctggtaagaacatgacatccggtttttccagcgagacaatattcaagatgtttcctagttgaattggctcgatatattgtttgtcacttaattgtggggttaatgacacagcgtttggatttgtgttcatgatgatggttttgtaaccagatttttttaatgtccataatatttgcgaagtgtaataatcagctgccgaattagggccaagttgattcccaccacgaccaataactaaggctgtttttccggaatcacttttgctttcgttttcaagctcgtaactgctataaaagatatttgtggtttctcgaaattctccggcacttggttcaacctctttgtaagttacaggattacaatttcggttaatccttctaattgttgagatattaacctgccacaattctgcaagcataccatcaccaaacccgtagttatgaccaatttcaacagcttgggccgacaatggattattgataacaaagtcttgtgctcgtagtagttgattcaatttgtagaaataaaatcgatcaattctggttaattccgaaagttcatcaattgaaaaacctcttcgaagtgcttccatcaagatgagaattcgactagccagtgggtgaataagttgattaataacggcatcatcatcaacagttgaaacgctcggtaaaatatctcgtggtgaaaactgtgaactatgcattgctttgataatcgcttcttcgacggttctaccaattccaattgttgaaccgacagatttcatcaatgtgttcagatgttgatctacgtcggtaatatctcgaaatggccatagtgggatcttaacaaccacgtgatccattgttggttccataaatgccaaatatttactatatttggttggcaatttgatttcagtaagtgtgtaacctaattctaaaaagctagacacgtaagttaacggatatcctgtagccttagccgccagaagtgtgtttcgcgtgaagaagggactcactttagtcacgaaataattcgagtcagtccggctttgtgcaaactgaacatgacaagttcctgcgatgttaagggcgtccataattctgaatgtagctgttctaagcgcttgatactcctcgttgattaacgtttgcgtaggcgcaaaaataattgagtcgccagaatgaattccaattggatccatatcttccaagcccgagatcaatattttattaccattggaatctctgaggccgaccatttcaatttctttatagccaacgatgctttgttcaattgaacaacgtttaatataggttcgtttaaaacttacttcaagcgcgtcttctaattcgtcggtattgttacaaataaaccgactggtgtcatgacttggagagattggtttgacaatcactggaaaaccaacatctcgaacaaagtccatggcttcctcatcattggcaacaattttagaagcaatcacctgttcattaatttcggtaagtaaatttcgtagtttttgattatcgatgaccttctttaaatcagttggtcgcatacctaacaacgtgatattatttgtggttaaaacatcgctttcagcgagttgccacgcaatctgcatcgcgtttaggccaccggtagttgccataatagcatcgggcttttctttgtcaataatgttaatgacgttttgaaaattaacttcttgaacgtacacattcgccggttgaatttcttcactggcaaaggagaatggattattatctacgtatataatttgggcaccagttttttttaacgccatcacgcgttcaaatgccgctgcgtctaattcgttttcatgcccgatacttgtgggaccgccaccaagtaataggacttttttaatatctatcgccattgctgtcccttcttcttgccataaattctatgaagtcatcgaataaaccaacactatcttttggacctggcgcaccatctggagaaaattggacggaaatggccggatagtcgcggtgtctgagtccttggacagttccgttgactaaatcaacatgagtgatgaataatttggcatggtcaattgattttggatcaacagcatatccttgttcttgagcagagaaaaagatttcatttgtaatgatttcgcgaatgggatgattgctgccgtgatgctcgactctcatttttacaacttttgccccgttagccaacgcaaacagttcatgccctagccccataccgaacaacgggacctgtgactgaacatctcgaatcatttgtagaatggaatctgggaggttaaacggtgctccgggcccggttgataaaacaatcccatccggatctaaatcaaggatcgtttcactgcttgagtcccatggaacaaccgttatattacaatttcgtttggacagttctcgcaaaatgccactcttaagtccaaaatcaacaacgacaacgttatcgccatcgtcagggttaggatatggtttcggtgtggcaacttgagccacttgctgattggtaagaacggttgcgtgtaattgatcaaaagcgtgatcatcagcaacgtcgacgatgctagccttcatgttgccaaactgctgcaaatgatgccgaatttggcgggtatcaacgtcatagattcccggaattttatgttgtttaaggtaacggtctaacgaaatccgtttaaagtgatccgttgccaagttctcgtattcgcggacaatcacaccttttgcagacggcaaaatggactcgtacgcattttggtcgagtccggtattgccaattgatggctgggtgaagacaattatttggttgtgatagatctgatttgaaatgatctcttgatacccattcatagttgaattagcgacaatttcaccagttgtggttgcaagtgatccgaatgctttgccagcataggcagacccatcttctaatatcaaatatctttgcgtcatgttgactcctcactacgctccgtatcatttgatgagctcaacagcgtccttatcatcaatttctgatacataaactttaatcttttctttttgtgaacttggaatgtttttgccaacaaaatccgcgcgaattggtaattcacggtgaccccgatcaacgagaactgctaaattaatagatttgggacggcctaaatccatcacagcagataaagccgctctaactgttctcccggtgtagagaacgtcgtctaccaaaacaactcgtttgccttcaattgagaagtcgattttattgttagacattttgacatcggcgctcattgaatcatgctcgatatcgtcacgataattagtaatatcaagctccccaacagggattgaaacgttttccaattgctgaagtcgatcagcaatccgatttgcaagaaaaataccgcgggttttaattccaatgagaactaaatcttcgacccccttatttttttcgacgatttcataagtgattctcgtcaaggcacgctgcattgccattttgtctagaattatcttgcccatcattaatactccttaattgttgttttaaattaattgaacggtaattaatgtccatttcagaatagaaaagcttggcgaacttgtcaaggtctcggatgattattaattctaaggtgattaagtgtttgttcgaatatttttggcaaaggtgccgaaaatatcataagttcatgggtcttgggatgttcaaagcccaactcttgggcatgtaagaattgaccattacccgcgattgtctttcgagggccatataatgggtcaccaaccagtggatgaccaatatacttcatgtggactctaatctggtgtgttcggccggtttcaagacgacaagcaatgaatgtgtagtcttgaaatcgttcaagcacttcgaagtgagtcactgctggtcgaccatccgggataactgcttgcttctttcgatctttgggggatctgccaagtggtgcatttacaattccagaatcctcattaattcgcccatggaccaaggcaacgtacttgcgaagatttttcttagctttcagctgttcagataaagcttggtgtgctgcatcgtttttggcgaccatcagtagaccggaagtatctttgtcaattcgatgaacaattccaggccgatattcgccgttaatggttgacaatggactatgataaagcagtgcattgaccaatgtatggttgggatgacccgccgaaggatgaacaaccattccctgaggtttattaaccactaaaacgtcatcatcttcataaacaatgtctaaagggattttttcaggttccagactaatgactgcaggtgcaacatcagtaacaataatttcatcgctttcctgtgtctgatattttggtttcttgacttggccattgacggtaattttaccatcgtcaattaagtttttagctcttgagcgactaattgacgaatctaattctgagacaactttgtccaaacgaccttgctgatctttaatgataaatttcttcacaactaattgttaatcccccagttactatttttcacgaataatcgcaattgccaaaatgatgatgccaaaagttaaatacatatcggcacaattgaaaatcggaaaattaataaaatcaagttgaaacatgtcgaccacatgactgtaaaaaatgcgatcaatcacgttaccaagtgttccggccaatagtagacctaatccgattcggtaaggaatattttgccagtattgatttaaaaagtaaataattaagaccgttgccactaaagcaatgacaacaaaaataaactgatggccggaaaaaatgctccacgctgctccagtattattaattcgtgtaatagacaataggccacccacaaccgacaaggattgacctagagccaaatgggcgactacccaatatttgacaaactgatctattccgatgagtaggataacggctaaaaaataaagtacaggcaccttgattaagctcctttagaatagcccggtgattcgaccattttcatcgatgtccatatctagggcagcaggatgacttggcaaaccaggcatcgttaatattttaccagtgagggcaacaatgaaaccggcccccagctttaattgaagatctgacacgtggatcgaaaagttttctggtgccccgagtgattttgcatcatcagtaaatgaatattgggtttttgccatacatatcggtaatttatcataacccattttttcgattcgtttcaatgcattttgggcttttctggataattcgatatcgttcccgccgtaaatcttggaaacgattgcctgcattttatcagttaaaggggcatcaggcgcgaacaattcttgaaattgggctggtttatcacaagcggtaatgacttgctttgctaaattaacagcaccttttccaccatcggcccaactagtgattacttcaccagggacctctaaattgttggcgacgtaatcagccagatacttaatttcattatcagagtcactgacaaatttgttgattgcaacaacaaccggtttgccatattgctgcattccttcaacatgtcgtttaaggttcacgatacccctttttaaagcgtcaaggttctcttcatttagatgcttcttatcagcaccaccgtttagttttaatgcgcgaaccgttgcaacgacaacgacacaatcaggcgtcttttttaatctgggactgacaatatccataaatttttcagcccccaaatcagagccaaatccagcttctgtgatggcataatcaccaaaatgcaaggcagctttagttgccagaatactgttacagccatgggcaatgttggcaaacgggccaccatgaataaatgctggtgtgtgttcaattgtttgaaccaaattcggcttaatggcatctttaagcaacagcgttaaagcaccctgaactttaaggtcggaaactaaaacaggctgccggtcatatgtataaccgatcaacattttgccgatgcgttctttcaaatcagataaactagtcgaaagacacaaaatagccattaactcactggcaaccgtaatgtcaaagccgtcctgacgtggtacacctgatgttcgacctcccaggccaatgacaacctgacgaagttcacggtcattaacgtcaagcactcgtttccacgtgatttggcgaggatcaatattaagttgattaccatgttgaatatgattatcgattaaagcagctaaggtattgtgggcttccgttaaagcgtcaaagtcaccggtaaaatgtaaattaatatcatccatgggaataacctgcgcataaccaccacctgtggcaccgcctttcatccccataaccggccccaatgatggttctcttagtgctagggcaacctttttgccaagttcggtaaatgcgtctcccaatccgatcgtaaccgttgtctttccctcaccggctgcggttgggttaatcgaagtaactaaaattaacttaccatcttttccctgatcagtcggcttaaaattaattttggctttataatgaccgtattgttcgatttggtcttcattaatccctaacttgtcagcaattttaacaatcggttccattcttgctgcttgtgaaatttcaacatcgctcttcataataataatgaccctcctaattttgtctcaataaattttgactagttgttattgatgatcaattaattctttgatttcaataactgaattggctggtaaaataaaactataaattctagtgttggcaacaaatccaagttgatatttggaaacctgaacatgagatatttgatcgagattaatcacaagccaacgtgggttcgtaattcggctcacgataagctggttttggaaaaccttgatgtttcggaagtgaatctcagcccaggtaattagagcaaatagaacaaagaaaaataaggtaatccactggaaatgagtaatttccagccaaatgatgacaccaataaaaaagattagcaacgtccaactccaacaaataatgctgttaagtggactaggttggtaaaagaagtgtcgtttttgcgttatcattaaaaaaactccttaaggaagcgtggttgattaaatgattaaaatttataccgatgcagctgtcaatccggatgatcaacattcatcaattggggtcctgatcgttcataacggtcaacaaactcagttgaaagaaccaattggaccaaccaacaatcatgaggcggaatttatcgccgctattcaaggctttagatatctgactaaggccattcccaaggtcaacgagattgtctttttctacaccgatagcaaaatcgtaattgatagtttaaacaagcggtacgcaaagcattttcaaaatgaagtggatgaattgcttcaacttcagtctcattatgcgacggtcgttaatacttggatccccgacactcaaaatctcggagcccaccatttagctattcaagcattacatgcgcaataacattattcgatatattgactgaccggcttggtatactgttgccaatcagtcgttgattggccaaaaatagaatgtgccaataagtagccgataattggtccagttgttaacccagatgatcctaaaccgccaccaactaaaatgttcgacctgtttggtaatctgccgaaaaatggggcgaagtcatccgtataggctcttgttccaacgcggacaccagtaatttggtgactgttgagatgagccatgaaagccttcgcgttattcaatagctgttgtgctgctacttgggttgccttaagatcaaatccaccttcattttcatgagtggcgccaatgaccaactttccgttattaaatggaatgatgtcacttgaaccttcgggcattaaaaccggcattgactgtggggcaagttgttgactgagtttcaaatcaatgagttgccctttttgcggtcggattttcatcgtaattcccatgggggtcaatgtctttttcatccaggcacccgttgcgatgatggtttgatcgaattgttgcaaaccgtcttctgtaatgatatcaccatccgcggttaaagaaacggtttggcgaataattttcaagtttgtttgttgcgcgcgttcaagcaatttccaaacaaaattcgcgccatcgattttagcaccaccactaacaaaaacgccggcaggtggatttgacaataatggtaaccgttgttggacggcttctgacgacaaaagtgtcacatgccccattgccggcgtatggtcagctttggttaatgcttcttgatatagtttttctaagtccttggctgatttgcgcgtgacaatggtgccggtttgctgataggcatcaggtcccagctgggcttccgtgaccaatttaggatacaattcggcaccggctttagccaatgcgtaccaccgcttattacgtcgctttgacaaccatggagaaatgattccagaggccgctttggtcgcttgaccagtaccatcatcaaacagtgttacttgggtttgctctgaatcaggtaaatggctgagataaaaggcagccgttgcaccaacaatgccaccaccaataatggcaatttgcttaaccatcaactcacttctttctaccaatagttcatattttaacataaaaccaggatgattaatgcttaataattagataaggagctcatattacgaacttttttgccccaaaattgaaaatagtccgttcttattgcgccgttataaagctttcgccgttttgttgcctgttgaccataatacttttcaaactctaaatcagaagtcagaaaatacttggaccagcttgtaagtggtttaaaaacttttcccatttggcggtataactcatggacttgttctttatcgctcattcgttcaccgtaaggggggtttccaatgatgacgccgttaactttatcagttttaaagtcagcaacagccagttgtttaaaatgaatgtcgtctagaaggccaacctcttcagcgtttcgcttcgatatttcaatcatattgccatcaatatcactggcgaagatatctaattcacgatcatagtcggcttttgagtccgcctcatcacgaacttgttgaaccatttctccgtcaacccatggccatttttcacaaataaaatcacgattaaagcctggtgcgatattccgaccaatcattgctgcttcaattggaattgttccagaaccacagaacgggtcaataaaaggcatatcaggataccaactggttaacattactaaggcagctgccatattttccttcagtggtgccgcacctttttcaacccgataaccccgtttaaataaacttgagccagtcgtatccaatgtcagcatcacgtgatccttgttaatggcaacctcgagtggaaacttagccccagtctctggtaaacgtgtatgacgatggtaagcagcgcttaactcatttacaattgcctttttaacgattgcttgggaatctggaacactgtgcaactttgagtttcgtgatcgtccttcaactgggaaggctgcatccattggtaaaaaatgatcccacgggattgcagtcgttttttcgaatagctcgtcgaaagttgtggcatcaaattcatcaactacaattttaattcggtctgcagttcttaaccacagactcgctttaataatatctgcttcggtaccggtaaacctaacccgaccgttttcaacttgaacttcgtagcctaaatctcggagttctttacctacaagagcctcaattccagcagcacaagttgcaactaagttaaatttcattaaatccatctcatttctttttgaatccgatttttgggtattaaaaaagtgggagcaagctcccaccaacctgtttggtgtaaattcctgtaagccatgttttgtgcttgcgtcatcccaggacgataaagcaagtagtaatcatctatctgagaaagagaaatctctttctcccccacacttggttcatttaccgtgtgtgaagctcccctaccataaagtttgggtttcccgctcgaggggtttaccgcgttccaccagcattgtttccaacactgctcgtcactgtggcaccttaaggattttccagcatagcaaagccttagccggattatccgccgtaactccgaagagtcccccggcttattttttcaccgagcacgaacactacaggcatctcagcctgtgcgagaatggactttcctcagccgccataaaagacgaccgcaattactcagaatttacaccaattcattatacactagttaacagaaattagagccgatgggaatcgtttgaattaccatcgagttgtgacccaaacactcttctctctaaattagacaaacgttttaagatgtccatgtttgttgcgctggacataggttggctggcggttggtcgactagaaccagcacttggcattggttgagtcccagagacggctaattgcttatttaactcatcgacttgaacttttaatcgttcattttcgtcactgagatcctgcaattgcttaccataggtttcatagtctttaataatattatccaaaaaactatccacgtcatttggatcatatcctcgcattttttgtcgaaattctttttggaggatatcttttggagtatagttaatgttttccatttattggttacacctcgtcgttaatttgcaacaaaccattaaaataatatcatacattagctcgattgggaactattatttaagttttcttgatattcatcagccgctacctgcaaatcgtcgaatgtaataagccgatatggatacggatgtgtctgtgcaaattgttttattttatcaaaatcatattgtgatttgcctggattatctaaatcatatatcaagattgcctgatctgtgtgtgttagcataaattcttggtaatttcttaattgttctggggaatggtaaggtttttgactgacgctggcagaaaaatcaacttgattagttaatttttgaagcttaccccggttattttcattccagttgctaccaaattcagcaaatggtaacatcatggcagttttaaattcactaggataatctttttttaaatgatttgccgcaacgagtgaccattgttcaatgccaagctgaccaccggaaatgatccagtcagttccatcaatgattgcttgagaaaattcgcttttcaatacagaatcaatcactttacgtttagggtcatcatctttaaaaatattcaattcgtaacttcggtatccacttatccataaacgactcacgcaatcaccttgacaatcaattattttcattcacgatgctagttgatataatgacattattaatgaatattctatacgaaattgcagtacaatgtaagtattcttattaaaaaaggaagctatcagttcaatgactattagatacccaaacggcaatcaattttacgaacaaccagcctcttcgaatgatcataatgacaccatcaacttttccaatcgagggatgactttggaagatgagatcaataaaagcaattcatattatcttagaaatgagattgctgtcattcacaaaaagccaaccccaattcagattgtgtcagttgactaccccaaacggagtgctgcccgaattaaggaagcttattttcgaaaagcgtccacgactgactataatggtgtgtatcatggttattatatcgactttgacgcaaaagaaaccaagaacaaaacatcttttcctttaaaaaactttcataaacatcaggtcgaacatatgagacaatgtctaaagcaacaaggaatttgttttgctattatcaaatttgtcaatgatcaatcggtatttgtcttgagagcctcaacgttaatcacatactgggacagacaagcgactggcggccgtaaatcaattcccagatcagtgattgaaaaacgaggatttcccatccactaccgaatcaatccgctactcccttatttaagtgcggttgacttaatgattgactaaattacgaaggagaaatcaatgtcaaagaatagtcctcaacaaacccgtgctgatatgagacgtgggcgtcagttcaccaaaaagaaaaagggaccgtttcgaagaattatcaagattattttaagtttattcgttctcgcatttctttttggcgctggtttatttacctactacgcttcgagttccccacgtattactcgctcagcactttctagtgataactctactaagttttacgatgccagcggaaaagttatctccaggcttggtagtcagaatcgtgattacgttaaatcaaataaaattcctaaaacactaaaacaagcggtggtttcgattgaagatcgtcgtttttataaacatcatggtgttgaccccattcgaattattggagcggcgatttcaaacgtttccggttcttctcttgggatgcagggtggtagcaccttaacccagcaattagtgaagttatctgttttttctactgcagctagtgaccggacattgaagcggaaagctcaggaagcctggttggcaattcaagttgaaaatcattattcgaaagcgcagattttggaattttatattaacaaggtttacatgggtaatggtgtttacgggatgcaaactgccgccgagtattattataataaaacacttgaaaaactcacgttaccggaattggcacaacttgcaggaatgcctcaatcaccagttgcttataacccatataagtacccgacgtatgccacaaaacgacgtgatgaagtattggatgccatggtcaaaaccaaggctattacgcaggctcaagcgcaacaagctaagaacaccagtgtcaaatctggtttaaccaaaacacattcacggacgcaaacttcggccaaaacttcaaaatatattgacgcttatttaaaacagacaattgaagaattacgtggaaaaggatataagcccaatagtgggttgaaagtttataccaaccttgatttaagcgcacaaaagaagctttaccaagtttccaataatgatccaagtattctttatccaagtaagaggttccaagtgggcgcaacgattgtaaacgttaataacggtaaggtggttgctatgcagggtggccgtaaagccaaggttgcttttgggttaaatcgggcagttcaaaccggccggtcaactggttcaacggccaaaccggtaatggattatggaccagccattcaatatctgaagtacccgacctatcagccagttaaagataccccgtatgtttatcccggaactgacaaatctgtcatggattttgataacaaatatcaaggaacaatgacaatgcgtaaagcgttggttgagtcgcggaatatcccggcaattcgcactttggaaaacgttggggtttcaaaggcgactggcttcctgaaaaatctgggaatgaccttcaaaaagccgttggaactacaaaatggcattggtttatatgtttcgtctcaacaattagccgctgcttacgcagcattttcaaatggcggaacgtattacaaaccctatttgattaataagattgtccaagcaaatggtgtttcacgaacgtatcataaacaaggtaagcgagcaatgtctcctgccactgcgtttatgattaccaatatgttaaagggtgttatgacagatgctaatggatcaggaacagctgccaaagtttccggcttgtatgaggctggtaaaaccggaacgacgcagtatccagatgactatattaataaggtaccggctgactcatcaatggactcgtggttctctggatacacgcgaaactattcactagccatttggacaggatatgatcatcagtttaaagcagattcgtacatcacccctgctcaaacagatattgctcaacaaatatataaatcggttatgggatatatttctcaaaacaagcccaacactgattggacgaagccaagtgacgttgttgctaccaatcgtggtggcacaacggaatattatgttgccggttatcctggtgttggtactgataatacggctcaggcagctggcagctactcagttgaaggcagttcaagttccgataataccgttgtgacgcaacctagaagtgacaacactcgtaggagtgaaagttcaacagagtcatccgagtcaacaccaaccacacaacagccaggtggtgacggtggcgccaacaatgatcgagattccagctcaacgacgtcgagttcaagtagccaaagtgatactagttcttccagttcatctagtaatacggctagttcgtcatcaagtaacgatagtggtaactccaatcaaacagacaataatggcggtaataaccagccttaactaattgcgctggttagttgtaaaaagggttcgaaataattgtgggatatactcacaattgtttcgaaccctttttataactatcttttagataattagtaattgccaacaaaatcataaggcagtttactgttttgtcaaatcaatgaatggaatctctggcccatcataatggtcgtcaggactgtcggtttttcgatttgattggttacgtttttgaagataagtttggatttgttgaggagaccttagcttgttatgttgccaattgccaagaattcgatccatatatttcaaattataaacttgactgagcacggcttctttcaaagctagtctgataacagttggttcaaagtgatcaatatctaaccactggctaatcatttccatctcaaaaggtgataacgtcctgccaaattccttttcaatagtttcaaaaactgtctggcgatcactttcactaactggattagcggattccgcagtggttgcttttttgcgcgtcacagctggttttaaaagtgacaatttctcatacattggcgtgaaatcgtaagcatcaacttggtgcccatcatttgaaacttgcgtaattttggttaacttcttttcaatcatcttatgaaatatgtcaaacaaccgttgtttgggataacctgtctgaacttggagatgatcaatttcaggcattgggactgtcatcgtgtgttggcccttaatcagaatgtaaataaataattcttcactgctgacaccaattcgatggtaattggcgagcaggtagttcgtgattgttgtctgaccatcactgagaatttcgtgtgtataatcgtccaaagaaatcccccttcctaatggatcattaaggataaattcgatttagcaaacgtggaaatggaattgtttcacggacgtgatcttcatgcgtaatccaagttaaagcccgttcaagacccaaaccaaagccagcatgagggacactaccaaatttgcgtaaatcaagataccaagaatattccttggggtctaaaccagctttaacaacttgatcatatagatagtcatagtccactgcccgttcagaaccaccaataatttcaccgtacccttccggtgctagtaaatctgcacaaatgacaacatcatcgcgagttggatgtggtttcatgtaaaatggtttgatcgctttagggtaattcaaaacgaagactggctgattaaagtgatcggcgagaaaagtttcttcgggtgaaccaaagtcggcgccccaagaaatatcaaaatcgttcttcttaagtagatcaattgcttcgtcgtaactgattcgcggataaggtagaatggtatatttcttgagaacatcaatgtctcgatccagtgtctttaattccattttacaattttggatgactcttgaaactaaataagcgatatagcgttcctgaatgtccaaactttcttcttggtgcataaaggccatttcgggttcaatcatccaaaattcaattaagtggcgtcgcgttttagacttttcagcccgaaaagttggcccgaatgagaagacttttccaaaagcttcggcccctgcttcttcatatagttgcccactttgagataagtaagcatcccgatcaaagtattctgtatggaataaatccgttgttccttcaggcgcactaccagttaaaataggagcatcaaatttaacgaatccttcactgtaaaagaaatcaaaggttgctttaatgacttcgtttcgaatccgcataactgcatggggacgacttgaacgcagccaaagatggcgatgatccatcaaaaaatcaataccatgttctttgggtgtaatgggataatcatgtgattcagaaatcacatcaatggtttcaacctcaatttcatagccgaattttgaacggctatcttcatgaataatgccagtaacccacatacttgtttcttgcttgacctctttagcaatttcaaatgtttcggcagccacgttatttttaactacaacaccttggaaaaaggcggttccgtcacgtaactgtaaaaatgcaattttaccacttgaacgtttattggttaaccaaacgccaattttaactttttcgttaacgtattttggtgcgtcaaccatattaatttgtttcaatcccaatccctccagaaacttgtttttctaaaaattgattcataaacttatcaattctggcaacagcagtttttaaatttgctaaacttgctgcgtagcttaaacgtaaatagccaggcagaccaaatgcatcaccatcaacaacggcaacatgagcttcgttcaacagtaacttaacaaattcagcagaagaactaaccccagctaatttcattgcttcagtaattcttggaaataaataaaaggcaccctctggtttgacagcaacatcaaaccccgggatcttttgaacgagtggatagattgtgtttagccgattttcaaatgcttgacgcattctttcggcatctgattgatcagatcttaatgcagcgattgccgcatactgacttaccgttgccgggttgccggttgaatgtgatagcactgaattaactcgctgaattaattcggagttacctgcaatataaccaattcgccagccggtcattgaataagttttcgaaacgccgctcactaaaattgtgttagccgcaatgtcaccgcctaactgaactggtgaatagaaccgattttgattataaaccagtttaccgtaaatatcatcagtgatcatgatgatttgatgattaacggcccaatcgccgattgtttttaaatcggcttcggagtaaacagttccggttgggttttgtggtgtattgatgattaataatttcgttgtggctgtgacggcttgatcaagggaaactgtggttattttaaagtttcggtctgtatcaaccatgaccggagttgctccggccagtttgacttgttcatgatagctaacccagctaggcttcggtagcaacacttcatcaccttgttcgactaaaacctgcattaaaacatagagcgccatttttgcaccatttgtcacactaatttgggccgtatcatagtgaatgtcataatcagtttgaattcgatcggcaatggcctgcttcaattccggtaaaccgctagctggggtatagaaactggttttaccatttttaatcgcagtaatggcctcattatcaattgtcgttggtgttgtgaaatctggttcaccaatccccaaattaatcacgtcaatcccatttcgaatcatttttttggcttgacttgaaacttggatagttgctgaaggtgtcacttgcatggctcttttggaaaatttcatggttcaatcctttcatttactaaatattttcaattaatttttttacggttccagtcttaaaagataaagtggcatagcacaggttgctctttgaatttaaatagctgacaacccaatacggtttgttcttaatcaaagtcaaactgatactattgatcttctttggttgcttggtttgcacaatcaagcttcgaattcgttgttcgctcagtccactactctggtcgacaactgttacgttacctccctttttggcaacgatgacatagatgggctttcgcttgtttgtggtaccggccacagaatagtaagtcttgccaaggttggaagcataaaatgcctcgacggttttaagaccagcatattttttggccaatgttactgtctgatttttagcagttaccattggtttttgagcctcatgaaggacgacaaatcctgcaaataataagattagaatcactagggtgattatccaggaaacttttactttcgattgcttttttattcgacgttgcctttgcatagtgttgctgtcctttcgtttcaaagttacttttaattatagcaaataagtcattcacaaaaagttaagtctcatttaagtgtctgggttatttcattttttaaagtcaacgtgagtgtggaaaaaatttaccatatcaaaaatgcaatcatcaattgatcccgtcacgagtggaatttcattccgaaggtttgctaaaattgtttcaccatagcgtttggttaacaaccgtggatctaaaataaagatggtgccgtaatcgtccttggttcgaagcaagcggccaatcccctggcgcaagcggagcgttgctttaggcaaagtaatgctataaaatggatttttccccctgccgcgttcgattgaatacaacgcatgattataaggatcggctggcgtatcaaacggtaactgggcaacaatcaaattttccaacagatttttcggaaagtcaacgccttgccaaaaggtattagcacccagcaaaattgcgggctcatgatgaatgaactgcttgcttattttagctgctgttccgtgaaccccttgagctaatacgaagtgggttgcagtaaagccgctttcttgcaaccagcgatatgttttttcaattgcttgcagtgaattgaacaagacgagtgtctggcgtggttcgttttcaaaaattgtcgcaatgttttcggcaaccttctttagataacgatctgcattggttgtaaaaatgtgatcgtcatcacttaccaagtaaattcgagcttgattttgaggatcaaaatcactttttagtcgtttgaccacggcatgcttacgatcaatcccgagaaggtcataaatgaatcttgatcgtcgtgacggaaaaatagtagcaccagtgaacgtaactggttcaaaagcatcataaatgttttcgtttaaatacgtttcggtttttaagattccctggttgagtgacaagctattgacatctttaacgtgattaatggtgatccaggtgacatgttggtcaatggattgatcatccatatcaagaatctccaacatttggtttagctgctcagacagttgattgtaattctcgaaaaatgtatagatgccagaaaaatcttgatcagtaaaggcatctacatttctgttgatttcggtgtttaattgcgtgattagtccgtcaatggcttcttgtgtgcggcgcaagcgatcaattgtgggatggttacccttaatgatcgacttcatctcgttaatgggaatgagacgctcaaaaaaactgatgtttttatggagctgtttgtttcgcacggctttttcaaacatggtttggatcaagccggtaataatctgcttaacctgacccaattgaccgcttaattgatctgccagactatccaaagtaatattgccaaccaagacttcatgaatcgagccgtcgtgttcttggttcatactagccaaaattcggttaactgaggtcatgattgttaatggtttaatggttgcctgattatttttgatggctgtttcagcaaactgctgggtttcgtcaattaacaagtaaggtttaaccggcattgacttaaagaactgccagtttttgattaagtaactgtgattaacaataataaactcggcggatttggctttgcgaaggttataccgtaaaaaatcgtcctcataaaatggttcgcttgggtcaagccatttaacacctgtatgttgaattttccaaacaaagggtgtctgttcaacgtttaggtgaagctcgtccaagtcaccagtggtagtcattgtcagccaaaccaaaatctgagctttcacgaaagctgtttgactggaactgtcaggaacaaacagcaggttgcgaaacttgttgaggtcaatgtaatgtcttgccccttttaaaatgacgctattaattttaaaaggtaattcgtcattgatcatggggatggtttggttttgtagctgaaactgtaagtaagttgttgaggtactaatgacaaccggtttttgtggagttgctaaataactaaatggcaagcaatagcctaaacttttaccaatgccggttggggcttcaattaagagcggtttggcttgatgatcctgttggtcggcataattgttgtaaataagattcatcatcttattttgttcggttcgtgattcgaggtggtcgggtaaaactgcagctttcgcttttttggtttttggaaacttggccttttgacgaccggatatatcttcaatcgtaattggcttacgtttgcgaatgattaatcccgaagaaattttgagatgttctggaagcggcatcgtgtgtacgcgatgtcgattgacgtcgtcagcatccaaaaatatctgcatggtatcttgaggtaacggtggattaacggcaataatctgttccaatgtcatttgtggtaattcttggatttggtttagtaaaattgtcagtaattttgcggttgccaaggcatcactatcagcagtgtgcggatgtttgtgggtgatattaaaataggaacttaaatcttgaagccgataacttgataatgttggcagtaaaatctgacttaatgtcacggtatcaatcgccggaatttgtaattcaggataccctacccgttgaaattcgccattaagaaacggaaagtcaaaattgacgttatgggcaacgaagacagtgttgtttagcaactgatacagtttggcagcaacttggtcaaacgttggggcttttttgagccgggaatcagaaatcccagttagctgggtaatccggttaggaacatcccgttgtggattaatatcggttacgtacgtttttattattttgttgtttgtaaccaagcaacagctgaactgaatgatccggttatcttcagaagtcgtatcggtaccggtagtttcaatgtcaacaacagcaaaggttgtttttaaattcatgtttgttcaccaatctatttattaaatcaattttttctttttatgaatcattatatttaataatactacaagcgcgttgtgattatctaccggcgtctgttggcaattttttatgaaactttaaaaataatagtaaaaagttctgaaatcgttgaattatgataaaattggaatgtttgaaagtgagcggataagattgaaagaaaatgctttaggaaaaagtaatgctaaaatcatttggtttggcgaacatagtgttgtctatggaaagccttcaattgccatgcctttatattcagttgatgttactgctgaaattgagcggactgccgctggacaacaaatcaagtgtcggtattttgatggcccaattaatgaaatgaccgacaatttgaagggggtccgggttcttatcgggacgttgttggatgttcttggaaaccgggatttgccatttatgcttcgaattacaagtaaaattccttctgaaagaggtatgggatcatcagccgctacagccgttgcccttattcgggctttttaccatttatttgaagtacctcttagtcgtggtcggttgttagaattggcaaatgttgaagaaaagatcacccatggcaacccaagtggcttagatgcggcaactgccagctccgacatgccgatttggctgattaaaaacgagattaatgaacaaatctcatttcatttatcaaggccctgtttggtgattgctgacagtggtattaaaggcaaaaccggtcaggccgtttcactggttcacgataacgtggttgatgaacctgatttagccattcccttgattaatcaattaggggaaattgccactttggcgcgccatgcccttgcaacatcaaacgagtcattattggggacactgatgaaccagtcgcaaaatcatttagctgaactgggtgtcagtacgtcaactttggatcttttttgtcggattgcccgagcacaccatgcgcttggtgctaaattaaccggtagtggtttgggtggctgcatgattgcattagcggctaatcataccgatgctcaaaagatttcaactgcattaagacaggctggtgctacccaaacttggattcaatcttttcgaaactacgacatttccacaggagaaaaaaatgacaacctggtcaaataaatcgattggtgccattgcacatacaaatattgccctcatcaagtactggggtaaaaaggacgaatcattgatcattccgtataccagtagcttgtcattaactcttgatcaattttataccgaaactcatgttacttttgacgaatcactgactgccgatgtcgttatgattgatgagcaggaagtgaatggtcaagggtggcaacgggtccatgactttttgtcaatcattcgaaaacgtgcggaaatgacgaccaatgctcaagttgtttcaactaatcacgttccaactgcagcaggcctggcatcatcagcctcagcatttgcggcgttggcggcagctggtagtaaggcggctggtctggatttgtctcatcgggatttgtccagattagctcgacgtggttcgggatcagcttgtcgctcaatttacggtggctttgttgagtggcggcgtggcactgatgaccattcttcttatgctgtgccggtaactgctgataacgggttaagcgatgttcaggtcattgcactgaccgttgaacgtcatcgtaagccgatttcgagccgccaagccatgcgcttatcggtaactacttcgccttattatccaacttgggtaaaaattgctcaaacggatctggcagccatcaaatcagcaattagcaatgatgatttcactaaatttggtgaaatcagtgagcttaatgccatgcggatgcatgccctcacactgagtgctaatcccgactttgtgtattttaatagcgaaacgctagagtcaatgaatatggtgaaacaacttcggcataatggtatcgaatgttattacacgatcgatgccggaccaaacgtcaaagttctttgtcagcagcgtcatgttaatgacgttgttgagacatttactgaaatgcttggtgctgataaagtcaccctcgccaaatcaggtccgggtgtccactatttataatttggaaaggaaatgattgcttgattacggtcaaagcgccaggaaaactatatattgcaggggaatatgcagttgttgaaactggctacccgtcaattattgtcgcattggatcaatttgtgaccgtcgaaatttctcagagcaaatcatatggcagcattgtttctaagcagtaccgcgaagattctgtttactggcgtcgtcaaggtgatgaaatgatccttgataatcgagataatacgtttaactatattatttcagctatccacttgactgaggcctatgcacaatcgcttggtcgttcaatggctttatatgatttacggattaacagcgatttggatagccctaatggtaaaaaatacggtctggggtcttcagcggcagttaccgttgcgacagtcaaagcactatgcatgttttataagattccgctaaccaagagtaaattgtttaagctgtcagcgattgctcacctggatgttcaaggaaatggttcgttaggtgatattgctgcgagcgtttacggtggttggatcgcctatcggtcttttgatcgcgcttggttggctgctgccagaatgcaacaatctttaacggatctggttgatcaaccatggccacatttaaagattacccagttgaccccacctgataatttacgcttaattatcggatggacgggatctccggcatctacttctcatttagttgacaaagttgctattcagaagagccagcagcatgtgacttacaatcaatttctgcatgagagtaaaaaatgccttgaggacttgattgatggctttaaacaaggtagtttgactgcaattcaagctggaattcaaaaaaatcgtgaaattcttcaacatctcgctgattttactaaagtccaaattgaaacgcccacgttaaagaaaatgtgcgacattgccgttgaacattcagcagcagctaaatcttctggtgccggtggtggtgattgcggcattgtgttgatcgataaaaatcaagatattgattctatgattaatcgttggaggcagaatggcattaccagattgtcgctgcgggttcatccagttattgaccttgataaggagtagctcatgatttcaaagcattctcaccgtaaagatgaacacatgtcactagcagaaaagttttatcaagatcaatcggcatttgctgactttcgctttattcaccaaagtctgccagaaacgtccttggctgatattgatctttcgaccagaattggaccacttagtttaaatgtccccttttatattgaagcgatttccggtggtagtctaagaactcaggaaattaatcggcagcttgccacggttgctaaagcgactggtttagcaatggctgttggttcacaaagtgttgctttgagtgatccaactttacgggcaacttttgaagttgtcagaaaagttaatccaacgggaattgtttttgcaaatattggtgctaaccgaaattatcaagatgcgcaggctgccattgaaatgattgatgcaaatgcacttgagcttcatattaatgtggctcaagaattgattatgcccgaaggtgatcgtgaattctcttttatcacaaatattgagcaaatggttcaccatctttctgttccagtgattgttaaagaggttggctttgggatgagtcgggaaacgattgctcaactcattgatttgggcgtccattatattaatgttagtggtcacggtggaacaaattttgcaacaattgaaaattttcgacgtccacagaagaatatggcttatttaaagaattggggattgacaactggagaatcattattggagagtcgccaatttcaagaccgcttaacgattcttgcttcaggtggtgttaagtcaccgctggatgttgctaaatgtttagctttgggaagtacagccgttggaatagccggacagtttttgcacgaagtgattcatgaaggccctcagacccttatagataaagtttttgactggatttacgggttgaaggccattatgctaatggtccatacttcaaccatttcagaattgcaatcacaaaagcttattttaagcccagagataatctcctatttaaatcaacgcggtttaacatattagtttatccttttgagttgaatcattaaataaaaagcaggcaatcaagagaaacatttcagtctcttgattgcctacttttttatttaatgagcgatttagccacctaatcagcttgaaatcgaagccccttaggaaagaaattttttgcagtgccattcacaactttgctgaatccaactggttggccttcacatatcaattgatgccacccctttttcaggctcttatcgactgaaaaagtatcaccatgaacatatttttgccagcttgcacaactaatggcaagcggatgaatcacgtcttgaggatgcaaggcaattcccaatgcgtaactcggttcaaaccgacttttcttgaaagtgccaatttgaagccctaatcgaataattttgatgcctgccaagttaggtgttatttctgggactgagtatagatcatgtttaaatgtgactaatcgaccgaaaatcggcttctttagcatttgtctttcaaaatcagtccaaagatttcgttcttcggcattcattggttgggtattttgattgattgcaacatcacggtgatgtttactggattgctgatgtaccggttcagaagtcggcttttgcagtttggcaataaaatgaccttcaccactaaaatgttgagggaaaattcgaacacagttttgtaaatcagagttaccatctgcccactcaggcaccccactatccattcctggaaatttcttgactggtaacagattaaatccatatgttttgacgagccaagcaatgatttgttcgtcttcctccggtgaaaatgtacaagttgaataaactaagatacccccgggtttaagggtcttaacagcttcttttagaatcgttcgttggcgttttgcacattcggcgggatagtctaaattccaatactgcatcgcgtcgggatcttttcgaaacatcccttcacctgagcacggtgcgtcgaccaatacccgatcaaagtaatttggaaggcgggcggcaagtacttcaggagtggtgttggtaacaattgtgttggttaaaccgaaccgttcagtgttttcaaccaatattttcgagcgttttgaattaatttcattagcgattaataagccagtattctgtaaataacttcccaagtgtgttgttttaccccctggagctgcgcataaatcgagaacgcgctcgtgttgcttgggatgagcaacctcccccacgtacattgcacttggttcctggctgtatacggcaccactttgatgatcaaccgttttaccggttacttcgccgtaatagccaaattgacagtgttcggtagcattggttaaattaaccccgcgtggtcgattttcctttaacgggttgatccgaaacccgtgacgagcgggcttggaaaagctttgaataaaggcatttgcctctttctgaccaagtaggtgttgatatttattaatgaaatctgttggtaaagccataactttctcctctttagaagtcgatgattgacgaaattttatttatcggatagtataaatagatacgctggttaaggagtgatcacaattacaaaaaaattaatagcacttgatttggacgggactgcattgaataatgatgccgaattaagtaaccaaaccaaggcgaccattagccaagctgttaaagaaggctacctggtaagtattgttaccggacgccctaatcgactttccgaaaatttttatgatgaattaaacttaaaaacaccaatgattaactttaatggcaacctaggcattttaccacatcaggcatgggctcgtgaatatcagtatacgattgatcgcgaaattgtgatggaattgttggaaaaaagtaagctgttagggctctctctgattgctgttgaaggccgtaacctgtttctagctaatcggggacttaaatctggatttggttttttcccaagtaccttacaaacaaatcagattttaaaccaacaaagcctcaaggacaatccaattagcatcacagtggaagtaagacctgagctaaaggctggattgattgactatgttcaaaatcagtttggcgatcaagttgaagtttctccctggggtggtcctcatccaattgttgagattgccaccaaaggcattcacaagtcaactggattaaaatttttagctgattactatgggattctgcaaaaagatatcattgcgtttggcgatgaggctaatgatttaaccatgatgaaatacgctggtactggtgtcgctatgaaaaatgccatcgaccagattaaaaactcagctgacgatgtcacaacgtttgataaccaacaggatggcgttgcccggtatctgcaagaacatttggacttggcagtaggtcaataaaatgagattgtttaataattcaattttcactatttttaagtgaaaatcatttttacgaagatgtttggtatgttaaaaaacagacccgtattttgatgagttattgatatgtaaaagcccgcggggatgaaaattcctgcgggctttttgctttaaattattagcatctcgttagacatgttgaacatattctgcaataaatccctcgggatctttgacagtgatgttttttccggtcggaacatgttggtaaggatgaattatctgaaaatgatgttgtttaaaaaagacaacaaattcatcgaggtcatcaaccagaaaagtgatctgggttgtgcgaaagggtcgcagactgttttcattaccactaattaataatagattaccaatcgatgctaattccaaccccttctgtggatatttaaatcttgattcaacggttgttgacagtaattgttggtatcgattaatcgttgcatttaaatgatgaacgtaaacgcgggtatagctcttcaatattttcattagatatcactttctaaaaaggctgaaactaagtggtactttgtaaaagtgatgttgtgactaatcctcatcagggtgatattggatagttgctttaaccgctttttgccaacctgaataaagtttctcccgttcggctaactgcatatccggcttgaaattatcacgggctttaaccgtttttttaatttcatcaatggacgaccagtaaccaacggctagtcccgcaagataggccgcacctagcgcagttgtttctgaaattgaagctctttcaatcggtgttcctaaaatgtctgcttggaattgcatcaaataattgttattggccgcaccaccatcaactgccagctctttaagatcaatgccagtttccgcaaccattgtatcaacgacgtcccgagtttggtaagctagtgattccaaggttgcccgaacaaattgattcttggtcgtggcacgagttaagccaaagactgcacctcgcgcttcttggtcccagtaaggagcccctaagccggtgaaagccggcaccacgtaaaccccgtcagtacttttagcagcaatcgccattttttcagattcgggagaggttttcaccatttccatgccatcacgaagccactgaatcgctgaaccagccacaaagatgctcccctcaagcgcataattaaccttcccgtcaatgccataggcaattgttgttaataagccacgtttggataacgttggtttttcaccggtattcatcacgataaaagcaccagttccatacgtatttttgatcatcccacgttgtaatgccatttgaccaaacaaagcggcctgttggtcaccggcaattccggcgattggtacttggacaccggagaaagaataacctgccgtatagccgtaaatttctgaagaagaatgaacttcaggcagcatactttcgggaatatttagtaatttcaaaatatcatgatcccatttgagatcatgaatattgaacagcattgttcggctggcattagtataatcagttgcatggactttaccgccggttagtttccacaggacccatgtatcgatagtgccaaataataaatcaccgttttccgccttttgctgcgcaccggctacgtgatctaaaatccagcgaattttggttgccgaaaaatatgaatcgataatcaatccggtcttttcgtgaatcatttcagaataacctttgtttttgaggtcatcagccaaatcagcagtttgttttgattgccagacaactgcgtgataaatcggttgaccggtatttttgtcccaaatcacggttgtctcccgttgattggttacgccaattccccgaactttatatggttgaacatctgcattaatcaaagcttcggaaatgaccgactgaacagcattccaaatttcattggcatcatgttcgacccagccggatttcggaaaatactgatggaattcacgttgagctttaccgacgatttctccatcattattaaacaagattgccctggtgcttgtggtaccttcatcaatggccattatgtattgctgatcattcatgtaaacgtctccattcctgttattcatgcatttgtttcgtagttaatacctttttaagtatacaatattctcattgaccacaccaatcaaaaaagaaatttaaagaaagaacaagaaatcaaaagcgattcacaaagtatgcaggttacattccaaccgcaacttgattatttttggatagtttgtcagattgaccgaggctaaaaaaaacgagacaaaaggcgcttaacttccagagagtaattggattatccgaatattctgaatttgaatatttagataatccgggtacacggccggaagttgccgtttgtcccgcattttagttcggtagaaatcgtgtttacaccaacagagactggttaaaatgattattgtcccagccttctaaaaaagagctgagacaaaaagtgattttgtccagccccatttttgtaatcataactattatcaagaaaaacgtgagataaagggcaacttccagagcacaaccgcccttcgtctcactcagcaatatttattagtggtcatctaggaagacgtaaaatagtcaatataatgatttatttttcgtcacttttcaagacgccaccaacgctataacgattagtttgcatttcactcaaaataacgtgaacatgttctgcaggcgcaccagtattcttaacaacagcggccgtaacgtcttcaacaagccccttcaattgatcttgagatctaccagcaattaaatggatatcaacaattggcattagctcaacctcctaaattattttttaattagaaaaagtataccttattttaatttaatccgcaatattctttagactgaattcgaggaatttataagggttattcattcgacgcttgagaaaaagatgatacaattaacgatatcaaattttgaataatcaaggagaaaaaataaatgataccatttaaaaattattctgcctgcacaagcatgatcgttggtaaaaaggctagtattgatggatcaattatgattgcccgaaatgaagacagcaaatcatcttggccaaaaaactatgtgattcacccccatcaagaattcaacgatgatcaacaattttcatcaactgataatggttttaagatgcccttaccacatgttcggggatcctattccgcaacacctgaatggaccgataagtttgggttatttgaagaaaatgggtttaacgaatacggtgttgcaatgagtgccactgaaagcacatatactaatgaattggcactgggagccgacccgttggaaaaagatggcattggcgaagaagctatgattactgttgtattgccgtatgttaaaacggctcgtgccggcgttaagcgactcggtacgatcattgaacactatggaacttctgagtcaaacggcattttgtttgctgataaaaacgaagcttggtacatggaaactgccagtgggcatcgctgggttgctgtcaaaattcccgatgatagttacgcagttattgccaatcaaactgccattcaggaaattgactttgatgatccgcaaaattacttgtggtcaacgaatattcgtcagtttgttcaagaaaaccatctcaacccggatcagactggtcgaacctttaattttagaaagatttttggaacggctactttagctgacacttattacaatacgccgcgagtttggtatggtttgaaattattttcaccggaacaatcgtacgagcctgtagatcaagatatgcctttctttaatcgtgccaaccggaaattaagtgtcttcgatgtccaagacttcttgagttctcattaccagggcaccccttacgatccaattggtgagggatcagaggcggacaaacatcgatatcgaccaattagtctagccaagacccaagaggctcatatccttcaaattcggccttctatgccactcggtgcttccggtattcagtggttggcaatgggtgtggctgctcaaagtacctttgttccattttatgctggcgcaacagatacgcctcaagcctatcaaaatgcgagtggtcagtacgcgcctgaccaagcatattggacgtataaactagcaggtgtactggttgaccctcattatattgaatttggaccgaagttaaacgaaaccaaggaacagcttcgaatccggtttcaacagctcgttaagcagacggatcgggttgctaaagaattatcaaacgttgaacttgaaaattatttgacgaaggttaatttcgataattcaagaattgcgttaacggcttatcaaaaattgatcagtcgcttagtgacggcggcgactgatttttcaccaattaattttaaacaggacgttaacttgtgattggtgagcaatgagcgttcaatgattttatgtttaataaagcatccagatatctcaaaagagatacttggatgcttttttaaattgctgcgacgaatcatgatattaaaaattcttttaataatgtgcccgagtaaacgaaccacgaacacggttgctggcctgagcaaccaatttggttaacagtttttgtgtatctttcataacggtatcggcagttttggcattctcaccagttagtacctttattaaaccagcttgcgacgtcttggatgctaatttatcaatttcagcaacgcgttgatgaccatagcccatttccttctcttggtatgcttctacttgatccatcaaactgtgatagtgatcagttgcgattaaagagattaatcggttcaaccaatatgcattatgactatctaaaagcccggtcgtgttgccataggcagccggtgtttcatcgatgtttgtaaagaatggcaccaatatattatacggatttgccgcaaacgccagccactgaatagctgcagacgatttggctacgtatggtctgagctgcataactgataattcttgattacgattaaaaccaatgggtcgataaggtgttttttcataatcaataccaggggcaaacggatcatatggtgtatcttgataatgagaactcaagataaatttaatatcttcaatggtgattttacgatctgcatgacaaatgaagggcaaattgttactcattggggacttgccctgaacggattctggattaaagtaacgttggccgtaccaagcccgcggtgtattatagtgatgatcaagttgtgaatctgagccaaatattttcctgaaattaaagtcattggctggattaagatgattcgttttaacaaagtctcggagatcgtctggaaacatgaaattgtctggatcattaaaatcaacttcttgaattcctgtttgatttggtgcaataacataagcgttatctggaattcgttgggcaacccagtggtgaccaccagcagtttccatataccaaatctcattaacatcagaaaaaataatcccgttggactcgtaagtcccgtgttcctttaaaatttgggcaactcgttgaacaccttctctggccgaattaatgtatggcagtgtaacggtcagtaagtcttcctcaccaactccactcttggtcagtggatccgcacctaggactctggagttggttgtaattgtttcagttgcgctcatagcaacgttatttccgttaatcccagcttcgccccaaacgccattctgatccactgcttccgggacggccgtataacgctgtggattatcgggtagctgaattgtaaattgactccccttggcatgatagtcacgtggttgatctgcaggatgcataacgacgaatttttttggattaactgcaaccccagcatcttcattcctagcgatcagtgttgaaccgtcataactggcatttttaccaactaaaatggtggtacagctactatgttctgatgaatccatatcaatatcctcctaataatcatttaatgaatcttataatgaaccttaacttgattttacaacactcgacatatttttgagcagcgcttatcaggtacaatcaatgatttcaaataaaaaagacgtagaaaacaaatggtaacgcggtttctacgcctttaaaaacagttctattatttgggctttcttgtttagcatcatgatcgaagagcttatttttgagccggttcttcataatcaccatttggacaaatcacctgagtgccgcccttaacctttttctcgactaagaaatgaccatcttttggacaatttctgccaatcggtttatcccatgaaacaaaatcacaatcagggaatcgtgaacacccatagaaaagtcggtttttctttgactttcgttcaatgacttgtccttgatgacatttgggacaaataacaccgatttctttgacaattgccttggtgtttcgacaatctgggaatcgagaacaagcataaaactttccgtatcgccccatcttaatgaccataggagcaccacagatatcacaattaaaaccagctggttcatctttaatctgaaccttttccatattttcggtcgcagattcaacttcagttgagaatggcttatagaaagtatcgacgagtttaatccagttttcttttcccgcctcaacttggtccaatttgccttccaagtttgccgtgaaatcaatattcacgatatctggaaagtattcaataataatcttattaacaatttcaccaagttcagttggttcaaaacgtctgccaaccagtttaacgtagtatcgacgttggatggtttccaacgttggggaatacgtcgatggtcgaccaacaccattttcttcaagcgccttaatgagtgtggcttcgctaaaccgagctggtggctgggtgaaatgttgatctggattattcttgactaatttaacaaggtcgccttcttcaagatccggtagtaagttgtctttttctttactatcaccgtagatcttcaagaatccgtcaaatttcattttggaaccgttcgccttaaaaatgatatgattttgttcaattgtaacagccatcgtatccataagtgccggggtcatttgactcgcaacaaatcttgaccagaccatttggtagagtctaaattggtcacgggtcaaatactttttaagactggctggggtccgaaatactgacgttggccgaatcgcttcatgagcatcctgagcgccttcaggtagcttgcccttaattggcttggtcgctgcatattcagccccgtatttttcatgaaggaattttgaagcttcatgcttggcaattacggagatccgggttgaatcggtccgcatgtaggtaatcagtccttgactgccttccttaccaatattgatcccttcatataattgttgggcagccatcattgtctttcgagtccgataattcagctttcggttggcttcttgttgaagcgtactggttgtaaacggtggttgcggttgacgctttcgctcacgacgggttactttggtaatatcaaagtcgcccttagaatcaatttggtttaagatttcttgaacggcctcattattcggcagctccttcttttttccgttaacgccataaaagctggcattaaatttactggttccttttttaaattcggaatcaatcgaccaatattcaactggtttaaaatgattaatttcattttcacgttgaataatcagccagagtgcaattgattgaactcgaccggcactcaatccttttttgactttttgccataacaaaggtgaaattgaatatcccacaaggcgatccaatattcgccgagcttgctgagcatcaaccaggttcatatcaatattccgaggatgtttaaatgattctttaactgcatctttagtgatttcgttaaagacaactcggttgtcagcttttggatctaaatccaaaatatgggatagatgccaggcaattgattctccctcacgatccggatcggctgccagatagacttttttggcctttttagccgcagaccgtaattccttgatggtatcacctttaccacgaattgaaatgtaatggggctcataatcgttatcaatatcaacgcccattttgctctttggcaaatcgcggacatggcctttactggcgacaactttataagaacggcccaaatatttttcgatggtttttgctttagcaggagactcgacgatcacaagattttttctgggtgatttacgtttggtcttggctttagcttttggttttgttgtagttgccattttttctcccttcaaagctttataaaagctactatattataattagttatttgttaatttttattccacaaatctaccacatcatattgcatgatttttcaggtgtcaactaatgaactcctcaagaatatcctttgaacacaaaatcggctttgcaccagctgcgattaattcgttcgttccaacagacaaatcgttaataatattgcccggtacagcaagcacattacgattattttgaagtgctaaatttgcggtaattaagcttcctgaatgatgttttgcctcagtaaccagtaaactttgaaccagcccggcaataattcgatttcgttcagggaagtggtttcgaaacccctttgttcccgacggatactctgaaattaataaatgattgcgccctatctgagcctgtaaatatttattagcggctggataagcaatatctaggccggttccaatgaccgcaattgtcttcccctgattagcaattgcacattgatgtgcccaggtatcaacccccttagctaaaccggacacaattgtcattctatgggaaatttcgccaggaatcaacttttttaatatttccaatgaatattcagatgcatcacgggcaccgacaattcctaataattgacccgtagccagacttaaattgccacgataaaacatgatgattggcggagcatatgattcctttagggccgatggatacatcgaatcgcaaagactgacccattgatcattcccgataattttagatactaagttagagctcctcattaattgaatataacttgaggaaaaggtggtgacatttcgtgctttaatttgccccactttgatcagctgttcaaccgctggtgctgaaatttgttttaattgaaattgacttaaccattcataaatccgatacttaccaacaattccaatccctttgcacaaatgtaatcgcaataaaaaatctcttaaaagcatatcatgttctccatccttttaagagtatctacgtaaaatattaagttttattgtaaaaacttttgaacgggcgaaaaacttcgccgatgaataggggttggaccatatttttttaatgcggccagatgttttgcggtaccatatcctgcattatggtggaaatcgtattgtggatatatttttgcatagtcatccattaactgatctcgataaacttttgcaacaacgcttgcagcagagacactgatactcttggcgtcacctttaattagcctgatctgatcaattggaacgttaatttgcatggcatcaacgatgatttcttcaggactgggcgataaagattcaatggcttgtttcattgccattcgagttgcctgataaatattaaactgatcaattttttcattactgacaagcccaatactaacacagagagcctcttttcgaattataggtgctaaacttaatcgcttttccggtgtcagttgcttggagtcgttaacatcaattaagtcaaaatcctttggtaaaattgctgccgccgcaactactggtccagcaagcggtccacgaccaacttcatcaacgcctgcaatgtagtggattcccttatgccataattctcgttcatatttaaaacgatgttcaaaggctgccaggcgtctttgttgagcttggattcgtgttttggctgattgaattgccatctgaacacctttgcgtgaatcgtgtgaaaactttgcgaataaaggatcgttgagtgatcgcgtttctttcaatattttcttgatatcactaattgtcagcttcattgccgtgcctacctcgtttctggaatgtccaaggtatagccgcccaatttaccggcacggatgtcttgaataatccggttggaagctcgttcataatcatcacgcataccgatcttttgagtgattttaagaagtaagtcaacgtcggataagttcatgtcagaatctgataaatgataacgccgttggagttcgtcataatgagtgtctctaaaaaaatttaaaccaaataaagcaatatcatcgctggcaaaaacactctctttgattgcaccggttaacgccagtttgtccgcgatctcttggctttcaaactttggccataaaattcccggcgtatcgagaagttccaactgcttacctgcttttaaccattgttggccctttgtgacccctggccgattaccaacttgagcagcacgtcgattaacaagccggttaagaaccgtggattttccaacattgggaacgccaacgctaattgctcgaattggccgtttcttcatgcctttgtcttgctcgcgttgaagtttatcctttaaaattggcgagataacagataaaacgttgttgatgtcaaagcgtgttttcgcgtcgattgcaattgccggttgatgaagcgtttcaaaatgtcttaaccagatgtttgttagtttgggatcagccaaatcacgcttggttaaaatgattaagcgtggtttttgaccactaattcgcttaatttctggattctgagaagcatatggaatccttgcatcgacaatttcaaagacaatgtcaaccaatgataggttctcttcaaattgtcgaatcgctttagccatatgtcccgggaaccattgaattgtgactgtcatcaaaattcctcctacatgtcttcttgatactgtttccaaacgtcgtcaaaaacaaccatacttggcaaatagcctgcgttttcttctaaatatttagagattgaatcaaattcatctaattgtttaggaaatgattgatcatagaaagcgttatttgcaaattctgcgattggatctgagctccccggatttcgtttggtcattaaaaattgataaaagcttttatgcattaattaacctcctttggcaagatgatatcaaaggcaaattgacccctaccgctcatattgatcgtttttgctcgatagttaacgccttgtggtccattcatatgaacaatgtctagtttgataagtttcttatttggtatcagctgcacccacttaggtaaatgataagctttttttacgttgtataatacaaagctgattggtactgggaatcttcccaacgacattttagttgcgtgaagttcaatgtttccgtttgaaagaaccttaggatcaaaaaataatgaataatcaacattcgttcccaacaatttaacggatccataaacaattccctggtcagctacctcaaaatgatacttagctttctggctgttggcttgaagcttatttaaataataattagaaagttgattaagttgtgctttatttaattccgctgaaattggtgtcgttccattatcgtagggcttgtcaactgactgatcaacattggatgatagtcgaattgcgattagtaagccaagggtccctactatgatcagggtaattaatgacaaaaatgccactttccaaggatttcggctaggccgtgattttctttgaggctgattcatattattactcctttaaccaattcgtatgttttatcatatcgcgatacaacaagtctgtcataatctgataaccggtttcattaggatggaagtgatcggtatttgaaaggtattcgttaggttcggcttttgaattgcttagtaatccttcaattccagcattagctccctgattgttaccatcatgaataacggctctctgccttaaccgttttctagcacttgcggtttgatattggccgtcagacatttttttatcaattgggataaaatacatattcttttggcgatcaatcacttgcttggtaatccgattattgtgagcgatcgcggttccaatgaacgagacttgggggaaataaacataaacaggattgtatataccaaaaacgaacactggcgcagaatgattcaagtaacgaatacttcgaaataatcgggatactcttttttggtatgttacgcaatagctatcaagatggtcttttaagccttgattatttcccaatgaaatatttgcctttagaaactgaattaagtcattaccgccagtggtcaccgtgatcatatctgcctgacgtaaattccgtttaagtcgcttggaagtcacaacccggtgattaatttgattggtagtttctccggaaataccgaaattagcagttgtcattgtcacattagatttttgatgattcacctttttacgaattaaatttacgtagccacctttacccttaggatctccgacgccttgagtaagggaatccccgaccgcggtcaacttgattgtttgagggcgactggccttctgaaaatggttgtatataacaagtacccctaaaatgacaattaccgttccgataagtccaataaaaaacgatcgcagtcgatgcttctttgtgacttttgccaatcttataacgctcctaacaatttaaatttcaagaaaaataacaatttgtccaacgagaaatcaatccaaacgactatttaatttaatcgtttttcacttccaaatggttgttggtcaattaaattaatatcaatgatgacaatgaattaaacgtttattatactacggcgaatcatttctttgaacaactattaaagaaaaaaatggcttttgagtgttaattttaaaagatcatcgcatccatgaaagaagagaccaagacagaattgctcttgtcccggcctcactccttggtttcaaatattataaatcagaaaatgtgaatcagcactaaacgtcacttggagaacattaatgattaaatgcttaatactagctcaatctggatcactataataaattaacgcgaatgcaccctcacccgtatgggttgaaataatgggagatgtgattcgatataacaacggcacatccggaaagtcggttttgagtttttgaaccgtttctttaaggacgcttgtctcagttacgtaagaaataccaatttcttttaacgcaggtgtatttttcatatcattaataatcccgttaaagaactttctcaaggacttatcaccgcgcccctttgaaacgacttttaatttaccgccggttacctgtaagcccaacttaatatttaggaaattagtaattgcaccagcgatcggatgaagtcggccacccttaacgatattatcaagcgtcatcacgcaaagatacaatcgcgtattattgcgaactttggcaatcttgtcaagaatggtagctaagtcagcacccttttgcgctaattttgcggcctcaagaacttgaaagccaagaccacgatcagtactttgactatcaataaccgtaacgtcacttttactaagtgtggctgcttgttctgccgcgtgaactgttccactgatggcttcaagcatatcaatacacagaacctgactaccgtcttttccaagttcgtcaaatgcttcaacaaacttacctactgggggttggctagttttgggtagatccttggaagccaacattttaggaacaaattgttcattattaattgtctcccgttcaacataaaccgttccgtcaatcatgacggttaaaggtacaactgtaatattatattgtttgatttcatcgtctgtgagttgaactgatgaatctgtcacaacctttacatttgccatgtacgccactcgtttctttaataaattaatttgtaaaccaaatcacattataacaaacttgttgactgattcgcaaaattcagaccattagctaaacggtcttttgatagacttcaaaagtatgtggatatttatttttttggtcgacaacgcctataattgattgaatttttgagaatttccggtagtcaattgttggcatcactgtgtcacctttaaaagtatgatgaattttcgttcgatacaaacgatctacttgatttcgcagttgagaaaaaaggttcgcaccgccggttacaaaatagttcttattcggatgctgcttcaccagttgacataattctttaactgaatgaataacgacaacgtcgtccggaaaatcatccttagacgataaaacaatattttctctgcccggaagcgcacgattataactacggaaggttcgtgatcccgacacgattgcatgtcccattgttgtttgtcgaaaatatttcatatcttccggcaaatgccatggtagtttacctgatgatccaatcacgccgttttcatcttcggcccaaataaaagaaatcactgtttgccctcctcttttaaacagcaaccggtgctttgatcgctggatatggatcatagttctttactttaatatcagtcatatcaaaatcagataactgtttcttatctggatttaaccacagctgtggagccggccgcggtgtccgagaaagttgttctttgacctgatcaatatgattagagtagatgtgggcgtctcccaaagtgtggacaaaatcacctacttgcaggccacattccctggcaactaaagaagttagtaacgcgtaacttgcaatgttgaacgggacacccaagaaaatatcgcctgaacgctgatatagttgacaacttaatttaccgtcagcaacgtagaattgaaacattgtgtgacaaggtggcagtgccattgaagggatgtcctcgggattccaagctgaaacgatgagtcttcgagagtctggatgagttttaatcatttcaatgacgttcttgatttgatcaatggtgtcacccgttgatgttttccaagctcgccattgactgccataaacaagcccaagatcaccatagattttggcaaaggcatcatcttctagaacgcgttgacagaatagccgcttttgggtttggtaaatatcgttgaaatctggatctgtttgcgcacgatgcgaaaaattggtcatatctggcccatgatagtcagctgaattaacgaatttttcgaaagcccattcatcccaaatatgatttttatgtttgagcaggaattgaatattggtatctcctcgtaaaaaccatagtaattcactcttaattaaaccgaaaggcactttcttcgtggttagtaacgggaacccttttgataaatcaaacctcatttggtaaccaaaagtacttaatgtcccagtgtgtgtccggtcagctttatgatggccattctttaaaacaaacttttccaaatttaagtaggcgtcttctaacatgacaattctccttttaatgacaattattccgcataatcgctcagatattcccaacgtttcatttttttatcaatttgatgatctaattggtccttttgctcttgaagatcagccagtttgtcatagtcactaccattcgattgcatttgttggctaattgttgacttctgatcctctaacttatcaatgtcgtcttcgatgtgatcatactctaattgttcagcataagtgagctttttcttcttttgatctgaggttgtttccgacttggactgattttgcttttgagtgctctgcctagcgtgattagtatcagtggtttgtttctttttcgcttgctcttttgtggcagccaaataatcagtaaatcgaccccgatgagtttcaatcaccccgttgcctttaaaaatgaggagccgatcagctactttatccaaaaagtatcgatcatgagaaacggtgattacagtgccttggaatttagaaatatagtcttccagaaccgttaatgttgcaatatcaaggtcgttggtgggctcatccaacaataaaacatttggttgttgcatcaataattttaataagtaaagtcggcgtttttcaccaccggaaagtttacgaattaatgttccgtgcataaatctaggaaacaggaattgttcgagaagatcagcgacactgattttttgcccatttttgtcagtaacttgttgcccaatttcactcagataactaatgattcgtttatcttctgggattggttcagttaattgggtatagtaagccattttgacggtttcgccaatcttgataatcccggaatccaagtgtctacggccagcaatcacgtttagcaaactggttttaccagccccattttcaccgctgattccgatccgttcatttggttggactaggatattgaagttcttcaaaatagttttgccggcgattgccaaattagcatccttcatggttagaacttccttacccagacgagtctgccccagtgaaatatcaacatcctgatccatttgaagcgtgttaacatttttctttagttcatcaaatcgattaattcgagcttgttgtttcgtcgaacgagccttggccccggctttcatccaagctaactcagatttgtataattgttgtgttttgtgctgggcatcaacttctccctgaacccgggttgccttttttgcgacgtaatcttgataatttccatcatattgataaagttttccaaatgatagttcccaaatcttattggcaacctgatccaaaaaataacgatcatgagtcacaacaattagtgatcccttataaccagccaaataattttccaaccagtcaatcgagtcaaagtccaaatgattggtcggctcatccaggagaagtagattgggcgattgaattaagacctgtgccaagccgacccggcgtctttgaccacccgaaaggtcggcaatcttttgattgtagtcatcaatcttgagctgggttaaaattgttttgacatcattttgcgcattccaagcatcttcttcgttcattcgcgcctcggccttagtatatcttttaagcgcctgggcatcttctgggtgatcagagtatgctttgagtgccgcttcataatttcgaatgatttggtaaacctgttgggaacctgaaaaaacggcgtccatgatcgacagattttcgtctagttctggatcttgggttaaatagccgattgtataagattttgacgtaataatgttaccagtagagtcatgatctaaaccagaaatggcgtttaggagcgatgtttttccagttccgtttgtcccaattaacccaattcggtcgtgttcatttatcataaaatcaaggtgatcaaagagcgtcttttcgccgtacgtctttgttagtccttctactcgcatagtctccattaatttaccagtcctcatttaataaaattcaaggttgctttaatcagttcttgaggggtatttccaatttgattggaaacgactgcccgctctaagtaatttagcgtttgaccaactgttggtcccggtttgagaatgccgcgcttaattaaatcgccaccagttattttaagctgttttttatttgtgatagtaagattatcatatttttgcaataattcctggctttcagtatgatttggtttgccgagaattgttattgcattgaccacattttgtctgccggcctgatacaacaaccaattatctactcgattagcggcaatcctgaatcggagatcagtagttagtataacatcattgattattttgttggcagtcttccatcgtttgagaaagtgggtaatctgctgacgtgagaaaccaaattgataacagattaatgaccaaacttgagtttcattgactagatcaaacttcgtgtcaacaatttgttgcagttctttaaagtgatcaccaaataccggtacatgttggtaaagcttggtctgcaacatgatgttcaatccgttttcagcatccacgcccaacatcattttgacaaattcagtatggcttcgctcaacagcaatcttttcaagcaactggctgtgtctggcgatgccggctaatgtggcctgttcaattttaaaatcaagctgactggcaaaacgaaccgcccgcatcatcctcaatgcatcttcattaaagcgttcattagggtcccctacggcccgaataatatgctgcttcatgtcagctaaaccgccaaaaagatcggttacttcgccactttcactgagtgcgagcgcattaatggtaaagtcgcgacgctttaagtcctcctttaaagaacggacaaaaaagactttgtcgggtcgacggtaatcctgataaccggattctgttcgaaaagttgtgacctcgtagccattaccgtgatcgagaatcataaccgttccatgttcaattccagtatccactgttcttctgaaaagagatttgacttcactggggtaagcactcgttgcaatatcaacatcatgaatgggtcgatgcaaaatagtgtctcgcaccgaaccgccgacaaaataagcttcataccccgctctctcaatttttcggagaattggtaaagcctctttaaattcattgggaatctttaatattcgcacaatcatcgccatccaattatttattctcactccataattctaacagaattagtgatcattaaaaagaatggcgaaaagattgcaacattggaagtacaattgttatagttagtcgttctaaaaaattgggaggttttgaaatggccaaaaatcaaagtcgttttcaacttggcatttccgttgttgacttattagtcattgcgttaggtgctgcaatttattcatttggaattgtcttttttaatatttataaccatctggcggatggtggtgttactgggatcactctaattttaagggcggtttttcacattgatcctgcttattcaacaattttggtaaatattccattatttgcaatcggctatcgattcttaggcaaaaaagatatgatctacacgctttatggcacaattgtcctttcaatttttctatggatttggcaacgggtaccaattgtaattaatattcagcacgatttattacttgcggcaatcggtgccggcctgtttggcggcttcggttgtgggattgtttaccgctttggcgggacaacgggcggagttgacatcgttgctcgactctttgaacggtttaaaggtgttcagatggggcaaacattattaacaatggacgttattgttttgctgtcgtcactgatctatttagatgttcggcaaatggcctatacgttaatttatgtttggatcttctcactattagttaattttacccagcaaggtgcctatacggctcgtggcattttgattatcagcgatcagtcgcagaccatttctgaagcgattcaggaacaattaagtcgtggcgtgacgttcatcaatgccgagggtggttattcccatgaatccaagcaaattgtttactgcgttgtttctcccagcgagttgcattcgctaaaacaattggttgaaaaaattgataaagcggcttttatttcgattttagacgtaaatgaagcaattggtgagggattctcttacaaacggccgaaaaagtttaagctgttaaagtaaaattttgtcaaactatcaatagtcaaaaattcgtaacctagttaaatatcgaaaaaacacgggattggacaaaatcacttttgtccaatcccgtgttgtgtaatcacgattattatcaagcaaaggtgtgagacatcaaaaggcgatttcctgccatgcaactgaattatcctactattccatctgaagcatatccggataatccaaattaaccgccttttgtctcactctggtgttctgtattgataacgactcagaagcccaaatattcgctaataatcttcattggtttaaatacctgatttttttgattaaatcaatatcttttgttctaataaacaaaagcaggcgtgtcttatagatcctcttcgtataatgaagccatttccatatctccaggaactaaagcgaggtacttttttaagtaatcccgttcttgatcgacctctcctgtttggcgataaaataaagcagcatgttttagaaaatcaggattgtcagctaattcatgattggcgatttcataattttcggcggcttttttaacgttccctgttgcctggtacgacaaggccaggttataggctagatgagcatcaaagacatgatcggccaaaatgggctctaatagctttaaattgtcgctgtgacgctgatgggagacataccaatcagatagtaatgttagtatctccatgtcgtcaggagcgatttcttggccttttttgagatagtgcaacgacaattcatcctctcccgccattaacgcgatttgaccagctttttgccaaattttttcattgaattgatcaattgaaattccttcttgaattaccttcaaggcttcatcaactcgtttttggttaaccagtgaatctgccagatatggatataaagaactatattggggatcactatcacgtaaatcttcaaaggtttcaattgctttttgataattttttaaactaaagtaagtaaacgctaattcaaatttcacatcactgttcatgtgcacgggcttaatctgttccaagtaacctagtgcctgttcaaacttaccgatttctgcgtaagagacacccaaccgttcaaccaagttaaccgaggacatttccagtgttccggatttaatcaaatccagatagttattaattgcttttcgataatggcgcgttgtgaaatagaattccgcaattgcaaattcaataaccggttcgtcaggtgccaaattttgagcttctaagagcttttgttcactaatttcaaatagaccctgtgtctggtataaatcggctgcaaccatcaaagaacggacatattcaggtgattgttgagaaacttgggatagatagttaagtgcttgatcatctttgtcagcatcaatggccaattctgctaaatttatttttaagccatcatcgtttgggtattttttggataattgttgatagattgtttctgaataactagaaaatccgagtgaatataattcttcggctaatgaatacaataaatcatcagaatcgttatttagtgcctgtttaaatgattttttaaaagcatctaattggccgccttcaagttcttccaatgcggtttgtgaataactcatatcatttcctccagagtatataaaaaagccagcccgacaaatgccgttctggcttaacagatgaatactatttaacagcatccttgagcgccttaccaggtttgaaagctggtaccttgcttgctggaatttgaatttcttgacctgtttgtgggttacggcccttacgagcggcacgttgacgtacttcaaagttaccgaaaccaattaattgaactttgtcaccttttgctaaactagcttggattgattcaaatactgcatccacagctgctgtagcatcttttttagtcaagccggttgctgaagcaacgttgcttactaattctgctttatttgccatgagtgtattcacctcccttaaagaataggtatgtaaaacattacaatctggattcaacggaatcagagttgttaaaatgaagcgtttttcgcatcatttcttgttcaaagatagcataagaatcccgtcattgcaatgtttttatccaattttcatggttaaacgactgttttttccaattctttgtgaaattgattaaaaaaacgttactttctgcttcgtttgatgattctgataggggttcccatgaaatcaaaattatcacgaatttgattttccaagaatctaacatacgagaaatgcattaaatccggattattcacaaacacgacaaatgttggtggcccggaaacaacctgagttgcataataaattcgaagtcgtttaccattgaccgtcggggttggatgaatggcaacggcatccataatcacatcattaagagcggaagactggacccgcttttcgtgattgtcgtagactcgtttaattaattccggtagcttttcaattcgttgtttagttacagctgaaacaaagataataggcgaatatgccatatactgaaattcgttacgaattaatgtttcaaagtcctgctgagtatggtttgtcttttttaatgtatcccacttgttaacaacagtgataattgcttttcctgcttcatgggcataccccgccacttttttgtcctgttcgcgaatgccttcctcagcgttcattacaaagaggatgacgtcgctttgatcgattgccttcatggctcgcataactgaatagcgttcagtattttcgtagaccttaccgcgttttcgaattccagcagtgtcaaccattgtaaatttgatgccatcagactcaaagcgagtatcaattgcatcccgtgtggttcctgcaatatccgaaacaatgacccggtcttcgccaagaattgcgttaacaagtgaagacttaccaacgttgggacggccaataatgctaaaacgaatatcatcgttgggcgccttttcatcggttttagggaatttttcaacaactttatcaagtaggtcccctaggcctagtccatgaacgccggaaataggcattggatcaccaaaaccaagtgaataaaagtcataaatgtcttctcggctttcaggattatcaactttattgactgctaaaacaaccggtttatcgcttcgatataaaattttagcgacttgttcgtcgtcatcagtaaccccctctttcccactaacgataaaaacaatcacgtctgcttcgtcaatggcaatttcggcttggtttttaatctgagtactgaatggggcatcactaatctgaattccccctgtatcaatcatggcaaattttgttgaaagccattcgccatgtgaatagattcgatcccgagtaacgccaggtgtatcttcaacaatcgatattcgatcaccggcaattctattaaagattgttgacttaccaacattgggacgaccaataaatgcaacggtaggcagtgccatttaaatccctccttttattaagtttcaagtaaataaattaagaccatttagttaaaaagatcaagcggttctgcttcattccttgaattagaatgatgacccattaaaaaaagaagctgaggcaaaattacttttgtcccggcctcttaatcttattagtttacttcttgtcaggattctttaattcatcaccgacaatatcacctaaagtaaatccagtttcttcctcaggtgcattattatttgaagcatggttattacgtgatggacgatgttcagaacgcttagcaggttgttgttcgtccttaggtgcatccgtcaatgccttaatcgataatgccaaacgttttctgtctggatcaacatctaagactttcaccttaatcacttgaccaacctttaggacatcaccaggtgttgcaatgtgctcgtgagaaatttgtgaaatgtgaactaaaccttcgacaccagggaatacctccacaaaggcaccgaaatcaactaaacgcttaacagttccttcaagtgtactgccggctggtgctttttcttcgataccatcccaaggttcaggaagagtttgtttaattgaaagtgaaattcggttacgatcaaaatcaactgataataccttaaccttaaccttttggccaactttcaatacatcagatggtttgtcaactcgctcgtaagcaatttgagaaacatgaactagtccgtccataccaccaaggtcaacaaaggcaccaaaactagttagacgagcaactgttccttcaaccacatcaccttcgtgaagagtttccatgagtttttcacgctcttcagctttttcagcttgaacaattgccttgtgagaaagaattaatcggttttcaactggatcaatttcgataacttttaactcaagttcctgacctttaaactgattaagatcgtcaacatagtgatcagaaatcattgaagcaggaataaagccacgaacacccgcgtcaacaaccaatccacctttaacggcttggctaactttggcagtaatcgtttcgtcattcttagacttttcagctaattcatcccatactttgcgggcttctaatcgacgtgatgaaagtaagaagcttccaccctctttgtcgctaccaattcttgaggtaacaactaatttaagcttgtcgccttgcttgatatcatcaacgttttgtgaagatgcgagttcacgttgtggaacaactccttcaacaccggatccttcaattccaacaattaattgttggttatcatctttagcaagaacttcaccagtgacaacgtcaccaacttttacttcgttaacgctgtttaaagcgttaagtaaatcatttttatcattatttgcattttcactcatcaaacaattcctccttgaaacaactctaatcataattttatcttaaattcactgatattaccagttaattgatcaattagttgttaattaagcttattttttacaacttttgcaatttcagacacgacttcttcaattgaaagcgatgttgtatcaatttcaattgcatctttagctttcgtcaaaggagaaatttttcgatgggagtctttataatctcttgcttcgatttcgagttgtaattcatccaagggtgtgttgattcccttttggatattttctttataccgcctttgagctcgttcttcaacacttgcgactaggaaaattttaacttcagcatccggcaataccgtgctaccgatatctcgaccatccattacaatgccaccattgagtgcgatttgtttttgttgatcactgagttcttttcgaacgtctgcaattgctgccactgccgatacagaattagtgacatcttcctgccgaatttcttgagtaatttcatcaccgtcaataaaaaccctttgcccgtcattgctgggagcaaaagtaatttttgatgattttacaatttttgagatctcatcaacattatccaatgaaacccccgcttggagcgcttttagtgtaattgcacgatacatggcgcccgtatcgcaataaacatagttaaattgtttggcgactaatttagctaccgtgcttttaccagccgaagccggtccgtcgattgctacttgtaatccattttttcgcatgcttacattcctaacctgaaattatttttgggctgaagagggacaaccattgtctttacccaatcctctatttttgattgtgaacacaattaagttaaacccagccgacagtaaatgaatgttaaaagttatctttgggttaatttaaccttgaactgtttccacattgtgcgttgtttaatcgtttatctaatgcgcaatttttcaccgggatggatttgtgaagatgacgtcaagccattcatttccattaattgatccattgttagaccatgattaacagccacccgataaattccctgacctgcgcccaccgttgcatattgatgagttgccgagttactatgacctgacattgtcgaagctgtcgattgatcagctgtctgtttggaagtcgttgttggttgagaccgtgagtctgtccgatggatggtagaatgattccttgattgattggttttaactgacgccgaccggtcatcggtagcctgcttttttaagtggtttgatcttgttacagaagaagcttgcttggtgtgcttactgaaacccttactatctgaattggattttttttttgaacttatttggctggtaacccgaactgaagaatcagcctgctgggaaccgcctttgcccattgcgctttgcttagcaataccgtatatcaaggcaactaaggcaatcataataattaatgcgactagtgtaatggtaactaaattgtgattatggctttgttgtcggagcttaacccgtgataagttgccattttcatcacggtcgccagaaaaagtttggttccacggttcgtcttcctctgtttttttatgttcactgtttgtattcatactaagccccctcctcactacaaatattgacaaatcaattctagcattaattgcaagtcattttctttaattttttaataaaaataatcgatccaaaatggttcgccaatttgagcgacttttcaaatttgtgatcggcgttttttttagatactgatcgttaaaagtttcccaagatcgccaaaaatcataatgatggtcacaacaatattttggattcagagttggacttatttgttcgttaaaatgggacaaaattgatgcgcgacggcaacctgttgtttcaacataggccaacatttcgtttaactcagttaatcgatgttgttgtagcagacggaatgttttctgaattttttcaaatgaataatgctgatcatagtagtatttgattactttaaatgcgtcattaccagtgagcttgtctggatgctgataaaggtattgtaacagctcttcttccggaaaattgttttcaatgagatgagtttgtagataacggtcgtttggctcgtatagcagaatggctaaactaggttgttgatcacgaccacagcggccaatttcctggacataattttgaatactgcttggtagatgatagtgaataacaaaacggatattatccttatcgatccccatcccaaaggcacttgttgcacaaatcacatcaatctcatcattcataaattgctgttgaatacgaaatcggggctgactatccattccgccatgataggccattacccgtttgccagtttggcggttcaatgttaatgcggtttgctcagcttggcttttgcttgaaaagtagatgatccctgcgccatttaacttggaaactaatgactgcaataattgattcttagatttttgattctcgcacatcttggcacttaaaaaaatatttggtcgatcaacggggagaaccactttttgaacatcttggctggcaaaacccaacttagaaaggatatccttttgaatctgttgagttgcagtagccgtcatcatcaaggtcaatgggcggttgagctgctcacggatctggcccaaccgcaaataatccggccggaagtctggtccccattcggaaatacaatgggcctcatcaattacaaaaaggccgacagatagttgccgaaaataagcaattaccttaggattactcagcatttccggagaaacatagataaattgatagtcttgtaaatgagtaagaattgcccagcgctgcttaaaatcaagggttgaggttagtgcaacaacgtgttttgatcctaagtattgcagtctgctaacctggtcctgcattagggaaattagtggggaaacgataacaactcgttggtgggatattgcaccataaagttgatataataatgttttcccacctcctgttggcaaaacggctaaggtatggtggcgagcaattaaattttgaatgacttgctcttgaccaggacgaaactgtctaaatccgaaatatttataaagttcatcaagtagatttaccatttacctgtttcctcctaagaatttggtaaagccgaaattcaaaaaattgcagttgcggtattttgttaactgcatcacgatatgaccattcaccgagtaacgctggttgattgaactctaacttatccataatctgcggattaatcaatcgttggaacggaaattgactgattggtaaaaaaatagcggcttcaattaaatgctcatacacggttgttattttgatccgtcgtttgctggcaataattgctgttgattcttctggatgatgaatgaataaatcataggtctgccgactactattagaaataattggtcgccttaaattggttgtgagtgccgtcaacggttcatttacttttttcttaaaaatttctagtaagagacaactatacaactgccgccaacaaatttgaataactaaaggactaacctgttgctggttgctaatttgttcttctgttttcccggaaaaatgatggccgcttaaactttcaactaaaatggttgctaaatcatcacgatttacccaattcagaaaatctgttagcagttgatgaaaaagttctggtaattgttgccctttattttggataaaccatttttttattaactgatcctcaaaaaaactgatcgattgtggatagtattttcgattactgtagctatattcagagacaatttgggtcgcaaatacaaatcgctgtaagaatcggctgacatcatattgagaagcaatttttagatattttagtggtagtaacttacttaggatttgttggcgcttcatcataccactggtcgttaatttgacgcgcatctgatcatctaatagaagcaatttttgttgctgaagccgatgtaatgtgtgatcaatatcatcaaaattaataccatggagtgaatcaacatagtccaataaattgtattcaagcgcccaatagagatttgagaccgttcgtcgaccaattaggatgtttttgattgctttggctctgcgaaattgttgatcatcacagaatataaaaaacaaatctgctgaattcattttctctcccctaaaaaagaagctgagtcaaaacgatttgttttggtcagcttctgtgttttaaccacacttattatatacgatcttaaggtcatattcttacgaaacaatttgatgattcattttactttaattttaaccgtggtaagaaactacctttgataccataaaagatgccgcctacaacaatccctttaattaagttaaacgggataacaccgtaagtaatcagtaatgcgaggggcatgttcagctttaatccaataactttcatgtacaacgggataacggcagcccaattagataatgacattataacggttaacccaattgtcattgttgcaataactagtagtgccttttttattccctttgtgaatgaaaagagtcgctcgccccagtggaaggtccaaaccaatgtgattgatgacagtaacgctgaactagtaccaatcaaatcaggaattgatgcgccgccaattgtcagccaatgaagtaatgaccgtaatgcggcaataatcatgccaccaactgggccaaaaataacagtcccaattagaattggaatgtcactgagatcaattttcatatatggcacaatcgggatgatcggcacggcgatgaacattaaaacataggagcaccctgccaacaccgacatttcgactaattgagacgttaataattgcttgtgattactacttttttccattgaaaaaacctctccccaatggtcgatcttcaaaaaaggtcctgacatagaacaatgtcaggacatcatagcgtagtaaaaagaattaatcttctacataccagactttactgtcggtactggaatttcaccagttcaacgtgataaatcacggtcgcggactttaccgccggtcgggaattgcaccctgccctgaagataaaccaatttatttagattcaacttaaatatatcagatatttttgcaatgtcaacgctttaccttttctgataattcttttagttcttcaacttcatgcggtttaagccgacgatattcaccaggttgaagacctcttaatgttaaaaagccataagtttcacgactcagcttctcaacgggatgagcaatgctttcaaacatttttttaacctgatgattacgcccttcatgaattgtcaatgaaacaatggagctttcacgatttgttcgaataagattggttttggcttttgaagtcttacgaccatccaccatcacaccggtcctaagccgctttaaatcatcgttggtgacaattcctttgaccttagccacgtatgttttttcaacctcgtactttggatgagtcaattgattatccaagtcaccatcatttgttaggatgagtagtccagatgtatcgtaatccagccgccccactggataaattcgttcaggaacttcttctaaaatatcgacaactgtttttcgatgcttgtcatctgttacggcagtgatcacgccgcgtggtttatacagtaaataataaacaggcggttccttagcgattgggacttcatcaacttttacttcatccgttgagctaactttcgttcccaattctttaactacctgaccatttaccttaacatgaccagctgcaattaacttttcagcttttcgccttgatgcaactcccgcgtgggcaatcactttttgtaatctgtcactcatgaatccacctccatttttccctgatcaatttctttgttaaatctcgttaatagtgcatcactggtattatcatcaagtttttcatctttaggtaattctggcaggtcctttaatgatttaagaccaaaataatcaaggccaaaattagtaatcccatactgtttggggttacccacctcctgtttaacgccagttatttcaagtaaatcttgattaaccaatcggtgtaaaattgctgaactgttaacaccacggatgtcgtcaatttcaacacgagtaattggctgattatacatgacaatcgcaatcgtttccaaggcagcttgcgaaagaactcgtggtttggcatcgttaacgtagtcggcaactaactccgacaaatcgtcttttgtgccaatccgataagtgtcgttgctgtttaaaatacttaagccacaatcagaatcccttttaaatgcgtcagcgattttggcgatgagttgtcgacatgcagccgcctctaaagcagttcgttgggaaagctgttttagcgtaatgccctgatcgccagatgcatataaaagtgattcaattttagctaaattacttagcatggtatgctggcccccttccaatcctgatagttgacttcatatccctttgatcgagtgtcacttcattatattttgccatttcaagaattgccaaaaagtcagtaacaatttcctcgggttcattggcatctttgacaatggttgtaaatgaaagtttagcttgatgataattgagaagcttgcggatttcttcagtctgacttttaatcgtataggtccattcatgaatcgtggttgtcaacggtcgatgataatgaaatcgtttcagagcatccacatagcttgccatcacatcgcccggattgaatggcgatggggtaattagttgttccttagaggctgcaaccgatagctcaggtctcgtaaagcttaatcgtcgactagcttccagaggttttagtttagcggcaaccaacttgtagcgtttgtaattgagtaactgactaaccagttcttgccttgggtcgtcaggcgggtcgtcaggatcatcatcggctatgacgggtaacaacatttttgacttaatgaccattagtttggcggccatcacaaaatagttgccaacaatatcaagattaagctgttgggcatcataaatgtaagccatgtactgttctgtgattttagatatctggatatcataaatgtccattttagattcttgaatgaggtgtaataatacttccagaggcccatcaaagtcatctaaatggagttcaggttgttttaattcagacatgtttttttgattgctcccatttcatccaaattgatttaatatcgaatccggtaatgatttcataacttggataaagcgattgtagttcgtcgaacaattgattgaaattggcttggttatgactttgaggtgtgacaactaattgatgaattaaaagttgtttctcttggagttcaattccaactaaacctgaccagttgtttgaatggtctttccataaataaatcatgcggttatcactgtttgcataccaagccatttcctgagtaaccaagtccatgttttgcaattcagaaaccagggaaaataatcccatcgttattttttcgtagtctttacggtattgatatagcatttaattacctcgattagatgcgccgggatgatacttattgtaaacttcggttaaatgttgatgtgaaatatgggtgtagatttgggttgtcgaaatatcggcgtgaccaagcaactcttgaacaattcgtaggtccgcgccattttccaacaaatgagttgcaaacgaatggcgtaatgtgtgtggtgtaacgtgtcgcttaattccggcaagactaacatatttttttatcatctgccaaattgcctgcctcgtgagttgtcgaccatgagcatttaagaaaacatagtcggtatttgttttgtgatgaagcagtctcactcgagtggtagtcagatattggttaagccaatcaattgcgacatcactgattgggatgatccgctcacgatcccccttaccaattgtttgtaataagttcattggtaggtgcaaatcattgagcttcaggttaaccaattcactaacccgcaatcctgtggcatataacgtttctaaaatggctcggtccctaactcccagcttagtcgtcacgtttggcgttgacaatagtttggtgacttcattaaccgtcaatacatcagggagcccatatgcttttttgggagaatctactttgatcattgggtcagttttaataatcccaaattgcatgaggtattgaaaaaatttacgcaggctggaaacggtccgaatgattgtattacgtgctttgtgttgattttggagaaattccaagtaatttaaaatcaaaaattgatcaacctgagtcagactggattctgatttttcgaagtaagtggttgcttcaacaagatcttggcggtaacttttgatcgtattttcggaaagtcctcgttcaacacgtaaataatgtaaatagttttcgacttcatttaacatttagccgcctacttttttaatgcaatatgccctgattcctgaacgattagttgttcttttaataggtgtccaagcgctcgcttaaaggcccccttgctaattccaaagtaatctttgattgaatccggtgtgctcttgtcactgaactcgagttgcttatcgtcggtgtgttcaagggcagctagaatcattttcgcatcttcaccaatttcctggtacgctcgtgggcgagttgaaatattgattgtcccatcgcgtagcataccaataacccgaccttcgacttcttctcctagtcgtggctcaattaaacgttcatcgggatggagaaaagccaggtgataattttcagttagtaaacgggtgcccgccattttgaggcgataaacccgcgcttttaaattcttatttttaatatcaccggtaattggtcgggcaattgccataaatatttcttcatcggctaaatgtccccagatccggtttttcttatcgacaaccaggctaatcaataatttgtcgccagcttgaggccagagtgctcgtaaggttggtaactcatcaatggaaaccacgacatctttatttggcagtccaatatcgacaaatacacccaggccaaatttttcctttacaacggttgcaaaaccataatgatctctgcggattgctggaatattacgtgtgatttgcattttatgctgttcgttttcataagtaaaccctgtaaagtcggcacccagctgaagcggtttttctatttcagacttatctaattcaaaagtttcgccactgacctggacaaaataacgtttatcattttcgtcgattactttgccagttacaatttgtgcaataatgttattcatattttttctccgttctgaaacatcatggtttcattttacacgctttctggacaaaattcgagttttgacagattggcggcttacagcttcagttattaaaaagtcgaattttcattaataactcatgttgattattaggaaagtcgaaaaaataattgcgtcttatctttgttgtatcaactctatcacaacataaaaacgaggctgaaacaaaataaattttgttccaacctcgttcaagtaaccgttatttaaatgtgataactagattcattatcatctgttaattgttaaattgagcttgatgcgccatggtaaatcacaccacgatgtgaatcaacagtgattaattcaccgtcggaaatcttggttgttgcattttgagcgccaacaacaacaggaattcccattgaaataccaacgacagcagcatgtgaagtcaaaccgccattttcaacaacaacggcacttgccttttcaattgctggtaagtattccttgtcagttgacttagtaaccaaaatactaccttcagttaccttgctcttagcatcagcagcatttttagcaacaactgccttaccaataacagtcttatcaccaacaccttggccttgaaccaactttgaaccaattaattgaattcgcatcaagttagttgtgccgctttcaccaactggaacgccggcggttacgataattaaatcgccttccttagccaagccggtttcaagggctttcttagcagctaattcgaagatttcgtcactgctcttaacttcatcaaccaaaattggatgaacaccccagttaaccatcaaaccgcgacgagtacgttcgtcaaaggttaaagcaaggatatcagcatctggatgatacttagaaatcattcgagctgtgtagcctgaacgagtagcggcaacaattgtgtgaatgcctaattctttagcaacacgggcaactgaatcaccaattgattctgttacatcgctagcatcaaaagttggacgtggtgttccaaattcactgaaggcattttcagccttaacgtcaattcgagccattgtttgaactgactgaactgggtattcaccattagcactttcgcctgaaagcatggttgcatcagtaccatcaaagacagcgttggcaacatcagaagcttcggcacgagttggacgtgggttttcttgcattgaatcaagcatttgagtagcggtgataaccggtttacctaattgattgcatcgcttgatcaaagtcttttgaaccaacggaacattttcagctggaatttcaacacccatgtcaccacgagcaaccattaaaccatcagcaaccttgataatgtcttcaaagttattgataccttcttgtgattcgatcttagggaagatttgaacatggtccatgtgcttttcttcaagtaaggcacgaatatccaaaacatcttggggtttacgaacgaatgatgcagaaatgaagtcgatatcatgatccaaaccaaaacgaatatcatcagaatccttcttggtgataccaggcaaattgattgaaacaccaggtgcgttaacacccttccgtgaaccaagtgtgctatcattttgaaccttgacaactaattctttattggcatcgtcttttttctcaacaacagtgtccaacaaaccatcgtcaaaaagaacatggccgccgacatgaacatcatcataaagtccaggataagttacggcaattttatccttggtaccttcaagactggcatccattgaaattcggaattggtcaccggtatgaaattcaattttaccctctttttcaacagttgttcgaatttctgcccctttggtatcaagcataattccaacagtcttaccagtcttcttttcagcttcgtgaaccttgtttaaacgatccaaatgttctggatggtcaccatgtgaaaagttaaatcggaaaacattagcaccagcttcaattaatttagtaattgtttcgacatcggtactagctggtcccaatgtacttacgatcttagttttcttcataagtaaaatctctccttcggtttttgggcacgccaatttcttaactacaaagatgtaattagatggttgacttccctttagagttcaaccgtattttatcacttttttcaggccatgtcgcccaaattttggctgataatgtgcaattgattgtctggtgtaaatgcaaaagttaggtgtgccgtaaatgaaagcctttaccaagttaaaaagatcgatcaaaaaaattacttataaacaacattattttcaccaaagattgtgattaatttgcttttcatttgatttccctcacgaagccataaatgacgatcgagtttccaagtttttttagtagctgcttcataaacaattactggaattgaaccgtgtgattcatcgcttaattggtctagtttgtgaaagatttggttccgatcatgaccatcgtcaattctgaggtaccacgttgtcggtttttcggaagatctcaatacattatcagcaggctgaattcgattagcaaccaattgaattgcggttgttttctcaaccttgccactgatcaataaaaccatgtctttatgaagccaagactgactgttggaaaacaggttaggaaaaaccgttaccgataattcgccaacttgatcattaccatcgagaaatgccatttgtttacccgtttttgttcgaatgattttaacttttgtaatatacagaaaaatagatacattgaccatcccaactaccaagtcggcggttgtctttgcttttaattgtttggctaaggatgaaaatcgttcggtagggtggccggaaagatacgcacctaagtagtcattctctttttccaatcgttgcatcaatggtaattcgggcatccttggcatcttaggttccaacgccttgaataacgataacgaatgaccactcaattcaactgagctaatgaattcgggagcagcggcaattaattcggatcggttaaatttaaaactatcaagggcacctgaataaattaaagcgtcaatcaactcggtcttgcgatacttactatccagtcggttcaaaaaatcgggaaacgttttataagccccgttagtttgacgttcctgaattaaatcaaccaccatatcatgccggacacttttaattgaaccaaggccaaacataatctgatcattttgataagaaaaagcagccgcactcttattgatatccggtcctaaaattttgacgcccattgcttttgcgtcgattaaatattccttaatttttacaggactattttgaactgaatttaataacgcaacgtgaaattcgccgggatagtatgttttaagataggccaactcgtatgccattttgctataagcaaccgcatgtgatttgttaaaaccataattggcaaatcgttcgatataatcgaatacctgatgactaattttgtcggaatagccgcgctttttagcccctgccaaaaatttggccttcatttggtccatcactttgagtttctttttactcattgcccgtcgcaaaatatcagcttggccaagtgaaaaaccggccatttcggaagcaaccagcatgacttgctcttggtaaacaatcacaccataagttggtttaagaatcgtcgctaaggactcgtctggaaattgaagtttttcgtggccattttttcgtttaatcacttcatcaatattctgcatcggtccaggtcgataaagcgcattaaccaatgcaacgtcatcgaattgttcgggatgtagccgtcttagaacacttcgaataccatttgattcgaattgaaaaataccggtcgtttcgccttgggaaaatagtgtcagtgtctttttatctgcaagtgatacttgagagatattcagtgttttaccagttgatttttttatttcggctaaggcgtcagccaaaatagaaaggtttcgtaatcccaaaaagtcaatctttaacagaccaacggattcaacataatctttggaatactgggtcatgagcaacccctcattaccatcctgaagaggcgccaaatttaccaatgcacgatcacttaaaattaatcccgcggcatgtgttgaataatgacgaggaagaccttcaagcgcaattgcggtttgatataacgcctgattaagtggactatctgcgatcaaatttttcagcttctgggaattatgatacgcatctcttaaggtaacgtgaaatgcactcgggattgccttactccattgatcctgttgggttggatttaagccaaagactctcccgacatcacgaattgattgttttgccgccaaagttccgaaagtaatgatttgagcaactcgggcatgcccatattttttatgaacgtattggattacctcatcacgcttattatccggaatgtccaaatcaatatccggcatctgaattcgttctggatttaaaaatcgttcaaacaatagattatatttaattggatcaacatccgtgataaataaaacgtaagcaaccagtgaaccggctgctgaacctcgacccggtccagtgataatatctgcttgatgagcaaaattaatcacatcccagacaattaagaaataatcatcgaaacccattgaatgaatgaccgataattcacgttttagtcgctcgagatatggttgcggattgttgatttggttagttgacagccgctgctttaaaccgcgattgcacaactgtcggagataagccccggaatcaatgtggtttggggtatcaaattgtggcagcttgggttgttgcttttgaatttggacgtcaacctgccggattaacgtatccacttgcttcagggcgtcattaagatgaatttgttgatattcatgttcaatttgttctcgtggtcgcagccaatacggaccgacctgtttacttagctgagtaatgtctgtcatcttagtggcatcaccaattgcctttaatacctgcattggaaaataatcagtggcattgagatattgaaccggtgcgtcagcaattaaatcaacctgattatcagcagctagtttactacacatatcaacgagattatccgaagcatgataatcgactccgattttgagagcatccaaatccaatttagtgtcttttaagtgcccaatcaagccagaaatttcagctgtccgtccctgtaacatcaagtcatttagctctgcaatcggtggcaaaatgacaaataagtgagataagtaatcattgatatcagataatttaaggtcttgcttggtcattcttaatgttgaaatctgcattaagttttgatagccctgttgatccttggcaattaagacaattggataatctttttcactaattacaattccggggagttgcaacgttaatccaataattggtttgatcgctgctttgacgcaggcatcgtaaaattcaacggcaccatacatgacgttaatgtcagtcagcgccaacgcttgataactgcgcttttttgcttcagcgaccaacagttcaattcgaattggactttgtaataaactgtaagaacttatcacttgaagtggtacgtagcccacaaaaatcccctctttcctaccaaaattatactctaaattattgttcaaaatcatgtttgccgattagtttcttggaatacaaaaagtggtcaaaggcaaactaaatttgtcttcaaccactcttgtaaaaaaatgagatctaattactcttactctttgaatatgaacctttgcttaccaagtaaataccgttaacggcaataaaagccacaattgcagccgtaatgcccacgggtgttccgttaaacgtagtgttttcaagggctgaaccgatataatcgatgatttcaccgaagacaaatgcccataaaacaactacgatatttgcagtaacatatttcatcaaacagccacctcacaatcaatggtattttagcatagatttttgtaaaaatcgagattgaatttatgaagtatggacattatggccatcaaagttagccattctgtggcactaattctggaacaaatgtcaattgatcgttgtccaaattaatatgcacaatactgtgggacttaatttggtcagcaatcatcatttttgccaaaggtgtctcaacaacattggtaacataccgctgcagtggtcgggcaccatattgcggttcatatccattctttgcgatccaacttttagcgtcatcagaaatcgaaatggtgacatcctgtgctttggtccggtttgaaagttgatcaattaatttttggacaattttttcaatattggatctcgacaatggtgtaaaggtaatgacatcgtcaattctgtttaaaaactccggtttgaatgatgcctttaataactgattaacctgctttttggcatcagttgaaatgacgccattttcatccgttccttccaacagaatatccgagcctaaattggacgtcataattaaaatggtgtttttaaaattaatggttcggccctgactgtctgttaatcgaccatcgtccagaacctgaagtagaatgttaaaaacatctggatgggctttttcaatttcgtcaaacaatacaattgtatatggatttcgacgaacagcctctgttaattgaccgccttcttcgtaaccaacgtagccgggagccgctcccactaaacgtgacacggattccttttccatgtattccgacatgtcaattcggaccatatgatcttctgaatcgaataaatcttcggcaagggccttcgctaattctgttttcccaacaccggttgggccaagaaatagaaatgagcctagaggccgactggggtcctgcagacctgctctagaacgaataacggcatctgagacagccgtaacggcggcgtcctggccaattacccgtttatgcagattgtccgctaaatgaagcagctttttgcgttcaccttctaccaatttggttacagggataccggtttcacggctaacaacgctggcgatctcgttagcggtcacagactcactaaccagccaatcagcgtgttgatcatttgtctccagtttttttagatcagtttccaattcgggaatcgtgccatgttgtaagacagctgctttgtttaaatcataattattttcggcttgtttcaaatcgttttttgcttgatccagttgctttttcttgtcactaatcttttttatagaatctttttcctgcttccagcgggcgtttaaggtattaaccctttctttcgtattagccagctcagattgaagttgttttagccgatttttggaagcttcatcggtctcttgtttgagggatgcttcttcaacttccaatcgcattaattgtcggttggattgatccaattcggttgggcttgagttcatctccacccgaatttcagctgaagcctcatctaccaaatcaatggccttatcgggcaaatagcgatcggtaatgtaacgatcagataacttggcagcggctaccagcgcattatcgtgaattcgcacaccgtggtgaatttcaagactctcggccaatcctcgtaaaatcgtaatcgtatcttcaacggttggttcgtgaaccacaacccgctggaagcggcgttcgagagctttgtctttttccatatatttgcgatattcatcaagcgtcgttgcgccaattaaatggagttcaccacgggccaacattggctttagaatatttccggcgtccatactgccctcagcttttccggcaccaacaatgttgtgaatttcatcaataaacatgataatttggccttcagcttttttgacttctttaagaactgattgaagacgttcttcaaactcaccgcggtattttgcccccgcaattaatgaacccatatctagttggaaaattgttttatttttcaaattttcaggaacgtcgttattggcaattcgaatagccaagccttcgacaacggccgttttaccaaccccaggggccccaatcaggaccggattattcttggttttccgcgataatacccggataacatcgagaatctcttcatcccgaccgataatcggccctaatttgttggcacgcgccgccttcactaaatcagtaccgtatttttccaaagcttgatagctgtcttcttgattcttgctggtgactttttgaccaccgcgaattttttcaacaacgttacgaactttttgctcagtaatgtcatgctgctttaaataatcggtaaacttatcgccatgtaatcccattaccgcgattgtaagagtatcaaccgcgataaaactatcgccaaactcattttttaattgttcggcattttgtaatagttcatataagtttgcagacagcgattgtccgtagttgacgttactgccctcaacggttgcaatctgatcaatttcgttatccagttcactgtttagatcatctaaatttaaaccaagatctgaataaatctggcgggctaattctcctggttggaccaagaatttgaaaagatgagcaactgtaatgttttgttgctttcgagtcgtggcaatctgttgtgcttgagaaattgcctgtgtcactgcttctgttaaattatcaggattcatttaaaatatcaccttattattgaatttaatgttgtctaataaaaagcttggaattaaaagctttcacgcccattccaaactgttcaaaacatatattatcaaattttattactaatgagaaataatttgaccttttttgaccaattatttttcagcaaacaacttagcaatttccacaatgacatcagtcgccttttccatggtttgctccgaaacatattcaaatcgaccatgcatattttcaccaccggcaaatatattcggtgttggtaatcccatataagaaatttttgagccgtcggtcccgccacggactgggaaaatatgtggtttaaccccaacatttttcatcgcttgttcagcaactttaacaaccgttggatctttctgaataacttcacccatattgtaatattgatcctttaaagtaacggttacccgagtttcgccaaactcattgttcatctgatcagcaattcccttaaataatcgtttacgggcttcgaaacgttcccgatcatggtcacggataatatagccgagatgagtatggtcaacgcttcccttaaaatcataaacgtggaagaatccttggcggccgtctgttttttctggacgatcaaattccggtaaggcggcgtgaaaatccatccctaattgaatcgcattgaccatgatccctttagcctctgctggatgaacatcagttcctttgatgtcaacttggccatctgcggcgttgaatgtttcgtaattcaaatcacctagtggaccgccatcgaccgtataagcaacatcagcaccaaaatcagcaacatcaaaatggtcagcacccgtcccaatttcctcgtcaggaccaaaagcaattttaatgtcaccatgttcaatttctgggtgattttgtaaatatgtgattgcagcaatgatttcagcaactcctgatttatcatcagaacctaataatgttgtgccgtcagtggtaattaatgtgtccccttgatacttttttagacttggaaaaacagcaggatctaatgtatattcaccggcctgatcaagtttaatgaccgatttaccatcatagttttcaacaatttgtggttcaatattttctgagttgaaatcagccgtgtcaatatgagaaatgaatccgaccgttggagacttccgatcagtattgccgggtaacgtcgcaaaaacgtacgcgcttttttcattcgtatgaacctgatctaatcccatcccggttaaatggtctttcagcatgtttaaaaactttgtttcccgttctgatgatgggatcgtgtcggatttcggatcggaacgggtgttggtctttgcaaactttaaaaaattactaattagttctggatactttgccatttcaaaaactcctttgcttacataaatgtaaatggatccgtattaattttcgattcaacaactgataaatgccaattgttttcagacgaccacttagcaaacattgtagctaatttgggaatacaaatactttcaatgtgatgacccggatcaataaccggcatatcggcggccaacatatcgtgaccggtatgataataaacatcgccggtgacataaacgtcggcaccagcttgttgggccaacttataaaatttgccaccatcaccacctaaaattgccaccttttttattgggcggtttaaatcgttagcaattacgcgtaagcctgaaacgttgaaaacttgtttgcagtaatttgcgaaagtcgataatgtcatttcatccggcaactcacccactcgccccatcgtgtactgatgtttcttgtcctcaagacgaatgatgttgtataaaggtttttccagtgggtgaacgtctgccagtgtctttaaaacgtggtccagatttttttcaggaacttcaaattctaaacgtgaatcttcaatttctcgaggctcaccagcaacaccaatcgttggatcggcaccagatttgggtacataaaagacagtaccgtcaatttcataagtgtagcccgtatattgattttcacttacttcggcaccggcatcaaccaatgacatccgaacggcagttgcatatactttggggacttgaaccgtgagtcgaaaaaccgacccctcgtattcaggaaccaatccgacaatattttttaaatttaaggcggctgccaaccaatcattcatcccgccatctgcagaatctaaattggtgtgagctgcataaactgtgatatggtgagaaataatatttgcgtacatggcattttgaggatcactgagatcgagattatgtgctgggtgaaacatcactggatgatgtgcaaagataaaatcaacatcattcttaatcgcttcctcaacaacttctggtcgaacatccagggtcgtcatgactttatgaatatcttgatttaatgatccaatttgcagaccaattgggtcgtgctgcattgctaacttttttggcgcgaacttttcaaattgattaattagttgactagctttcaccctttatcacctcattgattgtcttaatttccactttaatccgttgaatcttttgaatatctgtatgagaagccttctgcatatttgcaatcacccgttgacgttgaccaatctcttctcgccattttgttttaaaaaccggtgacttttcttttaggagcagtggtccaaacattaattcattaggcgaataggccattttttgcgaagctttaatcgctgtaataatttcgtaagtgtggctatcatcgaccaaaatctgttcggctttaatttggtaaccattaaccattagccatttccgaacaattggctcaccaacattgggttgcaaaataagtttctcgttaccttttaatttttccttaccggattctaaaatgtgggtaattaagtttcctcccattccggcaatcgtgatggctgtaatgttatcaccgggttcaattgcggccaacccatctgctaatcttggttgcaaaaccgagagtaacttttctttttttatttctgaaactgcgtttgataagggtccctttgcaacttcaccaactaccccatacggaatgatcttattttttgcgagataaatcggcaaatatgcgtgatctgagccaatgtccgctagtcgactgcctctttcaacatgttcgctaacggtttctaatcgtttagataagtggttactattcattgataactccttaatatcttgttaataccttcattataaattatccaaacataaaaaaacagcagagtgggagaaaaggtggttaacttccagagtataattggattatccgaatatgcttcgggtggaatagtaagataattccattgtacggcaggaagttgccttttgcctcacatttttgcatgataatagtcgtgattacaaaaatggggctggacaaaattgcttttgtctcagcccctgttaaaatggttattctaaaaagtcttttaattgtttgcttcgtgatggatgacgtaattttcttaaggcttttgcctcaatctgacgaattcgttctcgggtgacaccgaaaactttgccaacttcttcaagtgttcgggtacgaccatcatccaacccaaatcgtaatcgcaaaacattttcttcacgatcagtcaatgtgtcaagaacgctctcgagttgttcctttaatagttcgtaagctgcatgatcagccggtgaagtggcatcctgatcttcaataaaatcaccaagatgtgagtcgtcctcttcaccaattggggtttccaacgaaacaggttcttgagcaattttaagaatctctcgaactttttcagttggcatatccatttcggcaccaatttcctcaggtaatggctcacgacccaaatcttgaagcaattgacgttgaattcgaattaacttattgatggtttcaaccatatgaaccggaattcgaattgttcgagcttggtcagcgatagcacgggtaatcgcctgcctaatccaccatgtggcataggttgaaaacttgaatccctttcgataatcaaacttttcaacagctttcattaatcccatgtttccttcttggattaaatcaagaaactgcatgccacgcccaacatagcgcttagcgatcgaaacaactaaacgaaggttggcttctgccaattcttgtttagcttcttcatcgccggcctcaatccgtttagctaaactaatttcttcgtcagcctttaacaatgaaactcggccaatttccttcaggtacattctcacaggatcattaattttgacaccggttggcgctgaaacatcggaaagttcttttttagtaaccttcttagcagcaccaattgctcggggatcaggatctcccttttcatcaaccacactaattccggagtcctcaatgttctcaagtaattcttccatatctttttgatttaatgaaaacggcttttggatcttctcttcaagctcatcataagtgatatgtccaattggcttgttctgcttaacgatggcatcaaaaaccttcttgtatggtttttgagcttccttggtaattgcttttttactctttgttactcgtactttacctgcttttttgttagccatcaaaatgcctcctgaagttatactttttgcttcattcttttttcctgctcaagtttaacaatttcaattgttaactgacgttgtttatcaacatcaccaattttagcagcctgctttaactcagcgagtttcttttttaatttagtttcaaccggaacgcgacgcatcaaaattgttaaatagttatcaacctcttcatctgtggactgctcgggtagttcaagcatttcaatatctaccaatagactttgcagcgaactctctgtaatcatgttgctaaaagtcgcgacatgataatcagcaaatttgctgaaatagccctctgctaaaaggtacaacatctgaaagggttcatcaacgaaagcgaatccttgaacaccacggacctttatccaaacatcatgattgtgcaacattcgatttaacaattgcatctcggttcgctgaactaatgtcatgtgtttagttggatgttcaacgggaaccgattgatggtatgatgtttgatgttgactaggatgcaccggcaccctttttgtgagaggtgccagttgttgaatcaaaacctgcttgtcaactgaaaactcatcggctaaccgattaagatacaaatcacgtgaaatgcttgaatcaagtccgctaattaatttgattgcttcagtaatatagtgactttgatccacttcggagtctaaattatactgtttttttaaataatttaattcaaattcaattggcgctaatgcatgtttaatgagttcttgaaatgctgggccaccctttttacggatgaattcatcaggatccatcccatcgggaactgtaacaatcttaatgtcgagctttgaagattcaccaaacgcatcaattgcccgtttaattgccttttggcctggagtatcaccgtcgtaacaaataatcacgtgatgggtaattcgcttaatgtcgtatatttgctgttcggttaaactagttcccattgaggcaattccagacttaatccctgcttggaacgctgtaatcacatccataaatccttcaaacaggatagccggctggtcactgcgaatgttcgatcgagcaagatccaaattgaatagaatttttcgcttgttgaaaatttctgtttccggactgttcaaatattttggtaagtcggaatttgtcgttaataaccgacctgaaaaggcaatggtttgaccacttgaagtgcgaattggatacattacgcgatcaataaatcggtcccgtaaattaccttcctgatcttcagaaaataagcctgattttcgcaaaagctgataatcgattttccgctgatcaaaaaatggtttcaacagtcgttggccgggtgcgtagccaagctgatacgtatcgataatttcatcggttacaccacggttgtgcaaataatcaagcgctggttgccccattttagtattcgtcaaaatatgatgataaagtttaactgactgttcgtggagatcgattaattgcttgaccttttcatttgcagcggaattttggctgccaggctcagtatcattaaaataacgatcatcaacatcaatattttcaagttgagcaactcttttaactgattctgggaaggataagttttcaagttccataatgaacttaaagacgtttccaccacggccacaactaaagcagtgaaaaatttgtttttcttctgaaacagaaaaagatggggttcgttcttcatgaaacggacaaaggccaaataaattctttccggattgctttaattgaacaaactgtgaaacaacatcaacaatgttgacttgcgatctgatttgctcaatcacgtcttcagggatcttcaaccatcctcgcctcccatcttcaaaactatttaaatacccgcaaagagtcgcactttgaagtgcgactcttttgctagcgatacatattaaatagtagcatacaatgcaagattaaacaatcaattaccccttaaaacaagcggactcaaatcagggttgacagctggtgaaataatctgttaatgaccgaatagatattatcctttaacaaccaatttatccaaatcaccaattaataagatcattttcgaaataattgttaattgacgaagccgattattttttaaagcatcatccttggccatgatcattgttgcgtcaaaataatcattaattggattttccaatgaagctaagcggtcaaaatcttgttctgcatttagactatcgtagtcattagcagctgcgctaacgaccttgtttaaagctttctctgaatcattttcaaacaaggatggatcaacggttaagtcatcatccttaaatgatcccttctgagaaatccgaagaactcgagttagcgattcaataatggctttaaagttatcatcatctttgtgactttgcaacattttaccactggcaatattaaataaaatattcgtgtgagatccagtagtaactgcatctgaaatatcataccgaatcccaaggtcatcaagatattgtttgatacggtccttgacgaagttgctgacagcgtcaatctgagcggcttgatccaatttaggtgcaacattttcctgattctgtaactgaataatttggtctaatgttgatcccaagtcaaaattccaatttttttcagcaacaattcggacaatcccggttgcttgacgacgcaaggcatacgggtcgtttgagccacttggcaccattccggcagcaaagaatgtcagaatactgtcaagcttatcggcaactgctaaaacagctcccacggctgattgaggcaaatcaccattggcggaaatcggcatataatgttcggcaatcgccttggcaacgacaggtgattcgtgatttaataaggcatatttttcgcccatgatgccttgtagctcagcaaattccccaaccatcccagttactaaatcaaatttgtaaatttgagcggcgcgtttcaggtctttcaactcattatcagaaagaccgattaatttgccaagataacctgaaataacttgaactcgttgcattttttcgtacatcgtcgaaattttgtcatggaaactcacctttttcaaacgttcaacgtaatcagcgatcgttttcttttgatcctcttgatagaagaacatggcatcttccaaacgagcggtgaggactttctcattgccggcaactacgttctgaatatcataatcattaccgtttctaacagaaacaaagtttggcaggagactgccctcttgatcggtaacgtagaagaaacgctggtggtccttcattgatgtaattaagacttcatcgggaattgttaagtatttatcgtcaaaattgccctcaaaagcggttggccactcaaccaagttattaacttcttctaataggtctggatcaagattgattttccagttgtgatcggccgcaattttgttgatctgcttggtaatgatttcttttcgtttggcagcatcagcaattacaaattgctcagtgagtttttcttcgtactcatcagcgttggcaagcgaaacgtcttttcctaagaaacggtgcccggatgtcactcgatcagttgtaacatcaagaattgagaagggaatgacagtgtcattgagtaaagcaactaaccatttgatgggtcggacgtattcgaatgagtaactcccccatttcatcattgtcgggaaagtcattgcggtaataacctttttcattccgggcagaatctcttccacaggtttgccggcaatatgtttttcaacaaagacgtattgggttcccttaacatccttaaacgtaatatcgtcaggtgtcgcgccctgtccacgagaaaaaccaatcgctgcttttgtccagttaccgtcagcgtcctgagcaatctttttggccggacctttaacggattgatcaatatctggttgcttgtcagcaagtcccgtgatatataatgttaatcgccgtggtgtactaaaagttttaattgctttaaacgaaatgcgttgtttttttaagaaatcgctcgcacgctttttgaattgattaatacttggcgttaccacatgagcaggaatttcttccaagccgatttcgagtaagaaattgttagccattacttttcctccttgtcatcttttaatagttcctgacgttttttctcatctttaatcaatgggaaacctcgacgctttctggcggctacaaactctttggcaacccaacgagctaaatatctaattcttgagagatagcctgctcgttcagttaccgaaacggcaccacgggcatcaagtaaattaaaagtgtgactacatttcaaaatatagtcgtatgcaggatgcactaaacgttgctttaataaccgcttggcttcacgctcataatcgttaaagaagttgaagagcatctcctgatcactgacttcgaaactatattttgaatgttcatactctggttctttgaagatgtcaccatatagaacgccatcgccccactccaaatcaaagacggagtttacgttttggatgtatgaggacaatcgttccagtccgtaagtgatttcggaagcaaccggatccatttctaggccacccacaatttggaagtaggtaaattgtgtgatttccattccatccagccaaacttcccaaccaacaccggcacaccccattgatggattttcccaattatcttcaacaaagcgaatatcatgttccagcgggttaatgccaagttccttgagactattcagataaagttcttgaatattttcaggcgacggtttcataatgacttgaaattgatgatgttgataaagacggtttggattctcaccatatcggccatctgctggtcgtctggacggttcaacataagctgcgttccacggctcggggccgattgatcgtaaaaaggtatatgggctcatcgttccggcacctttttcggtatcgtaggcttgcatcaacatgcagccttgagccgcccaatattgctgtaatcgcaaaataatttcttgcactgataatttttcagtcattaatcttcctcctaattttttcacaaaaaaatccctatgtttaatgcgctcactacagtaagccacttaaacatagggacgatcagatcgcggttccaccctacttctggtatcactaccagctcttaattatttagctcaaaaagtgccaaattgattaactgattttgaccagctcacacctacctgatctcgttgtaaaaaccggctaatctatttcttttctcaatgctaaattatttaattcaaaaataatcatagttgacattaaaaagaatgtcaacgtcatgctgttcagattttgaatttccccaactgatcaataaaccgcttgcttttaggcgttacaccaacgctgcggacataaatttgatcaataacctgccgtaatgtcttcttagttgtgtcgttaactttaatatgagtgagcttactaagatcaacaacggagaacaagcgcagataatagattgtccgcgggtctaaatgtaatcgataaggatctttatcccaatggttttggcatagcaaaccgccgtatgtttctgagtaatcaaatggtaagtcacgccgatgacaaattgcacaatcaacccaatttggtgcgacgccgaatggcttaagcagttggatttcaaaaatgttagcaataatctctgcatcaaatccctcgttaatcaagttaagcccaaccaataatttatcataccaggctgggatgggctcaccgtcttgaaatgccagatcaattaacgacataatgtaggttgcataggcattcttggtaatatcctcggccattgcctgaaaatggtcaagccgtttgtcgttaataatgtaagacaaaccgttactttgaatatcaccgccgtaaaggccatacgtgaacggcaggattgccgcacgcattttaaactttggtcgttttgccccccgaaccagaaacatctttttaccgaactcacgggttaaaaatttgactaacaggtcacgttcacggtagtccttggtgtataaaagaatcccgttaaaatcagccctatcgcctgttgccacattcattcctcctcatattggtaaaaaaacagcttggttgcgaattaatcaggattgaagcattgaaattaaaaagcaccaactatttatccttacatctcatcctttttactataaccataggaattcagtaaattggctttatctcgccaacgtggttcaattttgacccataattcaagaaaaactttgtttcccatcatatgctcaatgtctttgcgggcaagcgtgccaatttttttcagcattgagccgccctttccaatcacgattgccttttgaccatctctttcaacaataatcgtggcttggatatgcaggatgtcacgatcgtttttgatgttttcaacataaacggcagttgaatgcggaatttcctgccgcgttaactgcaacactttttctcgaatcaactcagagatcacaaaacgttcaggatgatcagtcacctgatcggcaggataatactgtggaccggtcggcagctctttagtaagcgcatcgatcaactcagggacattgtttccctgcaaagcagagatgggataaacatccttaaactgaagtgcatttttgtattgttcaataattgccataatatcgtcaggtgaaatttcatcgattttattaataagcagataaattggcttgtgaacgtttttcagctgatcaatgataaagttatcgccggcgccgcgacgctctgtcgcattaaccatgaaaagaacggcatcgacctctttaagcgctgaaagtgcagaggccatcataaaatcgccaagcttattttgaggcttgtgaatcccaggtgtatcaataaaaacgatttgagcatccttggtcgtataaacaccctgaattttgtttcgagttgtttgtgctttgtcactcataattgcaattttttggcccacaactcgatttagaaaagttgatttaccaacgtttggtcgaccaacaattgctacaaatcctgatcgataatttggattatccatgatatactccctttattttgatagaaacggggcaaaagtttctgtcccatcttcgttttaatttacgttaactgggtcgccaatttaattggcacacagctcaaccattctaattaatcattcagataattagatccaaaggataccctggcacttacttgaattctggagggtaacatcttggcttccatctcttttatttgaataacatgattaaccttggtataaaaattaatgcgccaataattgcagcaaaagttgccgacagtaaaacaccaccggctgcgatatcttttgctcgctttgccattaaatcaaagtggtggccaacaattaaatcaaccacattttcaataattgaattcaaaacttcagatccaatcactgagaaaaatgccgcaaagagccagagccactcattaattttaatttgaagtacaattcccaaacaaagcacaatggcagcgatgatgagatcaaagcgaaagttgcgttcttctagaaccagccgcttgattccctccaatgcgtgtccaagtgattgaaaaaatgttttattcttatctatttgtcgtttatcttttaagcccatatgcatttaaaatctctttttgcaacggaaacatcacatccgcatcagatttcttcatgtgatcatagccattgagatgcaggaaaccgtgaacaaccaaaaatcccagctcacgttcaaatgagtggcctaagtaatctgcctgttcggcaactttatcgacggaaacaaagatatccccaatgttttcaggaatttcttcttcaagttcttcatccatgagaattggaaaatcatcgtcgccctgatcttcaattgcgaaactaatcacatccgttgcgcgatcgactcctctgtattttttattgatttgatggatttcctggttattgaccaaagtaactgacatttcagtattatcggctaaatgaatgtatgatccagcgaagtttagcacatcgcggattaacttttggtctttttcagaaacacccttatcggttttatcataaatctctaaatccattaattattagtcctcgtttaaattattgtccattatcttcatacgcagtaataatcttggctacaaccggatgtcttaccacatccttggcgctaaaggtaacaaattcgatttgatcgatattttgtaaaattttttgtgcagttaccaaaccactggtggcatgctttggtaaatcaatttgagagatgtcaccattaacgatcatctttgatccaaaacccaatctggttaaaaacatcttcatttgcatgtttgtcgcattttgagcttcatcaagaataacaaatgcattgtctaaagtccgaccacgcatataagccaacggtgcaatttcaatgacaccacgatccattaaacgttcagtgtgttcggcacctagaatcgaatgtaaggcatcgtagattggccgaagatacggatcaactttttctttaaggtctccgggtaaaaagcctaaactttcaccggcttcaactgccggccgagtcaaaacaatcctatcgacagtccccttttttaaagctgcaactgccataacaaccgctaaataagttttaccggttccggcaggtccgatgccaaacgccacatcatgatgttgtattgcctgaacatattgtcgctgtccgaatgttttaacccgaacagccttacctttggcatctttaatcagcacctgattatataggtcttggaaataatcaagggtgccgttttgcgccatattgatggcgctaatgaaatcgctgctattaacactaatgcccttttgaatcagtgctaatgtattttccaaaacatgaatcgtaatttcaaccgaatcattttgaccagtcacacgaagagaattgccaaacacattaatagaaacgccaaggccctcctcgataattgtaatatattcatcttgagcaccaacgatttgcaacaattcatttggatcagatacgataaattcctttgtaatttgttgagtatcagccaaatacttgagctccttttcatttagtaatattaatcagatactatcacaaaatgggtggttgctaaagaaaacagcgacgatcttaacctttcaactgtttttttacaaattggttcacaatattaccatctgccttaccctttaactttggcataacagcacccattacttttccgaaatcagccattgattcagcaccaacttgagaaattgtttcaaccacaatcttttcaacttcgtcattagatagctgttttggcgcgtattcctcggcaatctttaatttggcctgttgatcagtgaccaggtcttgacgattcgctttttgaaactcttcaagagattctttttgctgtttaatttctttcataacaactgtattaatttgatcatcagtcagcttgtgattactactatcaacctcagcgttcattatttgcgatttaaggccgcgaataacgccgagccttactttatccctagctttcatagcatcctttaaatcagactttaattgatcataaacactcatcaaattaaccccttttcaattgataattaaattttaccattaaaaaagatcagagactaataaacattaggctccgacctcttcaaagttattattaataacgacgtttctttttgttattacgcttacgtgctgcttcggactttaacttacgctttacacttggtttttcataaaactcacgtttacgatattcctgcaaagtaccgctttttgaaactgtacgtttgaagcgtcgaagagcatcatcaagagactcgtttttgcgaacgaccgtctttgccatatgaaattccctccctccgagcttaaatgtaactgtctaaaagcactaaaaatgtgcatcctaaaacggttcgaaataaattatacatattaatcgagaatgcgtcaatgatttaagctaaaattgattgaacatgttagaattaattggtaaattctatttgtgaggagcaaatttatatgaaaacgcagaacgtctttatcatttccgactcaagtggggcaaccgctcaaacggttgcccaaacggtggtttctcaatttcctaatttaaaagctgaaatccggcgcttcccatttatccaaactgactcaattttaaagggaattctaaatattgctaaaactaaccatgctatgatttttcatactctggtaagtgtcgatctaagtcagatggtcgaaactttttgcgaaagaaatcatattgctgactttgattgtattcaaacgccaatgaatacattggccaaggttaccggtgagcagccagcccatgttccaggattaattcacgatttaaacgaaaactattttgagcgaatttcggcaattgaatttgcagttgaaaacgatgatggtaaaaacgcaaagggattgttagaagctgacattgtgttgcttggcgtttccagaacttccaagacgccactctccttatatttagcaaatcaaaatcaacgggttgctaacttaccgattggtccaagcctgcacattccagaagaattggccgaagttaataagaatcggatatttggactacttaatacacctgaaaaattaagcaagattagaaaacaacggatgttgtcctatgggttaaacgcggatacaccatattccgatactgataatatcaagaaggaattggcatacgcgaaaaaattatataaaaaaatcggctgtctgacaattaatgttgcgaataaatcgattgaagaaacggcaacgattattttggaaagcttaaatttggatacgacaacctttgaggactaacgtgtctaactgaaaatcaggggaccaattcagatcaagataagtaggcgaaatcttttttcgaaattattgtgtatttccgtttggcaatgaacacgattaaaaattccggtcagacaaaagttgactgtatgaccggaatttgcccgtttatcggcgcttttacgtggtaataattgtgattaaacaaattcagagtgcgataaaagacggttaacttccagattacaattgaatggtttggagatgctccgagtgaaatagtaggataattcggctgtgctctgtaagttgccttttgtctcacttttttcttgataatagtcgtgattataagaaacgggtccctgggacataagtcgctaaaacagttattttttaaaaccccgtcaaatcagtgtttttgtaaactgatttgacggggttttccactttgaaattaagatgccatgcacttttatttatttgtaattcttgtgccaaaaccagaaaatattatcgagaagtgtctcttgttgcccttaaacacattggactaaaatggtcgattggctttcatatcatcaataatgttgggattgaaaacttgtgtccgcagcatggttacttcatacccgtgaggattatagcggacttttttattatctggatcctttaacacaggagtctccataatcttaggcacgcttgcaagctgttgatagtgagcaatatagtttaaagtattgaaaccaattgtccccaaaccgataatttgatgacgatccttatggctcccctgttcattttttgaatcatttaaatgaatgacttttaagcgattgattccaataatgtgatcaaattcgttgagaacaccgtcaaaatcattcctaatattgtatccggcatcgctcgtgtggcacgtgtcaaaagtaacagacagtttttcattatcagtcactttttcaataatttcggccaattgttcgaaattaacacccacttcagttcccttgccggccatagtttcaagggcaatctgtgctttttgatcaggtgtgattacttcatttaaccccttagcaatttgattaatcgccttttgcggaccagctcccacatgggcgccaggatgtaggacaatttgtttcgcaccaattgcctcagcacgtgtaatttcctgctgaagaaattgaacgccaaatgcaaaattttgtggttttaatgtatttcctaaattaataatatatggtgcgtgaacgaccacttcttttaaaccatgatcatgcatataggctttaccactttcggcatttagtttttcaatcggtttacggatcgtattttgtggtgcgcctgtgtaaaccataaaggctgtttcattaaaaccggctgcctcttttgctgatcccagaaacatatctttaccattcatactaacgtgtgaaccgattaataatgattgatcattcatgttatttcccccttaagattaattgactaacttgtttagatgcatcaccattttcccaagcacaaaatttttgattgaatcgttctaaattattggcgaaatcatcaaacttccctgcttggcgatatattttaagataggtatccagttgggattcggtagttgccattggtcccggtaaattatcctgtgtatacgcaaaataaaagccccgtaattcatcacgataatgctgcaaatcatacgggtaaaacaacattggtcgctttaaattagcaaagtcgaacattaccgacgagtagtcagtgatgagtaaatcagtaatcaagtagagctcattaatgtcagtatcagcaagaattctaacccggtcttcaaatccggagatatcaatatgatcctttaccaaatagtgcggacgaataattaaaaacgtatctggggaaacacttttgaaaaacgccaataagttaaatggtagattaaaacgatacacacctttttgtttaaaattatcatcccgccacgttggtgcatacatcacaacatgaccaggaactttccccaatagtttttgtttaattttcttaatggtttcagcatgatcatcggcgtacaaccgatcatttcgtggatagccaatatccaaaaaatgattttgaaatccgaaagctgacttaaaaatatcatgagaatattggttaggtgcaatcagataattccaacgtttagcttcgttgatgaattcctgatggtactgttgggtagtattaccaggtatttcaacagtttcgatatcaactcctagtttttttagcggtgtgccatgccacgtttgaataaatgttgttcgcttattttttcgccaccacttcggcatcctcgaattcatcacccaatagttggctcttgcgatgtattttacccatccaggtgtaaatcgcttaactaacattatattaggaaactgaacatgcaggcgccgatactccgatggtttaacactgaagtaacaactgtttttcatttcaggacgatcacgaattaattgtttataaatcgcaaacggattatcatttatttctttgccattaaaactttcaaataaaattaaattttttttagtccccatacaaataaacccatcgttcatcacgatgagtacgtagcgggcaatcaattttataaaatcaatcgttttatttttcaaaagctcacctcaaaaactaaattaaatcaacaaatcttgaacggaacttataatgtaaatgtgaaccaactagtaagaagaacaggatcattccccaaaagacaatatttaaagttggcttttgccaaaaccaggaagtcgataacatcgaatcccgaaatccagaaacaatgtagaagaatggatttaattgaagaatgtgaacaaatggtgctggaaaagcattcgtttcgaaattgaacaagacaccagacatataaaaaagcattctcattaacgattgaagtaaaatacgataatcacggaccaagactgaaattgttgagttaaaaataccaaaggcaattagccaggcaatcatacagatgaagtaataaatccattgaaaccagtaaattgacgggtgaacgccataaagaaaactaactacaattgaaaaaaccaacatggtccaaaaagcacttaaattactaacaatcttaatcgttggtaaaatgctaaccggaaatttcattttagaaaccataccgacccgttgataaatactttttgatgcatcgagactggctcgattcatgaagaaccaaggtgtaattccaatcaccatccaaggcaggtaatcaattccatgagtcgtacttccatgctttaaaccaatcccaaagactagccaataaataccaatttgaatcaatggataaagatattcccaaaccaatcctagataatgactttgatattcggctttatcttcatattttgaaatccgaaaaataattccaacattttgaaattgctctttaattaatgtataaacttctttcaagttccggcactccttaattaagacttcaagaattttaggtaacgatcaatgactcgatcagttgcatgaccgtcattgtaagtattccagtaatggttgaaatcactaaaattagttgactcagagtgaatgatttgatcacgtaagtcatgtatcgttgtaacgggtttagttggtaaccaatgcataaaattgtcttggataccaggattcttttgataatttttcatatcaaacataaagaaaattagtgatttggcattgggtaacaaagtaaaatcaaaagcaactgatgaataatcggtcaccaatgtatcagtaactgtcaataagtcattggtcgcaagttggtgataaaacttaatccttgagttgccggtctctctcatcaaattttctttttcccttaaaattggatggaatttaacaaccaccattgcatttggatctgctgccaacgcgtccccgatgcctgccggtaatttaaaagcttgattttcccggtatgtaggtgcatataaaatgactcgtcgatttttcagttccggagcggcttgataaattcgctctcgagctgtctgacgccacccagagtcaacgtattgatcagagcgcggatagcccagcaacttaattttatcaaagtcttcacgataacttcgagtaaacacatgacccatagcttttgaagcaacgatatattcgtcaaattgattgtaaacttcctgaaatcgcttctgatcagacttcgaacgatacttggttgttggatcttcccagccaaattttttgatggctccgtttgcatgccaaatttgaacaatcttggtcatttttaaatggataatcccgccaagaaatgcataataattatcacaaaaaattagcctggcacccattatcagtggcacaacatccagaaccaatttaataccatctttaaatggtcgggttctaataccaaaagctgccaaatcagttgctgccgcttcggtatccggatggtataagacaacaaattcaaacgtattaggcaatctttgcgcgagttgtttgatgaaatctacgttattatcaaagctcatcaaataaatcaccttatttttgggtcgccaaatgttgatcagcgaaagaaaatgaatcaaccacagatatataactttcaacttttttcaccgtatttcagtattttgtgaatcacacactgaagtattataacataatcttttcatagattttttttcttaaataatcttaaaaaacaagtcgttatcaagtcacctcaccgtaattaaattaaggtttaggttcatagaatctccctaaaattttaactgaatccgatatgcttgcgaatgcatttggatcagattccagtaacgcttcctcaagttcattcatttcatatcttgaaattactgtaaacaaaattgtcttggcatcatgacgataagccccttctgcattgtgaacaatcgtaatgccacggcgcaaatgattttgaacactatcaataacagtgttggggcgattagtaataatcatgacttgcattcgttgttgcttggtaaatgtcatatccatgacccgggcattcacaatcaaactgaggacggaataaaaggcatatggccagccataagcaaaacctgcagcaatcacgatcaaagcattaaaagccatattgattgtcccaatggatttcccggttcgttgacgaatcacaattcccaagatatcaagtccaccagtcgaaatactattcttcaaagccaatccggttccaaagccatttacggcacctccaaaaatggcacagataattggatcatgtgtcaatggaaccggatgcaataactgaatcataaagctggaaagaaaaacggtaattaccgtaaaaattgtaaattcatgcccaatggcgcgccatgctaagaaaaagagtggaatgttcagtaggaataacccaagcccggtggaaattgtaaaagggaatgcccgtgagctaattgtatttagcagctgggcaaacccggtgacacccgaggaataaatgtgacccggatcccagaaaaaattaacggcaatagagaccaaaataccatatgttaacgacatagaggctttggttaagtatgtatgccgacgcataagttttgaaacgtcatccataaatattttcctttcatttgggtaattacatcattaataatgattactgcctaatgataaccgtaacaagcaaaaatagcacgaaaaaatcctgtaatcaaagtacgatcacaggatttttagcaatcatcaaacctaataggatttaattagtaaggttttgaccactgttttcacttaaattaaagtaaccaatacaatcggcattcacagttaaagtaacaaccccacaataatcatattgtcagaagataatgaccgatcttttttggaacatcacaactgataagactcaaatacgaaataataaatctgaagaattatttcttctcatcttgatcagccacaaagatccccaagtcttggagttgcttgttagcaactggagaaggtgcactagtaagcggttcaacagcttttgaattcttagggaacgcaataacgtctcggatattctcacgatcagctaacagacgaacaaatcggtcaaggccgattgcaagaccaccatgaggcgggaaaccatagtctaaggccgttaagaagtaaccaaattgggcttcggctctttctttagtaaatccaagggctttaaacatccgctcttgcaactttctggtgtgaatacgaatcgagccaccaccaagttcaagtccatttaaaataatgtcataactttgggcatatgctttatgaggatcctcatcgtcattcattaagtaatgaacatcctcttcattaggcattgtgaacggatgatgggcagcaacataacgtttcaaatcaacatcccagtggaataacggccaattaacgatccataggaaagcaaattttgactcgtcaatcatcttttgttcttttgcgatttgaacccgtaagtaagccaatgtatcggccacaattcgactattatcagcagcaaacaaaagtaaatcgccaggtttggcttctgctttgtccaaaatcttttgtcttaagtcagcatctttgaagaatttggcgatggggccgttaaagctatcgtcagtgacttttaaccatgctaatcctttagcaccaaatcgttcaacgtagcttgcaaaggcatctaaatctttacgtgagtatttatcagcaccaccaggaactgcgattgccttaacttggccaccgtttttaactgcattggcaaatactttgaaatcaacatccttcatgattgcagacaggtcttttaactccataccaaagcggacgtcaggttggtcggttccaaacctggccattgactcatcccaatccattcgcttaaatggcagcttaacatctttacccattgcatctttcatgaccttggcaatgaacccctcagtgacatccatgatctcttcttgatcagcaaatgacatttccatgtcaatttgcgtgaattcaggttggcggtcaccacgcaaatcttcatctcggtagcaacgagcaatttgataatacttgtcaaaacctgcccccatcaacatctgtttaaattgctgaggtgattgtggcaatgcgtaaaatgaccctggataaactcgggaaggaactaaataatcacgagcgccttcgggagttgatttggtcaatgttggcgtctcgatatcaataaagccttcgttgtcgaagaaactatgaatagattgaataattcggtttcttaataagatattgtattgcatttcgggacggcgtaaatccaagtatcggtattttaactttaaatcttccgaaacgttaattccgtcttcaatatagaaaggcggtgtttttgagacagctaaaattttagcttcggtgatgtccacctcaaccttaccagtcttcattttaggattaatttcttttggatcacgagcaactaccttaccccgagcttcaacaacatattcgctccgaagcttgtcggcaactgctaaagcatctttgccgtattcctcactaaaaactagttgaagaattccttctcggtcacgtagttcaatgaaaattaagccaccaaggtcacgacgcttttgaacccatccttttaagacaacttcttggccgattaaggtttcgttaactaagccagcatatgtggttcgtttcatctctaatcaatctccttgtcattgaaatatttagtaagtacagtatcaaaatcttgtaaaatttcacttatgggaaccgttacttctttgccactggccatagactttacattggctgttttagcctttaattcactttcaccaattgtgattgtaaattgagcgtttaatttattagctgttttaaactgggctttcggcttacggtcaagatagtcacgatcagcagcaaaaccatccgatcgcaatgattgaacaatttgtaaagtttcaagactggtctgttcaccaatcccaacaacataagcatctagttgatcaagaaccggaaacttaactttttgagcctccattaaaaccattaaacgttccattccaagaccaaatccaatcccaggcatctccggaccacccaactgctcgacgagtccattgtaacggccaccggcacaaatagtcgtatacccttcgccaagggccttagaatcaaccatgatttcaaaaatggtgtgtgtatagtaatcaagtccccgaaccatgtccggatcaattacgtatggaatctttaaagcgtcaagtaagtgcttaacttggtcgaaatgtttctttgaatcttcattcaaataatcgagaatggagggggcaccctttacaatttcttgatcatgcttgtccttgctgtctaagacccgaagtggattcttatgtaatcgaactttggagtcttcactaagttcgtcaaaatgcggatccaaataatcaatcagcgcttgacgataagcagctcgtgaggcttgatcacccagactattgatagtaagcttcaatcctgatagaccaaagtgggataataagtccatccccattgccattacttcaacatccaactcaggttcattactcccgaaagcttcaacaccaatttgatgaaattctcgttgtcgacctgattgaggacgttcgtaacgaaacattgatcccatgtaaaagactttaattggtcgcggatgttcgggtccgtataatttattttcaacaaaagcacgaacaacgcctgcagtgccttctggacgcagactcatgtgacgatcgcctttatccttgaaatcatacatttccttggtcacaatgtcagacgtgtcaccagaggttcttgaaaaaacatcaaaattttcaaacattggtgttcgaatttcttgataacgataatcgttaaataacattcgggcagtctcttcgacataagtccattttttggcctcatctggtaaaatatcagccgttcctttgggtcgttgatatctcatactatttcctcccacttaatttccgaaaaaaaagccccctgtccatcgacaagggtgctttcgcacggtaccaccttaattaatactctaagaataacgctcgcgcgaatagcattcactattaaccattgttagcaaaaagtgtcacttcaaaatatttaccacgttttctcagcatacaaacgttctctgtttttgataaacatccctactgttcttttttcggttgaatatttaactgcctttaagattagttgactattcaacaattgtcaaggacaaattaattaacccaaagtgtccagcaaccattataataaaaatacatatacatattggaatggaagaaaaaacgtgaaaaaaattaaggataacaaaagttgggtaattgcaaccggcattatcatcgtcacatttgccgtcatgcttattgcgctttattcaaactcggtcactgttaaggttaatcaattgaacattcgtagtggaccgtcagtgacatatacggttaaggcgaaagtaaaaagaggtcagcaattacaagttatcagtcgaaaaaatggctggatcaaggtgatttatcgtcatcgaattattggttgggtcgcttcatggctggtaacaaattctaatgttaaagatgtcaccaaattatccgaagccacgattgttttagatcctggccacggtggttctgactcaggcgcattatcaacgactggccaaccggagaaaaaatacacgttggaagtcgccaaacgcgttgcaaagaaattgcgaaaccgaggtgccaaagtgattttgactcgaaagtctgatcaaaccgtttccctatcagcaagacctcagctggcagaatcaagtttggcaaatgcatttatcagctttcactttgattcttcagacattgctaataccgcatccggttatacctgctattattatcgtcacggtgcttcgcaacaacttgccaaaagtattaatgcaaaaatgactaatcttgcattaactgatcgtggcgtggaatttggcaattttcttgtcattcggaataattccgttcccgcaatcttgattgagggtggctatatcaacaccaataaagactttaaattgattagtaaccctaaacatcaaaaccagtttgcaaacgatgtggttgctggattaaaccactattttaaaaacaatcattaaggaggctcttacgttgacaattaatcaagattggttggcacagctgccgcttgatcacgttgaaaaaattaaatcggtctcgggtggtgatattaatgattcttatttacttgagacaaaaacaaatcgttattttatgaaagttcaacctgggcgtggagaaaaattctttgcgcatgaaatcgagggtttaaaccttctgggggccattgctaatacgcctaaaataatcacaagcggtgaggttaatcaagatggctacttaattttaaattggattgatacagggcgcggcagccaatttgaattaggaaaaatggttgccgtcgttcaccaacagcatgttccaagatttggattagatcataatttcactgccggaaaattgcctaagattaatacgcggcaatctgactgggttactttttatattaatcagcgcttaaagccactggtaaatttagccataaaaaatggtcgctggaatgattggcgtcaaacacacttccaatcactctgcgaccaatttgccacatattatacaactcatcaagtcattcccagcttgcttcacggcgatttgtgggctggcaactatatgtttgaaaagaccggtgagccaatgttaatcgatccggatgttttctatggggatcgggaattagatatcgcaatgaccacaattttcggtggatttgatcatgacttctatgaaggatacaacagtgtctacccgcttttaagaggcttaaaccagcgaattggttggtatcagctcaattacttactggcgcatttaaacctctttggcgaatcctatggatcaatggttgatcaaatcttgggaaaatactaggattttgataaccatggaatgagttccaccagcgcgttaatttttatttcaggatttcccgaatcaacaatgatgccgtctggatcgaacaaacaggcagcaatattggcattatgcccagccgcaacgtctagtttgcggtcaccaatcatgattgccttggttcggtcgacatgatttctatctgccaaccaattgatagagtcgggttgtggcttacgcggtaatttttgatttgaggtaacataatcagtaaaatatttttccagatcaaattttttcaataatgttttagcttggttatcccgatgagtgagcaaataattatctccgtgcaattgcttgacgagctcaaacacttttgtaacccccggaaaaggtttggcatcggtcaccatttcaacttgatagcgtcggttcaattttcgcaatgtcgtttcatcaatactgtaaaaagcggaatacttacgaatagctgtgccaacatcatgttgccgcatcgtagtgtaaatatcgtgctcatcaatttcaatttcatcaacatttaaatcaccaagcgctttaatgaaggcttgaaccatcattggatacgtgttaaaaagtgttccgtcaaaatcccaaaataattgatttatcattttttagccccttaaaaaggtcgaacccaaaaagttcgaccttttatttttatttgaacttaattgactccgactccgttaaaatacagatctgtttaatgactacttatcttgtcagttatttattttctgtatccaaaacaatcgtcaccggcccatcattttgcagatcaaccaacatgtcagcaccgaaagtaccagtctggacttctaaatcatcttcgcgaagccgattattaaactgttcataaattttgttagcgtgctcaggctttccggcctgcgtgaaactggggcgatttccttttttagtatcagcatacaatgtgaattgtgaaattgacaaaatggcaccgtcaacggcatgaatatccaaattcatcttatcattttcatcttcaaaaatacgcatcttgctaattttgtgggccaggtagtctacttcagcatcaccatcttcatcacgaaccccaaccaataataaatagcccctctgaatcttaccatgaacctggccatcaattgatacggaggcgcttttaactctttgcaatacaactttcaacttattgactccttacctgaattttctttcaactaggtaaacatcaggaatgatcttgagattattcactaaacgatcaagctgttctaagttcctaacgccaactaacaatgaaatggtggccattttattattatcaacctgcccgtttactgacgaaacagtctttgtaacattattaacggttgtgaggatattagttaacaaaccagcccgattatagccctgaacggaaagcgctgcatcataattagtccgatctcccggatcgtttgcccaggaaacttcgattaaccgttcgccattttgttcggccttggcaatgtttgggcaatcaacgcgatgaactgaaaccccacgccccttggtaatgtagccaacaattggatcgcccggaaccggcgtacaacaatgactaagccgaactaacaggttgtccactccttcaataataatcccattggaagccttttggcgctttttctttttggctgtctcagaggatgtttcagaaatggtttgatgcccctcaagcacttctttttctgcttggtcttggcgttgccgcttttgccgatctcgcaaatcttgtgtcagtcggtttactacgccagtaggctgaagatcgccaaagccgattgctgccagcaaatcttccgcatgttgataatgcatattcacggccgctttttcaagattttcgggtgccatgacatcatgggcatcaaagccggcttcacgaagttttctggtaatgatatttttaccattttcgatatttttggcacggtcttctaatctgaaatactgcttaatcttgttacgggctcttcttgtatgaaccagtggaatccagtcacggcttggtccggctgagcttgttgatgtaataatatcaacaatatcaccatttttaacttgatgatccaacggcacaattttaccgttaactcgagcaccagttgtatgattaccaacttctgtgtgaatcatataggccatatcaagtggtcctgcacccttaggcaattcaaaaacatcgcctttgggagtaaaaacatagacgtggtcaccaaagagctctcccttgacgctatccataaaatcagcagcatcatcagtgtcttcttgaagttcaataatttgtttgaaccaatttagtttattgttatcttgtgacgttttaaccttgcttcgaataccttctttgtaagcccagtgagcagcaataccaaattcagcaacccgatgcatttcttcggttcgaatttgaacttccaagggctttccttcaggtccaataacggtggtatgcaaagattggtacatgttggcttttggcattgcaatataatctttgaaccgtcctggcattggtttccattctgagtgaatggcacccaaaacggcatagcaatctttaattgattgaacaatcacccgaattgccagtaagtcatagatttgactaaactgtttatgcttctcaaccatctttcggtaaacagaataaatatgtttaggacggccataaatttcacttttaatatcaaggtctgaaatggcccgcttaacttcatcaattgcgttttgaatatagtccacccgttggtctcgtcgagaattcattaagtgaacaattcgataatattgttgtgggttgagataccgcagtgaaatatcttccagttcccatttgatcgttccaatacctaaccgatcggcaattggtgcgtagatttcaagagtctctttagcaattcgtcgttgtttgtctggacgcaatgatttaagagttcgcatattatgaagtcgatcggctaatttgacgatcattacccgaatatctttacacattgccagtaacaactttcgatgattttcagccagccgttcctcacttgacttgtatttaattttagagagcttggtaactccatcaacaattaaggcgacatcattaccaaacaattctttaacgtcacttaattcaacaccggtatcttcaacaacatcatgaagaaaccctgctgaaacagtttctggatccatatgaaggtcagctaaaattcctgccacttgaatcggatgagtaatgtatggctctcctgattggcgacgctggtcattatgggcaatctttgcgaattgatatgcccgtttcacttggtcaacatgttctttattcatatattcagaaacttttttgatgacatcatctgacgtccagactttagtccccattttatcaactcttctcactctgtttatcctaaaaggacaataggtttttactctttaatttatttatcgaacccagttaaaggatagctcatttgtaactatcttatcatcattttacttctaattcagcttctcatgttagtgtatcaactcggtcatcattgaaacagcacttaagaagtatagtggtgctgtttctgttcgcataatccgaggacctaaaccaaccgaaataaagccatgattagtcagttgttggatctcttccggagaaatccctccttcaggtccaaaaattcctaccagcgattgatgcgcggtaagctgacttaggctggcaaccaaccgactttgctcaccaacctttgcagactcctcataagcaacaacttttgcgtcaaacggttctgctaacaactgtgccagatcattaaaatagtggacttgaggtatcacgtttctgtgggattgttctgcagcgctgagtgcaacttcatttaaatgatgaatctttttttgatacttttgtccccaattaacgaccgaccaagccataggcatgaaaataatttgattagcgccaagttctgttgccttctgcacaacccattcaggtttgtttttctttgatagaccactaacaattgtgacatcgacagggagctcaacattgacatttaacgcggcttctatctgtgctgttactgaatgattctcaacctcaataagtttagcacgaaagacgtgatggtcgttgccaaccaattcaattcggtcattaattgttgctctcaacacccgtgccaaatgatgactaatatcactcggaaggttaatgatatcttttggtgcgattcgttgatctaaaaaataatgttgcataattaatcttcaccctttggcttttgtgcaataatggcataccaatctttcatattgagaatttcagtaataacaaatccgttttcctgcaatgacaccttaatcgtttcaaacttatccttaataataccagacgtcaggaaataaccgccaggctttaaatttttgaatgcttgagcaacgagcggaatgatgatttctgctaagatatttgcaacaacaatgtcaacttgttcatgaatgccagttaataaattattggcaacaactgtaatatccttagcaacaggattgagtcccatatttttcttggccgaggcaacggcgacgttatcaacatccaatgcttttacctcggttgcacctagcagtttagcggcaatacttaacacaccggaccctgttccaacatctaaaaccgactcgtgacccttcatgatgatctcgagtgcttgcagagaaagctgcgttgttggatgggttccggtaccaaaagccattcccggatctaagcggattattttttcttcaactgattttggcgagtagtcttcccaacttggaacaaccgttaaatatcgggtgacatgaacaggatggtagtacttctcccaagcagttttccagttctcatcagctacatcattaaccgttacctctgcaggcgccggatgaaggccaaaatgtactagtccctgtacctgggttgttatttggacaacctgatcagtaattgattgattatctggataatatgccgaaataattgcacccttactaatatgtgataaatctgccggatccacaatttcaccgtgtgggccatactttcctggtttaagtttggcaaaatctgctgcatcttcaattgacacgccggaagcaccatgttccattaaaatatttgcaactgcttcaacggcttcgctactggtgattactgatacttctgtccactgcatttaaattcctcttcacttttcaagattgataattagaatacaaaaagagcaccctcacttggatgccccatccgttacttgattctgttgtttctctgcttcacgagcgcgaacttttgcttcatgctttaacagatgaccctctaaataacgtaataactcagactcattgtaaaaaatccggggatgtttttgcttgtggagacgcaaatcaatctcattaattcgctgcctgccggtccatttatggctgtatcgaatgattagccgattattcaaatggtcacggccaaatcgaaaaatatagatattatctggagtaagtaaggggcgaatatactcttttttgtagaagtaaccatttttccgtaaatactgttttgttcgacttagaatagtaaacacctcctagttacaaaattttaataatggttttataaatcaaatcgaattaaaaacgaattaatatatataataatggaatgtgagggaaaacgcaaacattttgttaattttaccaacttgatttaaatcatacctttatcctattattgagtaaaggagctgaaaaacatggaactttttcgcgtacgttttatcaacaaaattcgaccagatacaattgagatccgttatcgggcaaccttagaatcccattcaagcgacacaattttcgaagggcatcagctgttccatcgacgttatttaaaatatcaattattaaaaaccggtgaagtagcattacgttcaatcaataatattttttccgcaattccagatgattttgtgttagacaaaattagttttgagcaatctcatgatcgaagcatcctcgaggtcccttcgaagtcatcatttgataagtatgttatcgaacatcattacttaaatcgagtgatctgccatgaaaacaaatcaaaccaacccatcattgatacgaaaattatcactgagctgagaattggttaaatgaacaatgaaacaatttttgttagtttaaacgctcactgaataattatcaagtccccaatctcattttaaagtttattacaagcttttaaagggctgctttttctttgagataacaacaattaatttccttgttatgattatcaaatcatttggaacccgctttggaatgctttatttgacaaatatatgacaattgtcatatggtggaactaagaaatacggaatatatatgatgagaaaaaataaagaaatcattttaaattctagggggaattgatcatgacaaatcaattattttttaatcaatctcaggtagttactcatggacattaaggacaaattacaggcgattgttgatgggaatgacagtgcttaccaaattcagcaatttactggtgttagttcatcaatcattattcggttacgaaaccatttacggtcaattgacaatctttcgcttaaaactgctgagagattgtctgaatactacgattaccgcatggttagtatggaaaaaatggcttttgggcaaaaacagttgccacattttcgccatcgcctgattaatcgacttcagcaactttatgaagtccagcagagaaaagctgagtcctcatcgatgtctgatgaaacagcgctcacggtggtaattgaacaactctttaatgatgttcttagcgacaaagttgaactgggacgattggataaggtataccaggcccaacttaatgacaacaaaaagccgacaaaactaagttaacagttaagtaaattccaagctaatcacttttctagagctgaatcatgttgacttgtaagccattttcatttcaaaatacaattaactaaatacagtaaaaggttacctcttcgaactactcacaaattgagtaaattaaggggtaacctttttgataacttattaaacttttaaaacgtgaattttaagtaggaatatagcaggaattccataactttttgtaagcatgtgaataccaccaacgcttacttaccgcccttttcttcttcatccgtttgcaaaactgccatgaaggcttcctgaggaatatcgactttccccactgctttcattcgcttcttaccgactttttgcttctctaatagtttcatccgacgtgttcgatctccaccatatagcttggcagtaacgtcttttcggtaagctttgatgtttgtacgagcaattatttttgcgccaattgaagcttgaacaggaatttcaaagttttgtcttggaataatattttttaatttaccaacaatgtcacgagatctggtcgcagcgaattgccgatgagaaataaagctcagcgcatcgaccttttcaccgtttagcagaatgtcaattttgaccaaatcactcggtcggtaatcttccatgtcataatccagtgatgcatagccctttgtactagactttaatttatcaaaaaagtcaaaaataatttcagaaagtggcatatggtaaatcacattcactcgatactcatctaagtattccatagtatcaaagattccccgtctgtgttggcaaagctccataactgggccaacatattcattgggtaccataattgttgccttcacatatggttcggaaattgttttaactgaagaaacatcaggcatctccgatggattttcaaccttcttggtagtaccatctgttaatttaacctcataggtaactgaaggtgctgttgtaattaattcgagattaaattctcgttcaagtcgttcttgaaccacgtccatatgaagtaagcccaaaaaaccgcatcgaaagccaaatcccagtgctttggagatttctggttcaaactctaatgccgcatcgtttaacttgagcttttccaatgcttctcgcaggtcatcaaattttgcgttatcagtcggataaagccctgcataaaccattggattcatttcacgataacctggtagtgctttctcagccggatcgttagcgttcgtgaccgtatcacccactcgtgtctgagtaatatctttaatactggccgtaatgtacccaacatcgcctgacattaagtagtcacgcttaactggtttaggtgagttcacacctacttcagtcacttcatattcgctaccactattcatcattcgtatcttgtctccgggctggacagtaccttcgaataagcgaacgcttaaaacaacccctcggtagtcatcataaaccgaatcaaatactaaagctttgagaggaccagtcacgtctccggttggtgccggaattttctgaacaatttgttctagtaattccggtacaccaacccctttcttagcgcttgccaaaacggcgtctgaggcatcaaggccaataacattttcaatttctgaacgaactttttcaggttcagccgatggtaaatcaattttattgataactggcacaatctccaaattatcatccagagctaaataaacgttagcaagagtctgagcttcgaccccttgagcagcatccaccactaaaatagcaccctcacacgctgcaagactccgtgaaacttcatatgaaaagtcaacatgtcctggtgtatcaattaggtgaaattcataatcgtgaccatctttagcatgataagtcaattctacggcattcaatttaatcgtaatgccacgttcacgttccaaatccatgttatcaagaagttggtctttcatatctctcttggcaactgtgtccgtcatctccaaaattcgatcggctagtgtcgatttcccatggtcaatgtgagcaacaatggaaaaattgcgaatatatttttgatgatccttcattttttgtaaatccatgttgatttctcactttcattcgtttgtcattatttaatatccctaacccttctagtctaatgaaatatcgttagtctggcaaggaaaagtgggcattaaacaatctcatacgtcattgattcgataaattcaaatcttaacgaacagtgataaaagttgtgtgccaaactgtcgttgtatgagatatccgtgcctgcaaaattattttttatgattacaaacaatgaggttggaacaaatgataacttgtcccaacctcattgttttttaaggatacaatggttcacaacaatcaaaaatagcttttttaggttcattgtcttaaaaagaaacaatcacttaacgatcacgcccagcactattttttatcaaatgcatcctttactttgtcaaaaaaattactaccacccttgccgccaaggctttcaccactagctttagcaaatgcctcaagagcaattttctgttccttattcagtgttttaggtgttgtcacgttaactgttactcgttcatcaccattgccatttccccttaagtgaggagctcccttgcctttcaaacgaaaactggttccggtttgagtgcctgcaggaatctttaattcaacgtcaccatggactgttttaaccttaatctttcctccaagcgcagctctggcaaaactaatttgttcatcggtatagatggttgacccatcgcgagtaaagtccttgcttggcttgactctaaagataatatacagatcaccgtatgggccaccattaacgccggcttcaccttggccttgaagtctcatttgctgtccatcatcaatgccggcgggaacattgacttcgagttcatgacgctcatcaacacggccacgaccaccacaagttgggcatttttccttaatctctttgcctgttccatgacaaactgggcaagtttgtcgagattgcatccgaccgagtggcgtgtttgtttcagtcacaatgaagccgcgaccaccacatcgagaacaagtgacaggagaagttccaggcttcgcacccgtcccaccacatgttttacactgagcctcgcgattatacttaataacggtctttttaccaaagatagcttccttgaattcaagggtcatttggtattgcaagtcacgaccttgttgaggtgcagaagggtcagcattctgttggcgaccaccaaagaattgactaaaaatatcatcaaatccaaaaccaccgccatcaaaattaccaaaaccaccggcaccaccgccaaatccacctgctcctgcagcaccatcggcggatccatattgatcataatttgcacgcttctgtggatcacttaacgtttcatatgcttcgttaatttccttgaacttggcttctgcatccggcgctttattgatatcgggatgccactttttagacagcctacgataggcatgttttatttcatcgtcactggcgtctttggaaactccgagaattttgtaataatctttacttgccattagaaactcccatcttcattcaattgtttatccatgatagaataccatatttcaacaaaaagccaaagccagctggccttgacttcttgttaagataaatttagtaataatgattatttatctttgttatcatcgtggacttcgtggaagtcaccatcaacggtgccatcgtcgcccttacctttgttagcatcatcagaggagttcggttgaccatttggttggccggctgtcccttgaccatccttaggagcctgttgttgatataacttaacggctaggtcttgaacgattttatttaaatcatctttcttagtcttcatatcatcaacattgttatcttctttggctttcttaagggcgtcacgggcatcttccgccttcttaatttcatcatcggaaacctttcctttgacttctttaagtgtcttgtctgtctggaagatcaattgatcaacttcgttattcaaatcagctgattctttacgttgcttatcagcctcttcattctcctgagcttctttcatcatctttttaatttcatcatctgaaaggccggaagaatctttaatggtaatcttctgctctttaccagttcccttgtctttggcagaaacgttaacaattccgttcttatcaatatcaaaggtaacctcaatttgagggattcctctaggagcagcaggaatgtctgtcaattggaattgacctaaggttttgtcatcggctgccattggtcgttcaccttgaaggacatggatatcaacagcgggttgattatcagcagcagttgaaaagacttgtgacttgctggttggaatcgttgtattacggtcaattaacttagtgaagacaccacccatggtttcaattccaagtgataatggtgtgacatcaagtaaaacaacatctttaacatcaccagtaataacaccaccttgaaccgccgcaccaagtgcaacagcttcgtcaggattgattgaatggttagaatctttgccagtccatgacttaacagcttcctgaacggctgggattcgagttgaaccaccatttaaaataacttgatcaatatctgaggtactcaagttagcatcttttaaggcgttgtcaaatggtatctttgtcttagcaactaagtcatgtgtcaattcattgaattttgcacgagttaaagttgtttgcagatgtagcggaccactttctccagcagaaataaatggtaaactgatttctgattcggttacacctgaaagatccttcttagccttttcagcagcatcctttaaacgttgaagggccatcttatctttagaaagatcaacaccattttctttcttaaaaccatcaaccaaccaatcaattacacgttggtcaaagtcatcaccaccaaggtgagtgtcaccattagttgaaagaacttggaaaacaccgtcgcctaattcaagaatggaaacatcaaatgttccaccacctaaatcgtagactaaaatcttttcatccttatcttgtttatcaagaccatatgccaaagcagcagcagttggttcattaataattcgcttgacatttaaaccagcaattttaccggcatctttagttgcttgacgttgggcatcgttaaaatatgctggaacagtgataacggcatcagtaactttatcacccacgtaatcctcagcaaactccttgatatattgaagaatcattgcggaaatttgttgtggggtatattttttaccatcaacgtcaacggtgtaaccttgttcacccatatgactcttaattgaacgaacagtatttgggttggtaatttcctgacgttttgcaacttcgccaacctgtggcttaccatccttaaatgcaacaaccgatggtgttgttcgtgagccttcagggtttgcgatgatcttgggttcattgccttccaaaacggcaacggctgagttagtagttcctaagtcaataccaataattttattacttgccatagataaataatcctctttttctttaaagatttattttgcaacaacaaccattgctggtcgaagtactcgatccttcaatcgataaccattttgtaaaatctggacaaccgtatcaaccggatgatgatcatcggctgccgcagtttgaacagcttgactgaatttaggatcaaatggtttattcaacgcttcaatgacctcaacgccattatcacttaaggctttggtaaggtgttcataaaccattgaaacaccctttttgagttgcttaccgctatcatcggtaacatcaacggctaatgctcgctgaaggttgtcaacaatcggcaaaatatcatgtgctaattgttggccatcatattttattaaatctgcctgttccttcttggcatgattttgaatatttttcatatcagcttcagctcgaagaaaccgattttccatttggtcatatttcgtttgtaaatcggtaacctgttgttttaatttttttatttcgcttgaacgatgatcagtggccgaatcagcatttgaatcctttttagtcaatttatcatgattcttcaattgatctttagattttgttgatgggtcttcctggggtgtctcatgatccctttttaatgaatcatcctttttttctgccaaacaatcgcctccttgcattaatcattatcatcatcgtaatagccgagcaacttcttggttaattcttcacgaagcgcaccgactatgccaataatttttgaatacggcattctggttggcccaatcacagcaataatgccatggccatactcattcaaatcataagttccagtaataatactataatcctttaacaggtcatttcgtaattcactgccaattcgaacttgaacatcattagaattagtattcataatcttttgaacggtatcttccgtgtctagcaagttatataacggttttagacgatcgatgttttgacgttcggcaaatctcaacagattcagtttgccatcgacatgaattcgatcccggcccgcttcattcaacatttcaccaaatatttttaagaatccctctggtgtttgaatatacttggtcattaacattggaatgtcaaatttcagcttgtcaacaacctgttgcagtggtttgccaactaattctgaattaataatgttaaccatcgtctccaactgctcggacgacacattcattaatctaaagatcttgtcgacaacgtgaccggtatttgtcacaataatagccattacctggcgatcgtctaatttgactaatcgaaatccgccaagttttaatgtatcccctggttccggattaaaggttactgccatatagttcgttaaatcggataatacttttgccgattcctgaataatctcgtcaatccgattaaactcgctgttaaacgaacttttaattaaatcctccgcactatcatccaacggatctggttgaacaaggttatcgacataataacgataaccttcaatagatggaattcgaccagacgagaaatgcgttttagcgattaaaccttttgattcaagtgcagccatgtcatttctgaccgtcgcggaactaacgtgggtcggaaattcagaagctaatgccttggaaccaactggcatccctgttcttgtgtaatcacgaatgattatttgaagaatacttttttgcctatccgttagcacctaaatcacctctttttagcactcaataaagtcgagtgctaaggcacatttataatttaacaaaccaactgttataagtcaaggaattatcgtatattttagcattaatttgtttagagtgctaatggtgctaatttaaaatattggggtgatcattcatatattttcgggtcgtttgattatcctcgtctaactgactgatcaattgctctggcgtttcaaatttaatttcatctcgaatgtaggaaagccactcgactttgacaacctcaccataaatattctgattaaaatcaagcaaattaatctcaacggtcatcggatggccatctgaaaatgtgacattcctaccaatcgatgccatccccaagtattttcgatcagcaatttcgacagttacaacataaatgccaattttaggtaaccattgatactcagaatgttcaacgttagcggtcggatagcctaaaagacgaccgcgttcttcgccatggacaataactccttttgtctgaaatggcctacctaataaacgattaacctgcttgacatcaccggaatccaagccaattcgtatcctagtggaactgacttttttttggtcaatttcaattggtggaacagtgatgactttaaaagcaccattaacaaaggttggcaagttggccatcgtcgcagttcttttatcaccataagtatgatcaaagccagcaacaactgccactgcattaaaccgctcaagaaaatttgtgatgaattcttttggctgctgactttgaaatgcatgggaatagtttactaagaatactttttgaacgccgaatgcgtcaaacaatgccattttgtgatccaacagtgtaatataacgtttttcatgtgctgacatctttttataaaccagtgctggatgatgatcgtaggttaacaccgcaaaagttgcacccagtttcacagcttcatcttttgctcgctgaaaaactgcttggtgtcctctgtgaaaaccatcaaaaaagcccattgcaatgacggttttgtcattaaacttgagcttatcatccaacggataatgaagttttataatttccatatttacaactcaccttttaattaagtaaaaacattttgaatggtcggtattgaccaactttttggtcaaactgatacaaagctttaacgattccctgatagtctaaacgaactataggttgctgttccttgttaatcgattcatccagaaacccaccattggaaacaattttccagcgggtctcatctagagaatagactggataatgacgcaatgcttctgacaatggccgtagaacttcgtctaaagtgtcattttctacggctgtattaacttgagccagcgtcacacattgagataaatcaaacccaccactcttgattcgcgttaaatccgacataacagccggcacaccaaggagctttccaaaatcaactgctaaggttctcacgtaagttccttttgaacacgccacttcaaaataaatcgtttgagtgcgccgctcgttatcaaatatagtcggcttaatctgtttaaaataagtgatatgaatttctcgaggatgacgttcaacactcaatccctttcgggcatattcgtaaagtttgtgaccattcaccttcactgctgagtacattggtgggatctgctgaatatttccggtcaacttagaaagggcatgatcaatctgtgatgcagtgaatggtctttcaataggttgttgattaataacttttccatccaaatcttcggtgtcataggcaatccccagtgtaattgccccacggtatactttcccggaccgcatcatcaaatcactaatcttggtagcttgtccaatgcaaatcggtaaaacaccatcaacattggggtccagcgtaccagtatgccctaccttctttgtgtgtaaaatttttcgcagtttgctaatacaatcatgactagtcatcccacgttccttaaataaagcaattacgccatccatatatcgtttctcctaatcgtttcagtaataaaagtatatcacaaaatccaagcacaacagaaggcggataaatcccagaaatcacgttaactatcaatgatttcagagattagctcaaaagtttttccggttgattaagagcaatgagccaattggaaactttttgttaattcgtacttttgcttaaatgactatgattataaaaaagaccggacaaaatatctgcccggtcttttttatagttcaaggattaattgttatcttgttttaacttgttgattaagcgatcaatcttatcgccgtattgaactgacgtatcgagttcaaacttaatttcaggggtcttgtaaatgcttaatcgtgatcctaattctccacgaatcagaccagatgctttctcaagcccttgggcagttttttgttcgtcctctgtcttatctgagagaatactgtaaaaaatagttgcttgctgtaaatcaccagtaacctctaccccagttaatgtgacaccttgaacccgaggatctctcactcgtttcagcaaaatatcattgacttctcgttgaatttcttgttccaatcggccaacacgataatgagccatagaaacacctcctaatttgatgttttaatggaaaaattagcagttaatgttatttaaccggaacctctttcatgacataggcttcgataacatcgccaaccttaatatcattataatccgtaatcgtcaaaccgagttcaaatccctgcttaacttggttaacatcatccttgaaacgtttcaaactacctaaatcaccagtatatttgacaacgccgtcccgaattagtcgaaccttgctgcccttttcaatataaccatctacaaccattccgccggcaattgtgccaactttagaagccttgtaaatttcacgaacctcaacttgaccggttacttcttccttataggttggtgcaagcatccctttcatcgctgattcaacttcgtcaatcgcattgtaaataacttgatgaagacgaatatcaacatgatcactatccgcttgtgattttgcttgtggggttggtcggacattaaatccaataatgatcgcattgcttgcttcggccaaggcaacatcactttcattaatggcaccaacgccagcatgaataatgttaaccttaacaccctcaacttcaatcttttgaagactgttagacaaagcttcaaccgacccttgaacgtcagctttaattacaatgtctacttccttcatttcgccttctttaagtgagtcaaacaagctatccaaagtcactcgggtagtctttcggcgttcttgaacttgggcttccttagctctttcttcaccaactgcacgagcagtcttttcatcggcgaagacaacgaatcgatcaccggcttctggaacatcatttaatccggtaattgagaccggcattgaaggggttgcttttttcaattcccggccacgttcatttgtcatcgcacgaacacgaccaaaggtatgaccaacaacaattggatcaccgacacgtaacgttccttgttgaacgagtaacgttgccattggtcctttgccttggtcaagtcgggcttcaataacagagccaacagctttttgctctggatcagccttcaattcaagcatctcagcttccaagccaatcatgtccaatagctcgtcaatattcttgccgaatttggcggaaatattaacgaagatagtgtcaccgccccaatcttcaggaattaaaccatattcggttaattgttcggtaacatgttgcggattagcatccggcttatcaattttattgatcgcaacaataattggtgtcttggcggcctttgcgtgattaatggcttcaattgtctgaggcatgacaccatcatctgcagcaacaaccaaaatggtaatatcggtaatgttagcaccacgagctcgcatttcagtgaaggcagcatgtcctggagtgtccaagaaagtaatcactttatcaccatggcgtacttgataagcacccattttctgagtgattccacctgcttcaccttctgtaatatgggaatgacgtaaatgatcaagtaatgttgtcttaccatgatcaacatgtcccataattgtaacaactggaggtcgggaaaccaaatgttcagtattttccatttccttttcaaagatcttatccaaattagataagtcttcatgaactttctcctgagcggagatcccgtaatcgtcagctaaaatttcaattgtgtctttatccaatgactgattttggttgaccatgacgcctaacataaataacttcttaacaatttcagctggttcacgatggagtaactttcctaagtcctgagcattcatgccatcctggtactcaagcacttttggtaatggtcgatctttacgttcaggtgcgccatgatgttcaacttgacgtaatcgctgattcttttgcttacgctgttttttgttacgctttttattagcctttcgtgaaccgccgcctcgattcaaacttccaccaaatctcccactaccagtgttgttacgagaaaaattattggagctgctagtgttacggttactattggaagaaggtcggctttgagtatttgcaggattaggtcgactcgaggtgttcgtggttggccggctattttgtgaactggtgctgttacgccggttatcattcgaagctgaactatgtgcgttgtttggtcgactggcataattgttactccgattagaagcattactcctagaggaattattgtttcgactttgattggaacttgaatgttcgttccggttgcttgaatgcgttgactgattattacgagtcaaactatttgtgcgactgttggtatgaccttcagaacggttatcttgattttgatgctgagtgcgattaacagtccgcgaattattattactatgactgttggtatgaccttgctcatgattacttgactgatggttatttgcactcactcgattatgattgcgttgatctgaatttttagaattatgatgttgagttggttgatgggaattggtgtgttgagtactgttatttccactcttactaaacatctttctaatttgtttttcttgattgtcgtcaaccgttgacatgtgattctttattgacattccggccttatcagctcggtcaacgatttgtttactggagacattaagttctttagctaattcgtaaattcgctttttccccatatcatcactctcccttagtattattggttaattcaaccaatttttttgccataccccgatcagaaattccaacgatcgttcgtttcataccaatcgcattactaagcacttctttagtgtacatgttattaaccgggacatgatagtaatttgacttatctgtaaattttttctttgttgattctccggtatccgatgcaatgaacagaaaatgaactttgctattacgaatttctgaaagtaatttatcttgcccggaaacgattttgcttgcacgccttgcaattcccaaaaaattcaaaattgcttgtttattttccatcttcaaacaactcttttcgagcctgtttatgatctacataagcaatcagttcatcgtagaaattatcttctagtttggttgaaaacaccttttcaaaagtatgctctgacttggcccttttggcaatatcgacattaattgaaatgtaagcaccccgaccggatttcttgcctgtttcatcaatagaaacgttaccgtcagaatcacgaacaattcgcactaattcttttttaggcgccatttcgccagtaacaatatctttacgcattggaatttttctttttttcactaggatcgcctcctaaagtttaattaatgttttgttcgttaaccgttgttgaatctgatggatcatcaacagttgtcttgtcagcatccgtctgagaattatcaggtttgtctgtttgtggatcttcgtctgattgatcatttgtaattggcttatcttgtaactgatcattttcatcaccagtctcatgagtgtcatcactggtctgtttagtggcaaagaacgctttggcttcagtttcagacttaatgtcaattttgaatcctgttaatttagcagctaaccgagcattctgtccttttttaccgatagctaatgaaagttgataatccggaacaattaccgtgcaggcccgatcattatcatcgtcaaagatcacatcgatgacttcagccgggtttaaagcattggcaatatatctggcattatcttcatcccattcgacaatatccatgttttcaccgtgaagttcattaacaattgtctgaactcgctgtcctttggggccgacagcagttccgaccggatcaatatccttactgttagaacgaaccgccactttagcacgatcgccagcctctctggcaattgaaacaatctctacagtgccatcataaatctctggaacctcttgttcaaatagccgtttaagcattccgggtgcagtccgactgacaaacacttgcggtcccttggttgcattttcaacctttgtcacatagactttgattcggtcttgaggacgataaacctcgtttggcatttcatccttagcccccattacagcttcaactttgtccaagttgatataaacaaatctagtatcttgtcgttcaacggttccggtaactaactcatcttcatattttgaatactcatcaaaaacattttcgcgttcagcttctctaactcgttgcatgatgacctgcttagcggtttgggcagcaattcgaccaaagttttttggtgttacttcaaatttaatttcgtcaccaagttcatatcccttattaatttggagggcatcatccagtgaaacctgtaattggtcgtccgttacatcatcaacaaccgttttgacagaataaacgtgcatgtcacctttcttctcgtcaaatacgacttgaacattttgggcctgaccgtagtttcgcttgtaagcagataccaaagcagcttgaagcgcctcgataacgacttctttcttgatgcccttttcttcttctagagctgaaagggcccctaaaagttctttactcattattattgtctcctttaactaaaattggattgccaagcgtgatttagcaaccaaatcacgtggaatagtgacggtatcaggtttcccccatttttcatttttcatgaccagctgatcatcatcaacggattggagtgttccttcaaaggttttattgccatttaaatttttatacagtgatacgtgaatatatgagccaaccgcctgtttgagctcctcttcatttcgcaaaggacgttctgcaccaggggacgatacttctaaaaagtacgcttgtgggattggatcaggatccattgcatccaatttttcacttaattcatcgctcactaaaacacagtcatcaatggtgatgccatcgggtttatcaatgtaaacccttaagtaccaacttttattctctttgacaaattcaacatcaaaaaggtaaaacgaatgttcctttaaaattggtgtgacaacttgtttgaccgtttcaacgacattgctcaaaaataggcctcctaaaaattatccattaaaaagagcgagcatttctgctcactccttacaagttatttagtaaagttagtataccatagatcattaatcatgacaaatggattggtcggtgtctggaccctctttgtggaattgttaaaacatcctcacaatttccattacatcatatcaaataaacttaactggttttcatccggtaatccatctaaaacatgattttctgtcataaaatcaattaatgtttttgaaactttaccacgtttagccaaatcttccttcgaaataaacggtttatcctcgcgagcagctacaatttgcttggcaacgttcaatcccagacccggaacagaattaaatggtgcaatcaatttattaccatcaatcagccattcgctggaatcggattttgccaaatcaaccatttcaaaatcatgacctcgttcaagcatctcatttgcaagttccagaacggttagtagatttttttctttggcagaggcttccatgcctttatcgttaatttgacgcatcgcatttttaaccgcctctttaccacggcacattgaaacaatatcaaagtcgtcagctcgaactgaaaagtatgccgcataataaactaatggaaaatagactttgaaataagcaattctcagcgccattaaaatataagcagccgcatgggctcgtgggaacatgtacttaatctttagacaagattgaatataccagtcaggaatttttgcttttttcatctctgcctgccaatcatcaggaattcctcgaccgtgtcggacactttccataatttgaaatgaaagttctgaatcaagcccccattggatcaaatcggtcatgatgttgtctcgacatccaatcacattagcaattgttgcggtcccgtttttgattaattcgtcggcatttccaagccaaacatcagttccgtgtgacaagccagaaatctgaagcagttccgaataattacttggatgggtttgctctaacatgccacgaacaaaccgagttccaaattccggcacccctaacgttccagttttggattgaatctgatcttctgttactcccaagattttaggactcgaaaagatcgacatcacaccaggatcatccattggaattgatttcggattaataccggacaaatcctgaagcatccgaatcatggttggatcatcatgccccagaatatcgattttcaaaatattatcatgaattgagtggaaatcaaaatgagtggtttgccaagcggcgtcctggtcatcggccggatactgaattggtgtaaagtcataaatatccatatagtcagggacaacaattatgccggcaggatgttggccagttgttcgtttaactccggttgcccctttcgccaaacgatcttcctcggcttggcgataagtctttcctttatctcgttcaaacgccttaacgtagccataggcagttttatcagcaaccgtgccaattgttccggctcgatatacattcttttcaccaaacaaaacttttgtgtaattatgggcaatcggttgataatcacctgaaaaattaagatcaatatcaggcactttatttcctgtaaagcctagaaaagtttcaaaaggaatattatggccatcgccaatcatttgtgtgccacattctggacacttttttcgtggcaagtcataacctgaactatactcaccctttgtaaagaattcagtgtgctgacagtgaggacaacggtagtgaggaggcaatggattaacttctgtgatcccagttaaagtggcaaccaagctggagccaacagacccccgtgatcctactaagtacccatccttgttacttttagcaaccaatcgctgggcaattaaataaatcacggaaaaaccattaccaatgatacttttcaactcagtttttagacggtcatcaacaatctttggaagcggatctccataccatgcatgagcagtattcattgtgcgagtccgaatttcatcttcagctcccgccattctcggtgtataaagtttatcctttaatggatgaacatcctcaatctcatcagcaatcttattggtatttgtcacaacaattttttttgctttttcttcacctaggaaagaaaagtcatccaacatttcattggttgtcaagaaatgaagatccgggagttcttgccgatttagtggattagcaccaccttgtgagttaattaaaatcttacgataaatatagtcctcagggttaagaaagtgaacatcaccagttgcaacaaccggtttatccatttcatccccaagcttaaccatattggataatatctcttcaagattattctcgtcagcaatcaatccctgctcaattagcggtgcataagctcgcttaggctgaacttccaagtagtcataaaaatcagctttcttccgagcttcatcaattcctttttgggtcattgcggtaaagacttccccagaagcacatgctgacccaacgataatgccatctcgatatttctccaactggctccgtggcacccgtggcactctgaagaaataatgaacattggacaaggacacaatcttgaacatgttttttaggcccgcttgagtcttcgccagcaaaattgcgtgcgatggccgtgcgtgcttgtatgcatcattttcggtcatgtgatggttcaattcatcaagataaacaacaccataacgatcctcggcatcttttaagaatatgtgatttaaatgtccagttgcttcagcatcataaactgctcgatggtgatgttccaaattgacatcaaacttcttcgaaagtgtatttaaacgatagccacgcatgtggggatacaaaaatcgtgctaaaggtaacgtgtcaataattggattagaaatttccggcatcccgtgacgaacgtaaccagtattcataaaaccaacatcaaatgtgacattatggccaacaatcacagcgtcaccatagaattctcgaaaaagtttaaaaacttcttcttctgatttagacccatgcaccatatcgtcagtaatagaggttaaattagttgttttttcggacaagtgaaaccctggatcaataaactcttcaaactgatcgattacattgttattttgcattttgacagctgaaagttcaataaccttgtcataaattgcagaaagtccagttgtttcaacgtcaaaaacaacgtaagtagcatcctttaagggaatatgtttgtcattataggtaattggaacaccatcatccactagattgatttcaacaccatacaacattttaatatcatttttttgaccggcatgaaacgcatcaggaaaaccttgaacaccagcatgatctgtgattgccaatgctttgtggccccacttctttgcttgcttggcaaaatcggcaatattattagtggcatccatctgactcattgtcgtgtgcagatgtaattcgactctcttttcatcttcggccgcagtatcttggcgagaaactttcttcacctgattaatatcataagcatttagagttaattcgtgtgaataattgtcttcttgaacactgccgcgaacctttacccagtcaccttcattgatcccttcaaataaagcttcttcgcctttattggaaaatttttttacctgaattgaagatgtgtagtcagttatttttaacatcaataactgacggccggatctcagtgatcgaacttctttattaaaaacgtatccagaaacgacgactgaacgttcttcctcggtaatatcctgcatcttcatagttggcaaatcatctttgatctttcgcccaatcatacttttaccattacttgatctttttgcccgagattggttattttgctgaattgcctgttttgccttcttaaccagaaccgcattatctgcttcttttttcttttgtaaggccttgatattttcctgagatgaactttcatccacaatcgtatgaatggtaaagtccggaaagccggctcgctgatacatctcctcaattggaccaagtgccgtatttgttagaaagttttttacaatatcattttccgctataaactcaattcgggaatcaacaattgaagggtatcggtcttcacacaattcttgaataagaggtgatgttacgccactatttaccactacccattgccaatattgacgaagtaattgttcatcaaaatggttattttcaggtgtaatattcaatgaaacttttgcaatttcttgaaacgcagatttaagtcgtgcgttaaagtcattgaaaatttcaaatggtaaaattctcggcatcacaatatcaaactgccaacgttgacttttttcatgaacctctagtttctggattttggcatcttgaaaatagggtttatcttttgcttctgtccatcgaatttgttctaatagtttttcaaacaattcattttgatccagactcacagcaaatcctccttaatctaacaaagagcatcatacaactactgaaattaagtaacataataaagggaccgcttcaaaacgtcagttttggcacagtccctttatctaaccgtgacgataatatacgttaatagtagtgagtaatcctactcttcgtcaagatttttcaacaaaatttttatcgtttcgcttaattcttctactttgctttctactgtttcaccattttttcggagtttaatttcaacaattccttcatccgcttttttaccaatcgtaattctcagcgggattcccattaaatcagagtcggcaaatttaactccgggtcgttccttacgatcgtcaactaagacctccaaaccggcgctggttagttgagattcaatctggtttgctaaatccatttggacctgttttttaacgttaatcgggatgacatgaaccgcgtatggtgcaaccgaaactggccaaaccaatccgttctcatcagcattttgttccgaaatagctgagagtaaccgactaattccaatcccatatgatcccataataactggaacagtgcgaccgttttcatctaatacagttgcgttcagagattttgaatagcgagttcctaatttaaagatgtgggcaatttcaattcctcgggtgaacttcaactttcccttaccatcgggtgaaacttcaccttctttgaccacaataaaatcatcaacttgatcgattcgaaaatcgcgtccaggattagcattgatgtaatgataaccatcttgatccgcgccaacaactgcatttttcatcccagaaacgtgttgatcagccaaaatttgaacgtcttcgctaaccccaactggtcctaatgaaccaaagtccgcaccaaggtacctcacggcttgatcatcggtggcaaggtcaagaaaatcagcatgtaagtaattctttagtttaacatcgttaacgtcataatcaccacgaactaaaaccaatactggcttttcgtcggcaatatacaacattgatttaatcgttttgttatccgaaacattcaaaaagttggcaacttcttgaattgtcttggcattaggcgttgcaactttttcaagattcttaaccgggtcatcagaaggctcgtcgacattcttggcttttgccatttccaaattagcaaagtaatcactttggtcggagtacacaatggtatcctcaccaacaggggccattgcagaaaattcttttgaatcggaaccacccattgcaccaccatcaccaatgatgactcgatagttaaggccaattcgatcaaaaatccgacgataagctttctccatcgcttgatatgacttatcaagatcctgatcattggttgcgaatgaataggcatctttcataataaattctcgacttctaagtagtccataacgaggccgattttcatcacgatatttattttgaatttgatataaaactagcggcaattgtttatatgatttgattgaatcccgaataagtgccgtaaaggtttcttcatgggttggtcccagaataaaatcagtgtcgtgacggttcttaaatttgaaaagttcgggtccatatgtatcatatcgccctgattctttccataaatcagcaggtaaaatatctggcattagcatttcgtgtgcgtcagtttgagtcatttcttgccgaacgattgtttcaatctttgttaatacccgataggcaagcggcaaatacgcgtacataccagccgaaatctgtcgaatatatccagctcgaactaacattcgatgactcaaagcctcggcacccttaggtgtttccttaagtgttggcacaagaattttagattgcttcatattccgttatttctccttttaaatcaagtttattaattagttagtgaataaaatagcgttcaatatcattccatgtcactaaaatcattaatagcatcaaaaatgcaaatccaactaaggtgacaattgtttcagttcgttgagaaacaggctttcgacgaattgcttcgatgatattcaaaattaatttaccaccatctagtcctggaatcggaaccagattaatgatggctaagtttagcgagagccatcccaagaatcgaaggacaccggcaatacccatgctggccgcttgagaagtcgttgcaaaaatagcaactggtccacctaaatcatttaggctgaaatggccactaatcattgaccaaagtgcccccaataatgttgtccccattgtccaagtttgagtaaagccagacaaaatttttgtcttaaaacttgtatcaagagactgagtaatcccaatcattccaacatttttgccgtttgacttttgggacttgggcgtcattgacagaacttttgactgaccgtcacgattaacgttgacagatatttttttattaggcttggattgaatctggacagataagtcttcccaatttcgtgtcttatggccatcaatcgaagtaatctggtcgccagatttcaggccggcgtttttggctacagagttctgtggcattacgttgattttattggtattggtgaccactccgccctgaacgaaactaagaattgtgaatactaagattgccaaaataaagttattaaaaacacctgcaaaattagtaagcattcgcttacccaatgatgctgattgaaattgtacatcttcaggggcaatttgaagctctgtcccgtcagtttcaataattgtggcatcgtgatcaacgggatatgttttaacttctgattcatcaccgttttcataacctttgatgtaaagtcccttggacaggtcagttccggtaacagttaaagggattccttgaaaaagcgaatgtttattacttgtatttatctttgtcacaacaccttgatcattagtttgcagggtaacgggagtcccgggttgcagttcttcctcaccatcatcaacctcgccggccatccgaacataaccgcctaaaggcagcaaacggagtgtaaaagtcgtactaccacgacgataaaagaatactttcggacccattccaactgaaaattcacgaaccataattccagatcgttttgcaactatataatggccaaactcgtgaaagatcaccagaataccaaagacaatgatgaaaacaataattgtagttatcaagtgaaactttcctcctaaattaacctaaatgataccaactaaatgtaacattggcagcacaaacaataaactatcaaatcggtctaagatgccaccgtgaccgggtaaaatcttaccggaatctttgacaccataataacgtttcagagcagactcaattaaatcaccaaattggccagcgattgacaggaagatcgtaatgaaaaacattttggtaattgaatacccggcaatcgggtaaaaataaacaaaggctgtacaaatgattgtcgcggcgattgatccgtaaactgaaccttcccaagttttattcgggctaattctgggagcaagcttatgtttaccaaacaaccgaccaaaaatataagcaccactatccgtacaccacacaataaacagtgcgtataagaggacggtcagtgagtccgcccgagcagcaacaaagtaatgaaatcccattccaatatatagcattcctaaagcgatgactccggcatcatcaaatgaaaaaagatttttgcttagaaccgtcagcaacaggagcattaatacaaataggaaaaaaacaaacatttgctctaccttgcctggtaaaatcgcagtccaagtatcaggtagtatcaaaacactaacccctaaatatgccaaaatggattcggtcgatactaaaatcctttttttcataactaatatttcagatattgccacaattccaagtagcattgcagcaatatcaacccagatatgcccaagaataatgattggtataaaaatgattaacgcaacaattgcggttataacacgttgtttcacgtttatctctcctatttactagtatttaaaccgccaaatcgacgatcacgatgctgatattctttcaacatatccacaaatacctgctcggtgaaatcgggccacagaatatgagtgaaaacaagttcactgtatgcaatctgccacaataagaaatttgaaattcgttcctcaccacttgtccgaatcaacaggtcaggatccgaataatcacccaagaacccagtcatcaaatgttttgaaattaaaggatcatcgatttcatttggcactattttaccatcttttgcttcctgagcaatcttctggacagccattcgaatgtctaatcgactgccatagttcaaggcaaagttcaaaatcatcccagtgcattgactggtatcatcaatcgcatctttgacggccctttgagttgctgggggcaactggtcaattaagcccattactttaacttgaacattattagcgatcaagtctgggacaaaatcattaaaaaatttaacgggaaggctcattaaaaaactaacttcatcagttggccgcttccaattctctgttgaaaaggcataaagtgttaataccttaacaccaagattgcttgctgccttggtaattgttttaactgtttccattcctcgtttatggcctgcaacccgaggtaaatgtcgtttctttgcccagcgcccattcccatccataatgattgcaacatggttggggatccgttcggaatcaagtaattcgccatcaactgattgattcttatttgtgtttttaaacatggcatactcctttaaatcgtgttagggcaaaaataaaggatgagaaattaaactcatcctaaaatgcacttaattattagtcgtttgcaccatccggacgttcaaccatgcgccattctccacgttttgcctctgccaatgtattgaaatacttcaataatttgttggcatctgctggacttttttgacctaagaggttaagccctttgccagttgttacaggttctgacaaatcagtgatctcgttgccattttcgatcttggcatttgaaaatgcaattacccaatcatcctcaactagctgagagacgataaaaaacaaattaaaatcatcagttacgaacgcaggcatcgcatataaatcattctgaaccggttgtagtcggctgccattataatctaacacacccagattatctttggtgacgggcgtatttaacttaaaaagcattttttcaaattcgtcagttcctggtactacggaaatctcatcgttattttgattattattattatctgccattgttgtttccttccctttacccatggacgacttcgttctctttatcagcgacaattttgtcgacactcttaatcgaattgtcagtcaatttttgaacctgatcttctaatctgtggaagtcatcgtcagtaatttcttctttcttattgcttcgtttgagggtatccattgcctcacgacgaacatttctaacagcaactttacttttttcgccggttgctttaacctgcttagcaatttccttgcgtcgatcttccgttaaggcagggattgctaaacgaattgcagttccgtcgttggcaggattgagtcctaaatcagcttcatagatgcccttttcaatattatccaaagcactcttatcatatggtgtaactaaaataacacgtgcctcaggaattgaaattgacgaaatttggttaagaggggtgggcgcaccataataatcaaccataacaccgtttaacaagctagcgttagcttgaccggcccgaattttacctaattcgcgttcaagaacttcttgagccttttgcattttttcttttgtttcatttaagacggtttgtgaatctgccatttttatttctccttcacggttgttccaatactatcgcctgcaacaactttacgaatattacctggtttatttaaattaaagacaaccaatggaatatgattatccattgataaggagctagcggtagaatccatcacttttaatcccttttctaaaatatccatataggttaaagtgtcaaatttaatggcatctttatgtgtccggggatctgctgagtaaatcccgtcaacaccattcttagccattaggattgcatcggcaccaatttcggctgctcttagtgctgcagttgtatcagttgagaaatatggattaccagttccggccgcaaagataacaactcgtcccttctccaggtgtcgaattgcttttcgcctaatgtacggctcagcaatttgtctcatttcgattgacgtttgaacacgtgttggaacacccaatgattcgagattatcctgtaaggccagcccattcattgtcgttccaagcataccaatatagtctgcctgggctcgttccattcccatttcggctccagcctcaccacgccacatgttgccaccgccaacaacgataccaatttgaacaccaagttcaaagatatccttaatttcttgggcgacgttttttattactggtggattgatgccatagccgcgttttccagctaacgcttcaccactcaattttaaaattattcggttgtacttcactttagacatctaagtgcctcccatagttaatcattactattaattttagcatactaaagatgtcaacaacaataaaactgccaatttcaataattcttaggaattaaatgtaaaaaaacagaatccgaaagcaactcactaatctttgctctcaaatcctgccagaaaaactttttagttatttagttgttcacgaacttcatcctcgaagctgtcctgtttcttttcaattccttcgccaacttcataacgaacaaacttaacaattgatccaccctttgaagcaacatatttggcaacagtttggtccggatctttaacaaaatcttggtcttctaagcaaatttctgccaaaaacttgtgaaggcgaccctcgaccatcttctcaacgattttttcaggcttaccctcgttcaaagcttcttgcttgagaacttcacgttcatgagcaagtcgatcagctggaacttcagctttgttcaaatactcaggatttgtggcagcaacgtgcatggcaatgtcttttgcagttgcctcatcagcaccttttaatagtacaagtgaaccaattaaaccaccattgtgtaaatatgacccaaagctttcatcatcgcttttttcaacgatttcaaagcgacgtaatgtaactttttcaccagttacttgggttgtctcgatcaggtcatccttgacagtgcccttatccgtttttaatgccaaagcagcatcaacgtcagctggcttattagcggcgattgcgtcactaacccgcttaaccaatgccttgaatggatcactagtggccacgaaatcggtttctgagttgatttcaacgatcgctgcagtgttaccactaacggcaattgttgctaatccattggcggcaactcgatcactcttcttttcggctttggcaacacctttttcgcgtaaaacatcaattgctttatcgaaatcgccatcagttgcgacaagtgccttcttagcatccatcatgccgacaccagtctttttacgtaattgcattacttgtgatgcggaaatctttgccattttaatggcctccctttttattaataaaaactgactcttcaccaaggccaaattggtctatagcgatagagtcagcctaagtgctactaattattttttagtatcattgtcgccttcaacggcgttcgcaatatcttcgattgaatcttcttttttatctttcttatcagcatctttgccttcaaaagtcttttcgtcaacgtcatcttcaccttgacgaccttcaacaatcgcatcagccattttagaagtaatcaaacgaacggcacgaattgcatcatcgtttgaaggaatgacaacatcaatctgatcaggatcagtattggtatcaaccattgcaacaatcggaatgtttaatttttgagcttcgtgaaccgcaatttgttccttgcgaggatcaacaatgaacataacgtcaggaatctttggcatatcttcaataccgcctaagaatctctcaagtttgtcacgttgcttaattaatagtgatacttccttctttggtaaaatatcaaaagtaccatcagtgcccatcttcttcaaatccttaagacgcttaacccgtgactggatagtttcccagttggttaaagttccgccaagccaacgattattaacatagtattggcctgcccgggttgcttcttcagcaatcgaatcctgagcttgcttcttagtaccaacgaataatacaacggcaccttttgctgcttcatctttcatgaagttataagcaacatcaatcaacttaactgttttttgtaagtcaataatgtaaataccattacgttccgtaaagatgtattgcttcatctttggattccagcgacgcgtttggtgaccgaaatgaactccggcttccaataattgtttcatagaaattacagccatgatatagcctccatatagttttttcctccctaatgatcatctacgtcaagaaccgtaacggcactagttgacatattacattaggtgtgtatttaaaacacctttaaaagtatatctgatattaacttgaagcgcaagcataaacgtccttttgtcattgaattgttacaaaaattgttataattccgtaaagtgtgttaagatactattcgtgacaaggaggaatatgtctatgattaaagccatcgtttttgacgttgacgacacattatatgataaacagccatcgtttgaaaaagtttttagcgatgtttttggtcttaacttaaccgatgatgaaatgaatgacgtttttgcgaattacgttcaacaggaacaattagcaatcgcaaagtccaactcaacctcagatttcgacctgtcaaaacaggaaataaactttcacagcctgcatcacacattcaagaaatttaatttagtcggactcagccaggctaccgccgaacaatttgagcttgcttatgcagccgcatgtcaaaacattcaattgtttgatggcctaacgaccgtgtttaatacacttctttctaagtttaagcttggaattattacaaacggcagcacagacactcaacttgcgaagatcatgaagctaaaattacaccactggtttaccagagatcaaatcattacatctgaagaggccaacgcaaagaagcctgacccgcttattttcacattgatgaatcggaagttcaatcttcgtggcaatgaaatgatgtatgttggcagttcttatttggaggatatggttccggcaaaaaaggctggttggcaaactatttggtacaaccatcagcaaagtccaattaccgatccaaatatcattccggatcaaaccgttaacaatcgagaagaacttaaggatcttttaatggacttggcagctcaagtttaagaaaatgagacttaatcagaataatttaacgaatccaccgtaccatgacaattcaaaaagcctctcaacattttattattaccaaaatgttgagaggctttttatacaagacaaaagttgttgacaatttaaaagatggccaaatccaggaaaagatcatcatagttgaataaaaaattcatttcagttaggtaaggatggccttacaatcacagaaatttctaaatttaaatgctgagtcagctcattttctaaattgctaccgaatttacagctttactagcttatctgatttacccgtttgaattaatgatttattggcatccattgcaaaataaaccatgttacgaacggcacgcttggtataaaaggcaatatgtggcgttaccagaacattttcccgtttcattaagttcttgagccgttcatctggaatcttatcaaaactaccgaaatcagtgttgaagatgccaacctcatcttcataaacatcaagtgcagctccggcaactttaccggaatcaagcgcacgaatcaaagcatcggtatcaactaatgtcccacgggcagggttaagaatatagacaccatctttcattttgctgaaggcatcatcatttaacatatgctcattttccttggtagcgggtgcatgaattgaaagaacgtcagacttggcgtatagctcatctgggctatcaacatagatgccctctttttctaactctggattatgaaaaatatcataagcaatgactttggcgccaaatcccttataaatttgaatcgcagcacgaccaattcgaccagtggcaaacacaccaacagtcatttggtttaattcgtcagcaatatctggagcccaacgaagatcaccattagcttgtttacgatcaaatgtgggtgttcgacgtagtaatcgcattaattcagtaactgtaaactcagcaattgcttgtggggaatatgctggaacgttggttacttgaatgttattacgcttagctgcgtcggcatcaacattgtcaaccccaacgtttcgaagagaaagaaacttaatgccaaagcttcctaatttgtccaaaacagcagcagtataaggcttttgttggtatgttacaacaccatcagcacccttagcttgatcaacagttgattcatcgaggagtttaccggttgattcaacttcaacatcagaattttcctcactccacttgtctaaatatggtttctcatcatcacgaatgccatatgcaataattttcacgaatattacctccctaaattagtaagttcattataacactttcacttgctgattttttaggcttaaaaacgcttacttgaatttaatggattaagattccatgttgagccaaataagcaatcttttgggaccgagagagctgcttaaatgcatactcagcgcttagtgcgtcatgcttactttcaaattctctcttgaacaaaattttaattggtcgatgcgagcgagtgtacttagcgcctctgccactccgatgttttaaaaaccgtttttcaacattggtcgtgaaacccgtatataaactattgtcttcacaaagcaacacatacataaaataattatttgtcttgaccataaagcatcttcttcacttcatcagtatagtgatcgccatcataagtaatcaaatctgccaatactttgagaccatcaggtttcccatcttttattgcttcaattagaaccatgtttgcttccatccctattcgaggcctcacaaaccgcaatttcttgggttcaaaacgattttcacgcaagctgaccattaagtcagttagccgatcgggtcggtaaaccatgaaaagtttggcgttcatttttaataagtcagctgatactttaacgatttcattcaaattagttttaatttcatggcgggcaattgctacatattgatttggatttttgacacttgtctcgtaattaacaaaatatggtggattacaagcaacgatatccacagagtccttttttaaataagcagtggcattttttaaatcatcattaacaacactaatttgcgaacccaaatcatttaacttgatgctccgagtagccatatcggccaatttaggttgaatttcaatcatcgttatatgagctgctgttttttcacttaaaaacaatccaatggcaccattccccgcgcatagatccactacttgacgggttttatgcccatttattctcacaaaatctgccaataacacagcatccaatgaaaatgagaaaacgtggctactctgaataatagaaatatttttactgtataattgatcaattcgctcatcgctgttcagtttaacttgcatgttttaagaacccttcactaagatatgtttggtaaattgacttgttttaagttaagattattctatcagataagaaagaaggaaatgagattgttctattcatttgtccgggtgcttgttcgtggcctggtattcattattaacggcaatgctcattatttgcacaaagatcgattgccaaaaggaaattatattttggttggcccccatcggacctggtttgatccaatttattttgcactggctgccagtcccaaaaaattcagctttatggcgaaacgagaacttttcaaaaatccaatattaaagtggattttagatcatgcaaacgcttttccagttgatcgggaccatcccggaccttctgccattaaaaaacccgttcgaattttacgaaaatcagatttatcactaattctgtttccatcaggaacccgtcattccgaacaattaaagggcggtgcagctttaatttcacaactttccaacgttcctttagttccaaccgtttatcagggacctctctcttttaaacgattatttacacgacaacggattactgttgctttcggtgacccaatctacattgatcgtcatcaaaaattaaatgatgatgcccaaaagcaaatcgaaaaggaaatgcaaagtgccttcgatgcactggattattccgttaatcccgaatttaaatacgtggacgtatcaaagaaaaaataattgactggtactgaattccgaataaaaaggtggctgagacagatttacattgtctcagccaccttaattttgcatgacacactatccaaactacttacgactcgattgattttgcatagagtgcatcatttgattcaatttcttttgggaaggtttttgacccatttgaagcattagttgccgcaattgctcttcgttaaatggcggattctcttttaaatatttttccatgtatttacgagcaccgtaaaagccaccaactaaaccaacaaccaaggccaaaacaacgattaaaatccaaatccaagttgccaagacaaggcctccttatataatctcaattgttaattttacacaattattaggtaaaattaaagggcaatcatgaaacccaaccaatatgtcatcggaatcagactaattaatcatcgcggagtcctttatgacgttgaatttgcttcaccttttttgaagtgacttcttttccgtctttatcgtaaactttgatcatttcaatctgttttttgaaattatcacgaaaacgagaaacatactttttcctgagttccgctcgctcaactttttcaacctcagttaatccttcttttttagctttctgggctaattcgttgattctgggaacaatttctcgtaatacactatcaccgattttactttgtaattcctttttttcttgcttattcatttaataaacctcctgtttatatattataactcatctttccaaaaacatgcgaacgtgtgtttgaaaaagttgttaacttatgatacgattgacacaattaataaatgaacttatgaggtgtcaacaatgacaaaaagtccccaaagtaaacaatttgaagttttacattatatctgggaaaaagtgaatgaacatggttacccaccgaccgtccgagaaattggcgaagctgttcatctttcttcaacgtctacggttcacggccatatttcccgactagaaaaaaaaggatatatcgttaaagatccttctaaaccgcgcgcgctggaagtgacttccgcgggtatggatattttaggcatcacacccaaacaaaagcagattccagtacttggaatcgttgcggctggtgaaccgattcttgctgtcgaagaagcgacagattattttccgttacctccaagtctttcacacactgaccagccattattcatgctacaaattcgtggtgaaagtatgattaaggccggtattttaaatggtgattacgtcgtcgttcgaaagcagtcttatgctgataatggcgacattgttattgccatgaccgatgaaaacgaagcgacctgcaaacgattttataaagagagtgaccattttaggttgcaaccagagaacgatacgatggcgccaattatattaacaaaggttagcatcttaggtaaagtagttagcttatatagagatgaaatttcatagaacacttttttccaataagccaagacgatttttcaagtaaatgtttagtcgtcctggctttttttagtctgattgggacagctgagcaatcgctccagtctgttatctgacattatatttccattaaatgcgatttttagtatctttatataatcggcggttggcttttctacctgctaaaacaaatcgattatgatccttggtgatatcaaactcatagtcacgaccgttcattggcaatccctgctggtacattttctcgtactcactaattgttaattttatccgattgttcagcaagtaagtcactggttctgctaacttttgtgattgtaagtcagcaataattttgccgctgtaaaattctccttgggcaccagatccatagctaaataacccaatccggtcacccggtttaagatcatcggaatttgctaataacgaaagtaagctaagatagagtgatcctgtatacaagttcccaactaaggcattatattgtcgagaaaattcaaattgttccaatagtccaaccgcacttggatggtcatgcactaccgaacgtaacgcttttaatcccatctttgtaaacggtaaatgaaacgcgatagctttaaaatcatccaaatgacgattagtttgtgcctgatattgattccaagtccgattaaaaaagtcaatataaacatccgttgaatagtgaccatcaactaaagcttcgcgccgataagccggccgccaaaaatccatgatatcatctgaataaaaagcactctgcccgtccaatgctaggatatctggttgcgccgttattaacattgcaactgccccaccgccctgtgtcacttcacccggtgtatttaacccatatcgggcaatatcagcagccaacacaagaaccttgcttttgggatgctgtgtaacatgatcaaatgccatctgaatgccggccgtggcgccgtaacaggcctgcttaatttcaaacgaacgggcacttttactgattcccaaaagtgattggacataaattgcagctgactttgattgatcaataccactttcggtcccaaaaatcaccatatcaatcgcctgtttgtctgcttcatccaaaatctcatcggctgcgtttgccgccaaggttaccacatcttgagttggtgggattacagattgtttttgctgaccaattccaatcaaatacttgttgggatcttcgccacgagcattcgccaaatcagtcatgtcaatataataaggtgacgtaaaaaaagcaattttgtcaattccaacgatcataaaaatctcctttacgaaagaatgagaccgagatatcacgagttaacactcaatatcttggtctcattatgtatcacttattcaaatggcattattcctgaacaaaatgaactttatattgatcattaccgttcatcgagttgatcacgagaccttcatgcaaatcaccagcatatacaaacccttcatgcttgtgccccgttgaaataaatgtccactgaattacttgattaccaccaatcacagagccaaaaattcgaactccagttaaagtaccagaagtattatcagataacataacttcttggttccctaaatttccattcacatttatagttaacattgaattaaattctcctagcgatttcgtttatctaacataataatatagcataattgatatctgattgcgaatcaggtatggttaatttgaacaaatctaaaaaagtgagggatcgttatgaaaattaatattcaccgttctagaagtaatcgtgtcatcggcggcgtcttaggcggtttgagtgaacattatcattggaatccgttgttagtcagagttttgtttgcacttttaacattgaccccaccttttcccggaatcattgtttacttaatcttgtggattgttatggaagatcctgagtgatcttttgccaagccagtatattaaccccagcaggccaaagaaaaagacaaaaaatagcatgaaacattcaagaaaaaaagtgtcgggtaacatgttaatgacaggatcaaaattagggtcaaaaatccagtcttggtttcgaaacaataattcatgaaagtaaataaatacttgattaaaattaacaatcatcaatgaaataattactaacgaggcgacaaccattaatttaatgggtgttattaatagccacgttagtgattttttatttagactaactaatgcatatccacatatggggagtaaaataatgcccactgaattattgatcatgaccaagtgtcgcacatctttaaaatgttgtaagccatttggcgaacttgtaaagtaaaggaattttaaagctgttttccaaggattctgtaaataattaataatttgaacataatcagtatgcatttgacttgccgtcaacccagttgcggttctcaaatgtaaaaatgaaatgttaatatcaaacaaccaaatactgttaattgttaaaaaaacagcagttgctaaacatccaagaaaaaatagaattgctaatccagtttgcttcaatgttagtttcacattatggccgccattcatctaaactatcaatctggtaggttggcataatttcttttttggcgacctgttgtttagttgatagcccagaatatacaaggcaggcatcaatgccggcattgatgcctgccataatatcagtattgtaattatcgccaaccattacgacgtcatttttcgccaatccaatcttctgaagcgcactattaagaatttgggctttgggtttaccaatcataataggttctgtttgtgtggcatattcaacaaacttaacaactgagccagctcctggcatcatgccacgctccttggggatgtttgtatcaggattggtcccaataaaccgggaaccatttctaatggccaaaacagcctctgacagcttctcatacgtaagatctgaatctagtcccaccacaacgtaatctggccgatcagcttccagacgataatgatgagccaaaataacttgctttaaaccgagttcaccaacaatataaacacttggtgagtcggtttttttgtcagcattcataaaatcaacggttgccatccctgaagtatacacattttcagagtgaacatgaatatcatgattttcagccaagtttttgacaacatcttttggtaattgcgtggaattgttagtcacgaataaaaacgggatttgtttggcctgcaaacgttcgataaatcgcttggccgctggaattcgttttttaccagcataaaccgtgccatccaagtcgatgaaataccccttataatttttcattgcaatcatcccttcaatcaatttttactttcacgaataatgaagtggtgattattcgatttttcttcagtcttcacaactaaatttttacgcttttcaataggcggtttgcgtggtgtcactttttgttcaataaatgcgtgatttcgacgagctttatgatttctgccgcgtccacgactagaccgtcgatgatttttaggattctgataatttcttgatttcctgataattggccgagcttccaaattgtgaataacaaagtaagccgcaccgaaattaacacgttccagcagataatcattcaaggcggatataaatgggccgttggtttcatcttcccgatcatccttataaaatccgcgcaaacgtagctgaccatatccccaatcaccaacaatgtaatcaaattgactaagcgctggattataacgtttgacgaatgcttcaaagttaaaaccattggcatgatcatcatcaagctgatattgatgatcattaattgtgaacgttgtttctgttaattgactaattcgcgcaagtggtcgccttttttcatcatgatcggcaactaactggtctaattgttttcgatccacgagcaatctcctttcatttagttaacgggtaatgccttgacatataatcaccaaaaacgtcccgtaaattttgatcatataaaatatcatttttaccgataatacttaaagtcggaaagaacggaataaacaaataatgatccggcatcgcaatttgatacgttttaattggtgagactaattcctcatgaaaatacaactggccggcttcccgatcataccttaatccggcataatgaagctcgccaaaatattttcctcgaaatcccattcccttttgttcaaatttaatgaggaagtttcggttgtgttccatttcttggattaatcgccataagttataaccgtctaaagtaacccgcataacgtgcatggcatggggcaacatctgatgcagctgatttctgtccacaacgcctgccggtaaatctttaagaaataaacctgagctaagaatggctgcctcggttcctgccttgtccatgatggcatgcagcccctcatttactaaccgcgaatggccaatcagactagttgtcattggtgttttaattcgagcaagtttattccttgccaacagtttttcaccatggtcttcatatccttcgatctctgattgatcagaagagtcctccggcaagctaactgttttaacaacccgagctttatcagcatatattttgtgagaatcatctaattctatcgtgatcacaccgatatagtgaccccatttttcggcagcagcgagtagtgacgtgttaatgcgttcgcccattgccaacaaatgatgagtgtgagcaccaataatgatatctaactggggaaattttcttgctaagatgcgatcttcagggtgacccagatgtgataataacaccacaacatcatatttacccttattcgctgccaaaattttaggaagtactttctctggatcaagtggctgccaccctaaaatcggataagttaatgtataaggagcagtaagcccgattaacaagactcgggttccctttggggttgtgataattttgcttggctttgcccatgcgggaattttcttggttttaatatccagcaagttccccaagataacatcgaagttggcatcttggtataattcatttaattgttcatgcgtattggtaagcccttcgttatttccaatagtagcggcatcatagtgaatctgattgagcaaatcaacgtttgccttaccattggtgacttcagttagtggatgcacccgatcaacagcatcccctaaatcaactgtgatcaccgaagaatctttttgctggtttaattcacgacgtcgttgttcaataaagcgtctgattcgtggccagttttcaaaatgtgaatgtaaatcgtttgtgtgtaatatcgtaattttttcagtcattctatccacccgttatcgttgtcgttttgcaaaatcaatttgtttaccagtcaccatttcttcaacttctgattcagagaatggtgttccaaatggcggcttatgtttaagataatccgattcgggtgtatcaaccccaacgttaatattctctttaaccggaaccgcataatggtgaatatgcccgtgtaaattaatgatttgcttaacgattcccaacatcatcggataatgggtcatgtaatactgtttgtgattcatcttaattaagacaccgacatcatgaaattcgaatttcatatgatttccaacaggatgattatgcttctcaaggtatttaaataaatctcgtgaatcatggttccccttaattaaaactagtcgaccatgtaaactatcaaggacttcaaaaattttctgaagggcaattttttctggccgcgtatgcagaatagcaatgtcacctaaatgataaacaacatcatcaggtgccactcgcttgttccaattatcaataattgtctggttcatgtcttcaacagttaaaaatggtcggggagcaaattcgctaattcccaacaatctttcatgaaaaaaatgggtgtccgccgtgaaatattgcattgttcaactcttctttcacattgtcattatacgtttaatcataccactcagttggtttgctatattgccagttatggcaacttaagattttaatccatcatacccttatgacagaaaatatggcgtgtcataagaaaagggaccgaacaaaattacttttgcttgagcccctcttgccttaaccgttgcaccttattcaacgtatctatgataccacatgacattattattttgtttccatccgatctgaaaacccctttgctacaaataaaattgttaaccagataattgatccaatcaatgcaattaaggtatcggtttttagaaccaacacacaaccaacgaaaattaaaaacgccaagacaaaataatccgaaaacggaaaaagtggcattttaaatttgaaactctttgtcttactcaaatcaaccgtctgtcgatatttaatgtgagctaaaatgatcattccccaaacaaataagaagcaggttgtggtaacgctggaaataaaactaaacacattccctggcatcagaatactcaccacaacaatcaatgcaatcacacatgttgaaaatagaattgcgttaaacggaatctgccgccgcgataattttccaacggttcgatgaaattttgatttgccactgtacgttaacgaaaacatcattcggcctgtggtaaaaattgaactgttacaggctgaaattgaagcagtcaatacaacaaaattaataattgtggcggccgatcgaatgccaattccggaaaagacttggacgaacggacttgatgtcggtgaaacatgctgccaaggaaaaatactcattaaagccagcagagacccgacgtaaaaaagcagcactctagttgggacctcgttaatactcttaggaattgtgacctctggatcctgtgtttcagaagcagtcatgccaatcatttcgattccggcaaatccgaagagaaccatctgaaacgataggataaaccctgaaactccattggcaaatagtcctccgctgacgatgttagacacctcagcatggccatacggggttttataatggactgacactaatatgataccaatcacaattaatgcaacaattgcggcaattttgataattgacaaccaaaattcagtttcaccaaatgctgacaccgcaatgatatttacaagaaacaagacagatagtacaaccaatcctgtcaaccaaaccggtatctttggaaaccaaaattggatatataatcctgttgccgttaaatcagccattgcaatcgaaatccagcatgtccaataagtccagccaatcacaaatccggctcgttcccctaaatacttcttaataaagtagacaaaagaattgccactcaaatctgatagcaaaagttctcctaaggcccgcatgagtaagaagcacgcaaagccagccagcagatatgccaagataatagaaggcccagcaaggtgaatcgattgccccgcacctaaaaacagaccagttccgatcgttccaccaagtgcaattaattggacgtgacggttctttaaaccacgagataagtgatggtcatcattttgattctccaaaaaggtttcctccctttaatagttattgttaaaatttaataataattcggcatgatgtcaactcataaatcatcagtttaataaaaaaaggggcggagacaaaacaccgttttgtcgccagcctcttctacgcgataattttgagtcaaaacgtgaaacccaagtagttgtatacccggtaatcaccataaaccaagaacacattgactaaatatcatcttagatgaccgcgtcttttttcatattaactcagtaaatggatcattcgagtatcttaatgttacttttgttcagttttgcgtaatcgttcaatatcacggacaatcattaactcctcatcagttggaattaagagtgtctttgtggtcgagccatcagcagaaaggtcacgttcaacaccacgaatatcgtttttctttggatcaactttaataccaaaatagccaagtttgtcagaaacttcttgacgaatcatgatatcattttcgccaattccggcagtatatactaatgcatcaatgccgcccatttcagcaacgtaacttccaatataacggataatccgattcttgaagatctcacgggctaacattgcccgatgattttcatgcatgacaccttcaatttctcgcatatctgctgaaacaccagaaacgccgactaatccagatttatgattaagaatatcaatcatttcgttcatatccttaacatccgacttatcgataatatactgaagtgcagacgggtcaacatcccctgaacgagttgccatagtaattccggcaaccggtgagaagcccattgatgtgtcaaaggatttgccatctttgatcgcatcaatagaagcgcctgcgccaagatgaagaatgaccaacttaaggtctttaagtggtttgccaagcattgcagcagctcgttgcgagacataacggaagctggtaccgtgagcaccatatttacgaacgccaagatcagaataataattatatggcaaactgtaagtatagttcacttcaggcaatgtcgtatggaatgaggtatcaaaaacggcaacactaattacgtttggcaaaatctttttgaacgctttgattcccaaaacatttgctggttgatgaagtggggcaaaatctgttaacgactcaatcttcttaagaacatcatcggtaatgaccactgaatcatggaagtcttcaccaccagcaacgattcggtgcccaaccccagtgatttcgttataatccttaataattcccaaactcaacaacttatccaaaacaagctgaatcgcctgctcatgattatcaatgtcgattgtgtccttgtactttttaccatcatcatacttaatctcgactaatgatgatcccaaaccaattcggtcaatggcaccactcgacaataccttttcttcaggcatttgaaataatttgtactttaaagttgaactaccagcgttaattgcaatcgattttcccataattagtattactcctctaaattttttataaaagatcccgttgctgccaatcatcaatttcagtcaggaacttcttaaacgcagtttgatctttgaaagaaggaaattcaccaagcataaccggattggattgttttgcattttctccagtattttgtaaaattaaaattgccttctgagccgccttgttttcaaataattcaccggggagattcagcagaccttgtagataaattcgaccttgcatccactttaatagttgcttagcttcctctgtttgaaaaagctggcttggaaccaggaagaaaccaaatccacctttttttacatggttcatactatattcgattaataggtggtgaacataggaatgtcctgtttcagaatgagtgttgaaccccttcgcattcgcatcaattgggtaatagccaattggtagatcactgatgacagcatcaacgaccggagccaatacattttgaatggcatcttcatgaaacagctcagcatggatatgttggatttcaaatgaagaagcagcaagttcaaacatggcatcatcgttttcaattcccgaaacggtaggcttaactcccaaacttcggtcgagttgattatagatagctgttagtagattacctgttcccatcgcaggatccaatagactgatttgttttttatcattaaagatcccagctacaatatagccaatcacatttgcaattgtatctggcgtaatctgataatttgcttggattttatcgagtcgaattgcctttaaaatggccatctgaattgactttctaagtgtctcagcatcataatcgtcgcgattgaactttgcataaatattagtaaccttttgggcatcagaagcggtcaaaccaagatgccggccatccccatcctgaacagcatctaaggtctcaatcagtgaatccaaataggattgatcctttgctttttgaatgatttcactagactcattcaagatgttaaagaaacgttcaatttgttcttcagtcagaacactcaactccctttcacaatacttgaatactattaaatactaccagaaaaggctttaataattcaagtagctttagataattttgaagttaacgtaaaaaagaccaggacagatattagtttgtcctagtcattaaagttttagtagcacccaaaattgtcatatttagcaaagccgtaatacagaggtcttttattaagtatggtccttgcatgattctctatgattaagctaaaaaaatgagctcatttttttagctgcctacccaatgttgtgttttgtgcggtagtgtcagctcctttcagtcttatacttctttttgttttaaccgtattttttagttttttctgattaataagtcgaatttcttgaatcgtcgacatttgttcctggaaagaacgacattgaaatataatacaactaacgattatagttgcaaaaataaccgcaaccacagtgagtgatccttgccgacgctgattacttcttaaactcaagacgagaatatgccacgtatttctcaccattattaaaaatgacacgtgtttgtaaacacccctcttttttctcaaaatgaacataatggacatctgtcagtgatctcagatgtccttttcgatccccggttagccgaagcatattgctatatttttgaaaatgatagtacttacgggtcttgggactatatagcactacttcccaatccggttttacctcgcaaacttcaaattgataatgatccgactccaataattgaacacatgaataaaaattgagggtttgattttgttgatcatgattgtttgcccaaatagttgtcgtgattaaccagatgcccagcacacaaatcatcatactcatcattccctcaaccaagagatacccatacttgaaatgccctgaactgtttgaaaaactattttttaataatgagttcttcatagttatgcctttcattgatcatcacttgctgggcctctttgagttgttgattcatctgatggacagtttgaaaatataaaacgctgaatatcgaaataatcgttaaaccaatcaacgaatcaatcattgtaaatcccgatttaaaatttttgctcaagttcatagccactccatcccatttgaattttttgaacgtattttaccctgccgtcttttgtcaaccaattgatggtattgggactgacaaagccatcagcattaatgcgaagtgtaatgacctttccgggatgcaattcttttggaatttctactaaaaattgtttttccttctgatttccgggcacaaaaacaatttgatgggattggatttgtacaaagtaggcccgtttatgaagttgggcatcattatctgcctcggtccaagaattatgaactgagcgccaaaaagatgtctcttgcatgctgccgacatttacaactctgattaacgttagatttaataacagcgtccctgcaataacgccaagataaacgattaattcaacaaccgtaaatccacttttatttggacacttcattatgatcaatccttaagccttcatcttttgcctgcttaatttgctttttcgttaaataaccatccttagctaattctgggtagccgatgctgccagcgcttggatgctgactggtatatgcgtcaacttgagcctgaacaaccgaacccatcgcagatgtatgaattgtctgtgcatgctttcgttgactggaaaggtttggaataacaatcataattaatagtgaaataatgaataagacaatggtcatttctattaaagtaaatgcctgtttagttttcttaatttgtttgataattttaatacattcctttcacaccattataaattggcgttaataattgaaaatatgttcccacgatagtaatgccaataacgataaacattgacggctgaatgaatccaattattttattggttgttagcatcatttcttcaaacattaagcttgaataggcagtcattgcgtttgccatttctgtaattggatctcctgaattgagaaatttgatgatttcatctggaacaaattgggcctcatcaaccacatcagttaatgactgaccgtcagttaatgcggcatccaattttgctcccagtgaataaattaaagagcctttatcaaattccgccaaagttattgaaatttctcttacactgagaccactttttaaaagtgttgccaagttgcttgccaaataataagcaacgtaattttgaaatagcttgccaataagtggtaatttaatcagcagctgaactttcctgattggcgattgtctgaaccaataaacaaaactgattcccgttaaaaggattatgccaatcagaaaatatttgatgagtctaaagtttctcgtcaagaacgttgactgatgaatatttggcatcaattcctgaatttgaggaaatacgaacaagcgaatcatgatcatcaaaacgaataaaataagacataaaaataacggatataccatcattgacttgatctttttaatttgttttattttcaatcggtcaaacttggccaattcttttaagacgtcttttaatcggccatgcttttcagaaatcagcagttgatgataggccccaatattgatcagtgatctaacactttccgaaaaaccgttgccactttttaacctggtcacaatcaaattaacctgcggtcgcattcgtttattcgtttggacaataaaatcaagggcagctgttagggaaaaaccaatttttaatagatttgccaaaagcgtaaaaaattcagcttgctggtcgattgaccattttttaaccaagttggaacttttgggccacttgtttggtaaccatttttcggttgaccgctttttcaagttcactattccactccttccaatcgtaacgattcattctgctcaattcggcatattcatgagccattaatagcgccttctgctttccttggatggttggaattaaacgctggtaggcaacagcagtcactgcttgtgagataaatgactcatcaacgcccagctgctttaatcgactaataacgccgagaggattttgggcatgaacggttgtgtaaaccaaatgtccactcagtgctgctttgatagctgcctgggcagtcattgaatctctaatctcgccaataataaaaatatctggtcggtgcctaaggccaacttttatgagctctgagtaacccattcctgcatcattgttgacttggagttgtaaaaaccttggatctttaatctcgattggatcttcaattgtcatcacaaattgatccgcaactaactgatgaaccaaactatagatcgttgttgtttttcctgaaccagtggggcccgaaaaaatgattaatcctcttctgctgcttagctcttcaagaaaatgcttctgggcttcattaaaaaaagcagttgacaagtctgccagtgaatagataattctaatgacgagtgattccttaccggcaaagttcccaacagctgacaaccttaaatcatattttatgtcgtctatataccattccatcgcgccaatctgcggtcttctctgctcactaagcgccatatcagctaaatatttacaataattcatcattctccgggcgttcaaatatttaatttcatcccaaataattatttcctgaacaccacgaattttaatgacatacccatcctcagtaggtaaaaagtagatatcactggcttgatgagtaatagcgttcattaataaagcattcacctgttcactaatttccatgttgtttcacctctcaataattagttacgtaaaagaataaaattttccttgaaaacaactaaaaacaatggaacacaatgtgattagtttctaaattctcgtcaataataatttgaatacgataaagagactggctaaaacgattccagtagaattgtccctttatgaaatttgtgatcccccaaagaattcaatcagtaattaaatgacatccttaccatttgcagtatttgcttttctattctcaatttttgataacctgctactcaaaattgaataaaattttcggcaaaaaaagaccaaagtgaaatgaatttttcactttggtctttaaatatagttataattaatcttgattttctggcaaaacagcagcttcataaacgtcttgaacatcatcattgtcttcaagttcgtcaatcaaaccagtatactgtgatgtcttatcaccgggcacttcggtggttgtttctgggaacaaccggacttcagcagtatccagatcataaccggctttttgcaatgcatcacgaacagcagccatcgatgatggatcggtaaaaatctgaaattcatcatcagttgtcttcatgtcatcagcacctgcatccagtgcgtccatcaacatgtcgtcttcagtcttatccaaaccatcgcgaagaacaacaatatagccctttcgatcgaacatataagacactgatccactggctccaagtgaaccaccatgatgagtaaatgccgaacgaattgctgcagctgtccggttcttattatcagttaaagcagaaaccatgatggctgtaccgccgggaccgtaaccctcataagtaatttcttcaaacttggctccaccaacacctgaagccttatcgatggcccgttgaacattgtcttttggcatgttagcggcacgagccttttccattactaaacgtaactgaggattattttctggatcaggatcacctgctttagcggcttgatataagtcacgtgagatcttttggaaaatttttccacgtttagcatcttgggcgttcttccgcccttggatgttatgccattttgaatgtcctgacataaataactcctcttttctaaaatttaatagctagtttcaaacatacagcaacattctaccagatacgaacagcggtttcaaggcaagttatatgatcccaattgtcacagtgatttcaacccctacttctcattatgcacaataaataaacccaatatctctgaagttcaaataccaggttcatttgtccaaataatggttattaaacttttattcgttgaatcagttccttgcaaattactaaatcagccaattccaattgccattacccgctgaccgtacctaattaataattacttagttgactcacgtttcatcagtccatatggcagtaaaacattcttttcatcaaccgtttcattattcattaacttggttaacaatcgcattgcaaccgcaccaatatcgtacagcggttgtgtgatagatgacatctttggtcgaaccatctcagttaatttcgtatcattactggtaataatttcaaaattatcgggaactgtaacatcagcatcagacatgccattcataatcccagcggctaattcatcatcagttaccattgcagcggttgcattaactgacataagggctggctgtagcagcgttccggtcttgtatgtatcgtccgtttcgaagaccagtttttcgtcgtaaggaatccctgcactcttcaaagcctgcttatatccctttaaacgatatttcccattgattgcctgttccagtggaccacaaacaaaggcaacccgcttgtttccccgatcaatcaaatttttgacttcttcctgaacagctgccacgtaatcaatattgacgctcggattcaagtcctgatcatcaactgagcctgccaatacaattggtgtcttagttcgtttaaattcttcacgtaattgatcagtaatttcattgcccatgaaaacaatcccatcaacttgttttgacaaaagtgtattcagaactttaatttccttttcgctgttggaatcagaattagttaaaatgatgttgtacttgtacatcgtggcaacatcatcaataccacgcgctaaagacgcaaagtacatattggttacatcaggcacaattaccccaacggttgtcgtctttttacttgccagaccacgagcaacagcatttggccggtagtctaatttttcaataacatccagaactttctttctggttgcaggtttcacatttgcatttccattaaccactcttgagacggtcgccatcgaaacgctagcttctctggcaacatcataaattgttatcgtttgtttatccataaagatagccctttctttcaagacaaaataagttttcatcgattttcaaaacaccattcaatataccaaataaacgacgcttcggcaaactgaaaacgttttcaactaaatcataaactatcaaaactgaaaattcaagtgaaagcgcacttttgatgacatttatatgtgatatactattcctaatctataaaggatgtgttaattgtgagtaagatagaaaaagtacaaagatggctggttgataatgggcaagacattgctttaatcagcaatccaaaaaccatacaatatttgactaccttttacagcgatcctcacgaacgtgtgctgatgctgattgttttcaaaaataaagaaccgttcatgtttgcaccagcccttgaaactgaagcaattaaagatagcggttggacaagtcctgtatatggttacttagaccatgaaaatccatggaaaatcattgctgatcaagttcatgcacgtaacactgctgaagatcacattgcaatcgaaaaagatgcattaacgattgaccgtttagaactaattcaaaaatgtttcccaacaagtcatttttccgctgatctaacgccacttatcaacaatatgcgtgtgattaaaacatctgatgaaattgaaaaattaaaaatcgctggcaaatgggatgattttgcacttaaatctggtatcgaagctgttaaagtcggtcgaaccgaaaatcaagttgcagcggaacttcaatatgcgctgatgaaaaatggtattatggaactcagttttccatcacttgtccagtcagctgctcatgccgcagaaccccacggtgcgactagcaataaaaaaattgaaaataataaactcgtcctgtttgatcttgggacagtctgggatggctatattagtgatgcttcacgaacaattgccgttggaaagcccgatcaaaaatccttagacatctaccacgtctgcctggaagcacagttgacagcccaagcggccgcaaagccgggaataacagctgaagaactcgataaagttgctcgagacgtcatcactaaggctggttatggtgactacttcattcatcgtttgggccacggtatggggatgagcgagcacgaatttccgtcaattatggaaggaaatacgatgcaactccaacccggcatgtgcttctcgattgaacccggaatttatattcctaatgttgccggtgttcgaattgaagattgtgttcatatcactgaaaatggttgtgaaccatttactcatatgacaaaagagcttcagtatgttgaaggctaacccccagcattcttaaacccaataaaaaaactaaaaaggaacgaagcgccgcaagattttctttgcgttgccttcattcctttttagtctaaaagtaattaatcaacaagtctttcatttaagagaaccaaataaccgacgttaacttatttatcttgagaatgatcatgatctggagtcgtcgggtccaacgatggatcatcattggatgttgtcccacttggatctgcgttagtacttgaatctggtgatgtggtgctttgattgactgaatcagttgaatccgtactcttgaacgcctctcgagcatcgacaacgatgtcatcctgttgtggtgcagattcattaagatcatcagcacccctttgtgatttagaagttgttgctttttcggtaaactgagaactggcatccttgacagttcctttggcgttattcagctcatctttaatgacatctttaaaatcactgacagcatcattggcatagaatgcataatcgactgcccgatcacggacctcatctgttttttcacggagattccgtttcaattggttcttcttattctcatctagtttttgataggcagcgtacaagcctgccccaagaagccctgcaactaaaccactaacaatttttttacccattaaaatcatcctttcacaattagtatgaactattctttctgcttattcgaatggcggtgattccggtacatattccaagcagtcttgccaaacttaccggcaacaccagctgtaacacctttcttgccactatctttgacctttgatgttaaattttgagtcgcagcatttaaatcagacacgctctgtcctaagtcagctgcagcctgaaaaacaggagtcacaatgtttagcttatcatcaacatctttgactaaggtattagaagttgccatgattttatctgtttgcttaacaatcacatccacgttactggtcattgatcgaattgatgagttaacttcagtaactgttttacttactttcatcaaaaataatccaatgaacagcaccaatagcaaaaatgcaattgcagcgatgagtcctgcaatttgcccaacagtcatcttttctcctccttgtgcaacaatttactttagaatagcattaccacagtggtttgacaatgaaattgtttttttggcgatggttttatttcaaggagtggtttgatagtatggaaatatattaaaaaaacgaggtcctgcataatgcgtgcaatcacgatgaaactagcaattaattggaagcaatatcttaattactttgattggcaaaaaatattaatcacagtgacagaaaagattatcatgatcatattactaagtattttaatgttaacttgtcggcgaatcggtaagtctctcattaatcattttttcaaaaaatatcatcaaaaatatcgtgatactgtgaccgaaaagcgcgttcggacatttcacaccctctcgatgaacattttaaattactgcttatggttcttctggatatactcggttctttcaacaattggcgttccggtcggaacactaattgccagcgccggtgtattcagcttagcaattggccttggtgctcaaggattcgtgactgatatcgtgagtgggttctttattttgctggaaaaacaaattgaggtaggtgaatacgtacagattaatacaatcaagggaacaattaccgccgtgggtcttcgaacaactcaagtcgttgctgatgatggcacactgaactttattccgaatcgaacaattacaacaatttcaaatatgtcgcgtaataatatgaccgccatgattcaggttgcaatattacctgaaacgccaattgataaagtgattaaaatcattcgcgaagtgaacaaaagccaacaggctaaatatcctgacatcgttggtgatcccaaaatcctgggaaccattaatacgccagatggtaagcttgttgttcaagttaatatcacaacaaaaaatggcgcgcagtacaatgtttcccacgatttcttggcaatgtatctatcagagttaaacaaaaataatattcaattaccctcaagtcccgtagtcgttcagggaaacccaaataaatagcctcaaaaaatcaggtagtcaagtcgaaactaacgttcacttgactacctgatttttaatgcctgtttcacataaaattgtcaatcgacgacaaacgaaaacacaaataacgctgacgtcctcgcggcacctaagcaacgggttgaaaaacgattcaatcgcaactttaaaatcatctgaattcttcaataatgattacttggccaaatggcttaaggtgttcccaaattgactttaattacatgctcttacttttagtttcctgattcaatttcttctctaaatatgccggcaaagcaatatagtgctttgaaaaattatgagccagaaaattaacctctttaaatatttcgcgacgcgtaataatacctttaaagtggttttcatgatcaacatatggcaagaaattttcgtctatcaaatatcgaagaattgcttctaagttatcccgttcataaatcgtggggacctcggtttgcataatctccttgaccttcattgtgtcaagacaacgactcgtaattccagtattgcctaacattttctccgtgatcattggtaatgaaacaagacctttaaaatgactatcattgtctaaaacaggaatctttgcgtatttaattttggttaatactagaaaaacgtgctgtaaattattttcttcattaacggttgcaacgagatcagcaggaatcagaatgtctcgtttactttcacgcatcactgcttcaataggcttatcaatcatttgtggttaatactcctttactgtgaggaactaaatcgaaatttcaactcagggacaggggtcaattgacgatcaaaaaattgaatcaaataatcatgattatcagtaataattgctacatacgttccaccgattgatgcataccgtccccggggataggaaatgctcccgggattgacaaacagaatccccttgtcaaagcttaccccaagttggtgagtatgaccaaacgtgacaatatcggccgaatgtgactgcgcaaatagttccaacgtcaataggccagaatttacattttgaagatgaccgtgggtaataagaatgtttttttgatcaatgcgtaatgccctagattctggaaaatgttcaaaatccatattccccattacaatctgtaattttgaaactagaggatcgtcggcttttaattccgagtcaccacaatggacaattgcatcaaccttaccttcatacttattaataatttgttcaataatttgtcgatcaccgtgattatcactcataactacaattttcatgagtcccacaactccagtaatttccgaatcagtacccgaatggcatttccccggtgactgatcatattcttgtcatgagttgtcatttctgccagggttctttgctgtgccggtacatagaacagtggatcatagccaaattcattatcaccacgtggtgcgcgtagaatttgaccctcaattcggccaacggctttaactttttctccttctggtgttaaatatatcagaacagattcaaaataagcctctcggtccgatttattttgcatttccttaagaagttttgcgttattcgcatcgtcatcgtgatcaccggcataacgtgccgaatgaactcccggttgcccattcaatgcgccaacaaccaacccggagtcatccgcaatcactgcttggccggtaaatttcatgatttgttgtgcttttagcgttgcattttcttcaaaagtttgacccgtttcatcgacatttggaacatcattataatttgctaatgagttgacagtaattcccgtgccgccaaatgcctcttcaaattcaatgactttatgcggattctttgaagcaatcacaattgatgcaggctttttcaacttaaacgatctcccttttaaatatcaagatgatcagcagcaatagcatttcctaaaatattgtctgcaagcttggcaaattcgtccggatcgccggtagtaaagaaacgacgacttgcgtcagaactggctgggccacaaagtgcgccatgttgtttcaagtaatcgtaaacatcttgaccagccgcaattcccggatcaactagggacatctttgtgcccaagacatttgtaatttcttttcttaaaacaggaaaatgagtacatcccatgacaagcgtgtcaattggtttatcagcaaaataagcaagccgctgattcacaaccagctgagtttctggcgtccctgccaaaccctgttcgaccattgtgacgaattccggacagcccaatgaataaacatggctgctgggagcaagcttcttaataatgcgctcgtaatcccccgatttaacagttccattggtggcaatcacaccgatttgaccattatgagttgcttgaactgctgaacggcatcccggttcaatcacaccgataaccggaacggaaagtatttctgatagatagtcaaatgcggcagcagttgccgtgttgcatgccatcacgaacattttaatatcttgcgttatcatgtagtcagcaatccgtttagttaattttctgactgtttctgaactcttttgaccatagggtaaattggcttggtcgccaataaagatatacgattcatttggaagtaatttgacgatttgtttgagaaccgtcaagccaccaacccccgagtccatgacgccaattgggcgattatccaagtgaattccttcttcctttatattattaatattatctttcaattgtcagatagattcaactaacaaaacagatcttataagattattgtataataggattattacattttgcattgatggagattaaaaaatggataacgaagcatacaacaaattaattacgaataatcatttatcaggcttactgggccaagagctaattcgagatgatctcttacccagcattttaggaagtgactatcatgaaatatcttattgggctggcaaacatttggcaagaacccaccaactcgccaattatgatgatctaaccacattttttgaccaatttaagatgggtcacttaaccttgctaaaacgttctggaaatcaaattaaatggcaattagatggtgatgtagtcacaaatcgactcgatctttttgatgatcctgactttttcttggaagccggatttattgcgcagaattgtcagactattttaaatcgacaagctgaatcggaaattgagaaaactaatccatcaaagggatttgttttaattacaacgtttataagtaaagacaaaccaattgagggatcaaattcaacacaacctttcaaaatcatcaatccttcccaacaaaatagcgattcggagcggtcataacagatcagtagttttaattaatcattactattagaaaatacaaaaaaggagctggacaaaatcatttttgtctcagcccttttttagttaactctgatgacgcctagtcagtatattgatccaatacctgcttaaccttagcctttggatgataaccaacaatggtatccacaactttaccatctttttttacgagtaaagttggaatactcataattccaaatttagaagccgtgtttggatttttgtcaacatccatcttgttaaaggtcacattattcatctcttcagacaactcttcaacaactggtgactgcatccgacatggaccacaccaagttgcccaaaagtcagttaatgtcacacccttagcagtgtcattttcaaaagtttgatccgttgtttctttaagcatatcaaacactccaatccgttaatgattttatactaacaattatatagcaaaatgcaaacaaattgcacgcaatttattatttgaattttgctacggttgaaccatctccaccagcattaggggctgaataaccaaagctcttcacccgtgagttccgcttcaggtattcattaactccctttcgaagcgcaccagtaccctttccatgaataattgtaactgatggataaccggctagtaaagcagaatcaatataacgatccaattcatacatcgcctcttcgtaacgatggccacgcaaatctaatgttggtgacattcccgtcgagcgggttcttgaaacttgagtctggtaacgtgatttttcaggtttatcagaaccacttttttccaaatcagactcattaatttgcatctttaaaattccaagctgaacgtcccaaacaccatttttttcttgacgcagtaaagtcccctgttgaccatatgatttaactaaaacatcatcaccagcatgaaaattatgcttagctttttcttttctaagcactttatttctctttaagctgggtgccacttcaagcttattcaaagcgccctttgcatcaatcaattcattctcttttacggcaaccttgccaatttcagcttgctttttgtgcagatcatcaataatttgatcagctttctttttagcttcctcaacaacttgattagcctgctctttagcttgttcaaccagacgttccttttgactttggtatttattaaatttatcagtcaactcacgctgcagtttagttgatgcttcaagttgtaccttcaattcatcagcttcatcgtgagcacgcttggtttgagctgtcagctcttcaatcatattattgatatcttggttttgtgtatctgtaaacgcgcgagcttgctcaataattgcctgtgagaggcctaatttatgggcaatatttaatgcattactttgccctggaattccaagtaaaaatcgatacgtcggtcttagtgtatcaacatcaaattccattgaagcattaataattcctgggcgatcatatgcaaatgctttcagttctggataatgagttgtggcaatgagttcgcaacccgtcttatgaattgcatcaataatcgccatcgccaaagctgccccctctttggggtcggttccggctcccaattcatccagtagaacaagactgttatggcttaagcgacccagaatggaaataatattatccatatgtgaagagaacgtacttaagttagcttcaatcgattgatcatcaccaatgtcagcgaagacatcgtcaaaaacaccaatttgactatcctcatttgcagtgataaataaaccagattggcccatcaattgaagtaatccaacagttttaatcgtaattgttttaccacctgtattgggacctgtaacaataattgtatgatattgatcaccaatctcaatatcattggcaaccactttctcacgaggaatcagtgggtgcctggcttgacgtaacttgatcacatttcggtcagaaatattcggtaatacgcttctagtttgatgggcatactttgcttttgcatttacaaaatccaactgaccaattaaattcatattttccaacagttcagaacgatatggccgaattaaattggttaactctgctaaaattcgccgttcctcagctcgctgcgctaattgatcccgtcgaagctgattgttcatttcaactacattacttggttcaacgtacaacgtttggcctgatgcactttgatcatgaataataccgccaaagtgttgtttataatccgctctaatgggtaaaacaaaacgttcatctctaacagtaataatcggctcactcaaatatttcgcttcagaacccttaataaattttcccatcttagcacgaatgtcattttgcgtgcggacaattgttttccgaattgaacttaattgcgatgaagctgtatctaaaattcgaccatcatcatcaatcgatgaaatcatctgttgagtgatttcgggcatgagtgttaattgatcaacaatcttaggaattgatctgaggtcaactgcctctgctttaaagtcttcaaagaactgatggacaacttggccagcccgaagtagtttagtgatgtgggaaagctcagtcccacttaaagcagcattttcgattcttaatcgcttcatatatggcgcaatctcgattagtttaggaatcggaatttctccctttaatcgaataatatcagcgccatcggctgtctgatcgagacgatccttcacctgatcaaattctgaacttggttgcaattgattaacaatttcatgacctcgatcggtcgtcaaataagcagccagttgttgttttattttatcgtactctagtgtttccaataccttttcattcatttaaattttaaacctcgtttgaatgctcgtcccaaatctgaatcattttatctgagagaattggggtttgtttaacaatccattgggaaactgtcgactgttcgtattgatttacaatagcctgatttggaatcatcaggagtaaattcagcaagaaaaaaatcagtaaatagctcgacaaaacgttaatgccaccacctaataatgcattcagttgatgaattaccggtagcttcgtaactggtattaagatgcttttaaccagtcggacaatttgccacacgccaattacaagaataccaaaaataagccacttaactgccttttgggtacctaatgttgaatttccatggttcaaccagttaagtgcaaattcagcaatcggacttgtataaataaagccaacaactgtcgaaagcaaaattcctgctagatttaatatctcaacaactaaccctttgtgaagcccccgtgtaaatccgaacactaagatcaaaataatgataattgtaaaaatcatttcttgatcaccgatccttcggtgtttccggtttattttttggcatttcttcaagttgtttttcaacatcgaactgcttcgatatggcattaaaggcaattaagactgctcgctgttcctctgttgattggggcatcgctgtgtgtagttgatccaattgctcattcaacaggtctgtcacagcttgcatctgggtaattgaactgtgaccaaccaagacgtagtcttttccgtcaatcgttgctttaaatcgtcgtttctccttatcagacattaaatcacatcctaatatttttcaattaaaaaggaccgagacaaaactgacgctttgcactcaatcctttgactcaataataatctaattacttattatcgttacttggttgatcgtcttgatcgtcgccatcttttccaaggaatgtgttcaagacagattcaatcatatcccattctttgtccgtttgaataacctgaagctcgccaccttgtgggtcactgggatcatcaccctttggcaaagcaaaggcttggatttctacttcctcatcatcttttttaccagctgggtaaattaagatgtatgaacgatcaaaatcctccgatttaaaagtaaataaaacgtcatataacgtttcctcgccattctcatcaactaatgtaatttgttgttgaactggttcatctgccataatttgtttacctcgctatattttagttaattttcctttacgatccaaatagttttgaagaatcagacctgcagctaatttatcaatgaccttctttcgtttctttcgcgaaatatcggcttcttctgtaagcatacgctgcgcttcaacggtagttaatcgctcatcttcaaaatctactggtagatcaaattgtttctctaatcgttttccatacttttccgatgcctcagcacgaggtcccaaagagttattcatattctttggcaatcccactacaaagccatccacttggtacttatcgaccagttgagaaacccggtccaacccaaattccccattttcctcatcgatcggaataatttcaacgccttgcgaggtccaaccaagtgagtcactaacagcaactccgacggtttttgaaccgacatctaatcccattaatctcatttttcaccttttttggtctcatttggatgattatccaaatagaaacgaactagttcttcgattatctcatcacgctcatgacggcgaataagatttcttgcatcaagattacgcggaatgtaggctggatctccagaaatcagatacccaacaatttgattataagggttatagcccttttcttccaatgctgcataaacagtcaataaagtatctcgaacatccttcggttggtcttcattgaaattaaaaaacatggttttatctaacgaactcatacgattcacctctatgacataaggtcatttgtattaattctaactgattataaccaaaactacaatcaacagactcaatgtaaccgacatgtaatcgtggtgtaataattatttgttgatcaaccatgatacggcagcattcattgccttgtccagacccgatggatccttaccaccggcttgagccatgtttggtcgaccgccaccgccgcctttaatattaccagcgattgatttaattaaatcaccagccttaagaccactctttactttatcatcagcaaccgccacgattaaattagctttttgaccgctgccagttcccaaaaccaagacgtctgaaagtttcttagagcgccaagtatctgctagttgccgcagctgtgccataccggcatcttttataacacctgtaataattgtgtaattaccagctgcttttttatcagcaaagacgttttgggcttgttgtccagccagcttggcttccaatgcactttgtttctgttcgagcgtttttacttcatcttgaagttgttcaatccgatgagggacatctttaatttgagtgactttcaaattagcagcaacctgttttaaagctttttcttccttattcaatagttcaaaggcattctttgaggtaacagcttcaattctacgaacacctgcaccaactccagattctgaaacaatcttgaagagaccaatgtcacgcgtgttggacacatgcgttccaccacaaaattcaactgaaaaatcaccaatactgacaacccgaactttgtcaccatatttttcgctaaataaagcaattgcccccatctttttaccagtctttggatctgtaatggtcgttttaacgtcgatttctttgaagatctctttattaaccagatcttcaactttttgcaaatcctcatccgtgacttggccaaagtggttaaagtcaaaccgtaaataatcgggctcaactaatgaaccagcctgctgtgtatggccgccaagcacatttcgtaatgactggtccaacaaatgagttgctgtatgattcttttcaactcggctatgaaacaatggatcaacagccaaatggtaagtctgccccttgatcaacggctcttgtgttttaacagtatggaggttttggccatttggtgcgtgttgcacatcaactacgtcagccactttgtcaccatcatcgtttaggatgacgcccctatcagcaacttgtccacccatttcagcataaaatggcgtttgatcaaaaacaagttcagcggtatcagctttggtttcactaaccaatttttcattttcgacaattgcaagtaatttggctttggcaacatcaagtgtttcgtatccaacatactcactatgatccttaatttcaattagcagatcacgttgcacgcccattgatttagcaccactacgagctttacgggcacgatctttctgcttttgcatttcagctttaaagcccttttcatccacatccagattggcgtcattagcttcttcgcgagttaattcaaatggaaacccataagtatcataaagcttaaatgccgttggaccatcgatagttacttgatgattatcctttgctgactgaataacctggtgaagtaatttcaatccatctgccaacgtttcattaaagcgatcctcttcagaccggacgactttggcaatataatccttttgttccaaaacttcaggatagtaggtcttcaacgtttcaccaacaacgggaactagtttgtaaagaaacgacgttttgattcccaagcgttgaccatttacaatggcacgccgaattagtcgacgaataacgtatccacggcccacatttgacggcaatgcaccatcaccaatggcaacggtaattgctcttgcatgatcggcaataatcctgaatgcgacatcatcttgcttactcgtattgtacgttttatgatcgctaaattcttcagttttatgaatcattggcaaaaacaaatcagtttcaaagttagtgcgggcatgctgaaaaattgaaacgactcgttccagtcccataccagtatcaatgttcttccgaggaagtggttcataagtatcctgaggcgtatggttaaactgtgaaaatacaatgttccagacctctaaccaccggtcattttcaccgcccggataattttccggatcatcatcagcaaggttatcaaaatctttaccccgatcgtagaaaatttccgagtccggaccagaggggccctgaccgatatcccaaaagttatcttcgatttcaatgatatgatcaggtgaaaccccaacggcttcccaatattttttggcatccgtatcctttggatagacagtcatgaataatttgtccttatcccagccaaaccattttggagatgtcagcagctcaaaggcccatgcaatagcttcctttttgaaataatcgccaaccgaaaaattacccagcatttcaaaaagagtatggtgccgaggcgttttaccaacgttttcaatatcatttgttcgaatactcttttgagaacttgtcatccgtggattctttggaacgacagatccatcaaaatatttcttcattgtcgcaacgccagaattaatccaaagcagggttggatcgtcaactggaattaatgaagcactcggttcaattgtgtgacccttttcctggaaaaaatctagaaacatttgtctaatctgaccactacttaaacttttcatcagcaattctcctctttgacaaaattaaaacaccgttgctaacagagacgccgattgacgcggtaccactctgattgcaacgatgtttatcgtaaccacttaatctctataacgtagagtttgcgtaacattaatcatttaaaaagtaagagagcaccagctaatttaaatcgtttttcgcatcacccaaaacgtttcttaaaaataaagttagctagcatattcttagacatttcaaagtatacttttttgtgaattttatgtcaatcacgtttttgattaaacaccgaaactttaataaccaggttctttaaaaaaggacaattcccaatgaacttactggtaccgattggaactattcttacgttgcttacgcttcgaacgcgcttcttcacgtttcttaattcgtcgatccatctcatctttacgggcgatagtcattttgattcgtcgcttgtaaccaggcttaatttttttctttttcttcttgatcatgccgatcatggttggatcgaggcgatcatgatgttttcgatgggttttacgtcggtttcgatcataggaatcaataatttcaccgtgttttaaagcttttggtttgaagtgaattcccatatcttctaattcttcgacttctttttcctcatcaggagaataaagcgtaatagatgttccagacatcccattacgaccggttcggcctacccgatgaataaagaattctaagtcctcagtcggaatgtcatcgttaatgacatcagaaactccttgaatatcaattcctctagctgctaaatcggtggcaaccacaaactgaaaatcaaggttcttcactcgtttcattacctgtttacgttcacgaggtcgcataccaccgtgaatcatggcaactttaagtccttgacctttcaagtagtcagttaattcctcaacccgtttccgcgtattggcaaagatcaacaccagataaggctctccaattgtgagcagtttataaatcagctggtttttatcttggcccttcgtcgaaattaaccaattatcaattgtcgggctgataatggttgaaactggaatttcttcaataactggattatccatatatttctttaaaaagacattgattttttgaggaattgttgctgaaaagaccatcatttgaacgtcttttccaaagctggccgcaatgtgatcaacaacatctaagaagcccatatcaagtgtcatatcagcttcgtcaatgactaactgagaagctgtgtggacgtctagaccaccatttttaatcaaatcccaaattcttccgggtgtcccaataattaactgaggctgttcacgttttaatttgtcctcttgacgaactttatcggtgccaccaacatatgcgccggtcgaaatcggttcaggactgaatttggctaattgtttagccgcttcgataatttgataagctaattctcgactgggcgttgtaataactgcttgaaccttttgaacactggggtcaatttgattaaagataggcagcaggaaagcgtgggttttcccacttccagttgccgattgaccaacaacatctctatgtttcataataaccggaattaacttctcttgaacgggtgttggatggtcaaattttaaatctttgattgcttccagtaaaaatggctttaaattaaattctgaaaaattggtcatataatctcctacttgttgtttgtgacaaggtcatttagatcctttacaaaatctttgatttggtcttcattttcaacaacggcaccgctggcaagtgggtgaccaccgccgccgtatttcttagccaactcattaattgcgggcccctttgaacgaagccgaatccgaaatgtgccatccttttgctgaacaaaaattgcccaactcataacctctttaatttttccaggcaatggcacaactgctgatgtgctatcgtctcctaacttaaagggctccaaaacatcgtttgagagcaccaaatatgccgcgccactatcaagcattgtcaagttttcataaacatatgccgaaagtcgagctaatgggatatcgatttcatcttcgattttattgacctcgcttgccgaaaaatcataagttgttaatttggaagcaacagctaacgtgtgcggcgacgttgacggatacataaaccgaccggtatcaccaacaattccagcatataaaagccgggctccttcagccggtaacgtcaactctttttgattggcatcaaagaaatcataaattaattctgacgtgctcgaagcttctgggacaacccacattaaatctccaaatgcatcatcgtttggatggtggtcaattttgataagcatcttgcctttcgaataacgatcatcatcaattcggggctgattagcggtatctactacgataactaatgcgtctttgtactggtcatctgaaatttcatcggtttttcccaaccattcaaaaccgtgatactgtttgccggcacacaaaacagttttgcttggaaacgatgcttgaataatttgagctaatcccatctgtgaaccgatagcatccggatccggtcgcttatgccgatggatgataatggtttgatattttttaattgcatttaaaatttgatcttgaattgacatttttaattactccattacttttttgttgaacacttaagtatacattagattaaatataatataaaccatcgtgggtactctcatttaaactaatgaaacaaatcgagaataatattttcataagttaaatcagccaaattggtaattgtaatcccaagcaatctaactcctacagatatgtcaggcatctgagctaataagtcactggccattgcaaaataatctgccgcattattggttaaaaaattatctgaggttacccgttttgtaaacgttgaaaagtctttatagcgaatctttagaacaagtgttttaccatgcttctttttctcgtccattgtttgcgcaaccatctcggcaattcgttgtagttgaccatcaattgccgtttgattatcgattgccggtccaaatgtccgttcctttccaatcgactttcgttcccgcaggtattctactgggcgtggatcaattcctctggcacgctcgtataagacatagccaaatttaccaaagtgtttaataagatccatctgcgaccactgcaacaagtcggcaccgttagaaatctgaagagcctgcatttttggtgcagtctttttaccaacaccacggaaacgttcaattggcagtttttttaaaaattcgatagcatctcgctgatcaataattgttaatccaaccggctttgcatagtcggatgcctctttagctaaaaacttgttataagacacaccgaccgaacaagttaaatgtgtttgatcccaaatttctgattgaatcatcctagccacttgaattgaatcaaaaatttttagcttattatgagtaatatccaaatacgcttcatccagtgcgactgactcaatcacgtccgtatactcgcggaaaatatcgtgaatttgtttcgatactgcgcgataaagatcaaaccccgagaagcgaaaaactgcctgtgggcataattccagagctttttgcgaactcattgctgaatgaacaccaaaccgacgagcgtgatagtttgcagtcgccacaactcctcggccaccagttcgacgcggatccttagcgacaatcagcggtttagtttttaacgacggatccttacgttcttcaatcgaagcataaaaagcatccatatcaacatgaataatttttcttttaattgcatccatggttatcaactctcacattccgtttacaaacgtacgttcttgttggcggtaaaaaaatggttgggacaaaacaaattgttctgtttccaaccagatcgttgttgcactcaattattttgcttcaggtttactgtcatcatcagtatcaggctttgaatcagcagcatcacttttagcagcatcactggactgactgtcagctgtattctgatgagttgcagtatcactagcatcagtttgatcatttgcgttagcagtcgccgtagcggtaatggccggttgtttaacttgcgcaatggcactcaaatcaaataccagataaatcccatcacaatcaagggtaaccgtcttttctgcttcgttaatttcatcgaccacaccatgtaaccggccaattgtcacgacctgatcacctggcttaatcttagataattgatcacgacgcttttgctgttgttttctctgaggacgaatcatcagaaaatacattaaagcaaacaaaacaacgatcattaaaatcgaggtatacgaaccattcaatatttttcacccactctttctaatatacatactgtaccaaataactgactaatcgtccatagttaaaagtttttagcattgggttgattgtaaccatattgttcaaatacttccgctctaaggtctaataaattatcatccaaaatggcttgctgaacccgtttcatcagatgaattaaataatacaggttatggtaactgcacagtcttagaccaaatgtttcatttgatttaaccagatgtctgatataagctctggaataatttcggcaggcataacaattacagtgatcatcaagcggtcgaaaatcacgcgcatatgctgcgtttttaacaaccaatcgaccgtgagaagtcatcactgtcccatttctggcaattcgagttggtaggacgcagtcgaacatatcaacgccacgaatcacaccatcaattaatgaatccgttacaccaacacccattaagtatcttggtttgttttccggaagtaatggtgtcgttgcttccagaattcgattcatttctgacttcgattcgcctactgataacccaccaattgaataaccgggaaagtcaagactgactaaatcgttcgccgactgtttacgaagatcttcaaatccagcaccttgaacaattccaaataatccctgccaatctggattttgatgggctttgagtccacgttccgcccaccgactggttcgctcaactgattttttaacataatcataggattcaaagaatggtgggcattcatccagactcatcataatatcaggaccaagtgcattctcaatttgaattgccttttctggagatagaaacattttagctccgttaatttcgtttttaaaggtgacgcctttttcagtaatatccctatttttagctagcgaaaacacttgaaaaccaccagaatcagttagaattcccttgttccaattcataaacttgtgtaatccacctgcttgctggacaatatcttctccaggacgtagccaaagatgataggtattcgccaaaacaatcgtggcacccattttgtccaattcttctggggccaatgtcttaacggttgcttgagttccaacgggcataaaaattggtgttctaaaagttccgtgaggtgtcgtaatctcccccaaccgggcacccgtgtgtttttcttttttgatcaagcgatatgtgatcgctggttgcataaaaatcctcctaatggatgtacatagcatccccaaaactaaagaaccgatacttctcttcaatggcatgttgataagcgttcaagatattttctcgacctgtaaacgaagcaaccaacatcaccaaagttgacttcggtaaatggaaattggtaataaatgagtcaacaattttccagtcataaccgggcttgataaaaatatccgtccatcccgaatcagcgtgaatagcaccatcaaactttgtcccaacggtttccagtgttcgaattgaggtcgtcccggtcgcaacaatcttgccaccactatcccggacctgattcaatgtttgagcagcatcctgggaaagtcgataaaattcactatgcattttatgatcttcaatattctcttcatcaactgggcgaaaagttcctaaaccaacatgcaaagttaaataaacaagatgaacacctttatcggccactttttgaagtaactctttggtccagtgcagaccggcagtgggcgcagcggctgaacccatctctttagcataaaccgtttgataacgatctggatcatccaatttttccttaatgtaaggtggcagtggtgtttctcctaaacgttcaagaatttcaataaaaattcccttatatttaaactcaatttctcggccaccatggtctaattctttggtaacaaccgcttttaactgaccttcaccaaagtcaataaccgttcccaccttggcccgtttggcaggcttcatcaatgtctcccagcgatcgccttcgatattgtgtaggagaaggacttctaaatttgcgccagtatccgatttgacgccatagattcgagcaggcatgacctttgaatcgttcataaccaatgcatctccgggatttaagtaatcaataatgttgtaaaatcgacgatcctgcatatcaccagattttcggtcaagaactaataagcgtgattcatcacgatctttaatcggtgtctgggcaatcaattcatgtggcaggtcataatcaaagtcctcaagtgtatagttagttttcaaaattctaattcctttcgtccggcttagggactggatagtttaaatgcttatagcccttgtgagtcaccatccgacccctagctgttcgcttaattaatccaatctgtaataaatacggttcatacatttcagcaattgtatccgtttcttctccaatattagcagccaacgtgtttaatcctacaggaccaccatcgtaataacgaatcatcgtttgaagtagcttagtgtcagtatcgtccagcccaaggtcatctacctttaacttttgaagggcatacctgacaatattcagatcaatattttcttttttagcaacttgtgcaaaatcacgaattcgttttaataggcgattggcaactcgtggtgttcctcgggagcgtaatgcaatctcatgggcaccggattttaatattggaatttggaagatgtcagccgttcgttttacaatgctttccagatcggcaacgtgataataattcatatgttcgacaatcccaaaccgatcccgtaatggtgcagatagcatccccgcctgggttgttgccccaattaaagtaaatggcggtaacggaaagtgaattgggtgagctcctgaaccctgaccaacaacaatatccacataaaaatcttccattgccgaatacagcatttcttcgacaacttttggcaaccgatgaatttcatcaataaacaaaacatctccaggctgaagctcatttaataatgacaacaaatcacccggtttatcaattgccggtccactggttgttcgaatgtgaacgcccatttcattcgcaatcaccattgctaatgtcgtttttccaagtccaggtgggccatatagcaaaacatggtccaatgattcttctcgctgcttagcggccttgatataaacattcaattcatttttaacatcatcctgaccaatatattcattaagcatctgaggccgaagtgttttttcaatattcgattcctgtgaatcctcggtttctggagaaatcagtcgatcgtcttttgaattggtcaattttcttacctcctcaatgcattaatagctttaggcctaagctcaaatattgatcggttgataaaccatccttttgagatagctcagctttaatcccatcaatctgtttagtactatatcctaatgcagcaagtgctgaaagtgcatcagatagttcttgagaatttgaattttgattggtatgacttattgaatccaccgtattgggtaagataccttcaaattttccttgcaagtccaggataatttgttgcgccgtttttttaccgactcctggaaatttagtcagaaatttaacatccttattgttaactgctgctaccaagccatctcggtcgttgccggccaaaatagccaaggcgcttttcggcccaattccggaaacagcaattaatttttcaaaaatttgtttatcttcctgatcataaaagccataaagtaaaattgccgtatcactaactgattgataaatataaacccgaaccattttttcaggatcaaccgtaaaccgatacggatcggccgtatagactagataaccaacaccaccgaccagtaacacaatgtgtgtgggagtgacatcgactacatttccttctaagaattcaaacattggctactcctcttaactaaacatatgtttgccaataaattgtatcataactcgcaatccgttcgaaaccaattttaaaatatttcttcatcggtgcgatgagaatcctgaattcgcttaaacattttttcaatatcctcattactaaacttaactaatgttggtcgaccatgcggacaattgtatggattttcgcaactcggtaatcgttgaagaagggcctgtgcttgccgttgatctaaatggtgattagctttgatagcccttttacaactcatcatgatggccgtcttttctcgaaaagctgcaaccgaaattttatgatccgacaaaatccaatcgatcatttcccgaattgtatcttcttcctgtcctgctttgaaccacattgggtgctcgcgaacaataaagctgttttgaccaaacggctcaagatgaatttccaactttttcaacagatcaaaatggtcactaattagaagaaaatcagcggttgaataatctaacacaattgggactaataatttttgctgatcttcggatacttcaccaattgctttacgataatgttcataattaatccgttcctgtgccgcatgttgatcaaccaaatacatgttttcggccgtctgagcaactaaataagtgccatgaatttggccaatgtattctaattgggggaatccggattccgcgaccagttcagactgttttggctgaggttttgtgattgaagcagcatcactaaagcttgagtggctgctgttatcaaagattggtactgacgttggctcagcttcaagtaaggaatcaaattttgccacttgatcactttttaagtcttcctttgtccggacaacaattggatcaacttcaggctgatcagcaactgagacgggctgaggtttggcagtaaatagtggtgcttgatctgccggtcgactttggtcggctattgggacgttaaattgtcttggagtggcatcaaacggtttcttgaagtcacgagtagcatcgggaattaggttcttatccgatagcatttgctgaatcgccgttgaaattaaactgccaattttaggctcatcacttatccgcacttcttgtttcgttgggtgaacgttaacatcaatcaaagcaggatcagcattgatggtaataactgcaatcggaaaacgaccaatcatcaactttgaaccgtagccgttgattacggctttagttaacggaaagttacgaatgaaccggccgttcaaaataagtgaaatgtaatttcgactggaccgggttagttcaggcaaactgacataaccaccaattttaatatcaaggtcatctcccttgattggctgcattttagcaatcgttttaactccgtaaattgagccaaggacttggagaagatcaccccttccagaggtccgcaaaagttcacggccattactaatcaatgaaaaggccacttcaggatgactcaaagccaatcgattcacgatatcggatattttagataattcggtatttggtgaacttaaatactttaatcttgccggtgtgttataaaataatgaactaacggcaaccgtggtccctttacgagattcggatgcctgttgggaaaccagtttgccccctttgtaagtgacttcagtgcctactgaaccggttgaagtcttcatggtaacgtctgccacagaactaatacttggcaaagcttcaccacgaaagcccaatgttcgaactcgaaacagatcccgttgttcagaaattttgctggtcgcatggcgtaaaaacgccgtctgcacctgagacttgtcaattccgttaccatcatcaaccactttaatcaacttaaggccggaattttcaatagtcacatcaatttctgtactatcggcatcgattgcattctctaccaactctttgacaactgaggcgggacgttcgaccacttcaccagccgcgatttgattggctaaaattgttggtaattcacgaatctttttcaaatcaaccaccttattctttgttcatcttttgctgccacttataaacttgattcataatttgcattggggttttagacattaaatccaaattttttaactgagaaacaacatcggcctgtgtatcatcaatctgttccagtggaaaaagtgaaatttgctcttctgattccctttgcggtgtctcggccttggctgccattgtcttggcggtttgctgataattcttacgctcctgcttctcatcagcctgctcctctaatcgactgagaattgcgtttgcccggtgtagcaaagggttgggtaaacccgctaatttagcaacatgaataccgtacgatttatctgctggtcccggctgaatcttgtgaagaaaaacaagttccccgtttgattcagtagcaccaacatggacatttcgcaactgttttaatgactcatccaaaacggttaattcatgataatgagttgaaaacagtgttttagcaccaatattattgtgaacatactcaataattgcttgggccaatgccatcccgtcatatgttgcagttccgcgaccaatttcatcaaacagaatcaagctatttggagtcgcattttcaatagcgtcgttagcctctttcatttcaaccatgaatgtgctttgcccagaaatcaaatcatcggccgcaccaattctagtaaatattttatcaaaaacgggtaattccgctttttttgctggaacaaaacaacccatttgattcataataacggttaatgccatttgacgcatgtatgtgctctttcctgacatgttgggtccggtaattaacaacacactggtatcttcccctaaactaacatcattgggaacatattgctgatggcccaaaactttttccacaactggatgacggccatccttgactgcaacctcatgtttggttgtcaaacttggacgaatgaaccgatactcctcactcaccgcggcaaagctttgcaaaacatcaatcgacgcgattgcatcggctaaatcctgaattcgtttgatggacttctttatctcatctctgacggcaacaaatagtttgtattcaagtgttttactttgttcctgggcctctaaaattaaagcttctttttcttttaattcaggtgttgagaatcgctcagaattagccaatgtttgctttctttggtaacggttggccggaatcttgcttaaattaactttggtaacttcgatgtaatagccaaaaacgtgattgaaaccaacttttaggttattaattcccgttacctggcgttccttagcttcaagttgtgccagccatttttgaccattattagttgcatcccggtatttatccagttgatcattataaccatctttaataacaccgccatcggttaccgagattggcggttcctcaacaattgccgaatcaattttatcgacaatatcatcaagtggcacaacgttttttaatatgtcatcaaaactatgatcagcgatttgatccaaaatatatttaattttagggacttgttgtaatgaagttttcagttgaatcaagtcgcgcccattaacactgccaaaagcaacccgaccagctaaccgctctagatcataaaccttaatcagctcatcttgaagctgatttcgctcaaaataatgatctaataaaatagcgacagcatcatgacgctcatttatctttcttcgattgacaagcggtcgttcaatccactgctttaatttccgcccccccatagctgtttttgtttgatccaataaccacaataacgtccccgcctttttaccagtgcgaatattttttgtgagttccaaattatactgcgaattatggtctaattccaaatagtcagacggttcatagacaacagctcgctttaaatgttggagacttcgcttttgggttgtctggatataatccagtaacaacttcactatctgctttaaggctgaattagaaacatcctgtgagaggtaactggttgatgcttgaacaggcaattcaggttgatgagaaatcaaaattcccagttttttgatggtctcttcaatttgttgaggtagatccttatcaaccaccgtttcctttgtctgtaatgagactaattcattaattagctcagcctgactcgtcagcttggctacctttagttcaccagttgacaaatctgcatacgcaaatgcaaatccttgagatttagggtcatactgagccgccgttaaataattatttgttttcgcattttcagtaccaatatcaatttgggtccctggtgtcactaactgaattaccgcacgtttaaccattcccttagctaatcgaggatcttccatttgttcgcagattgcaactttgtacccttggtcaaccaagatatcaatgtaattttgaaccgctttatgaggaacgccacacattggaacagggttgtctgcattccggctgcgattagtaagcgtcaattcaagcaactgtgaccctttaatcgcatcatcattaaacatttcataaaaatcaccaagtctgtaaaataagaatgcatcagggtactgatctttgattttctgatactgtaccatcattggtgttaattctttttttgacaaaaataggtccccttatttaaaaaatatatgtgcaaattattcagacaaactttcttgcataaatctcgatctataaaataaacttaactcattcggtcatcggtatacatcactggttcaatatgagttgcatgacccgatttatcatcaatatcaacaaagcatccagaaataatgccccggccatcctcaagcacttcaaatcttgcaggacgctgattcaaaaatctgccaatcacgttttctggacgcattcctagcatcccatcagccggaccagtcatccccgcatccgttaaaaaggccgtctttcctggtaaaattctcgcatcattggtttgaacgtgagtatgtgtcccaaccactgcagaaattcggccatcaagatacttcgccattgctaatttttcacttgtcgcttctgcatgaaaatccataaaaatacattttgtttgttgactgagtttgtcaaccagttcatctgccaaggcaaatggatcatccaaattatccataaaaacccggccttggaaattcaaaacagccaattgctgaccgttaacgttaatcatggtatatcccttacctggtgttgttcgccgtggaaaattatatggtcggattaatcgtttggcatcatcaataaaatccaagatttcattattactccacgcatgattccctaaggtgaccacatcgacaccgtcgctcattaattccttataaatgctcagactgatccctcgtcccatcgccgttgcattttcaccattgacaactgtcacttgtggtctgacgctttgcttaatcttcggcaaataattcttgatcattgagacacccttgttacccacaacgtcaccaataaaaagcactcgcattaaaattccctcgatatcctctagttttcttttgctaattttaacatttataaaagaaaaaagatcagaataactgatctttcaccttgcgtattcgactgaacgaatctctcgaatcacagttactttaatatgacccggatacttcatctcagtttcaatcttttgtttaatcctgcgggcaagaacaattgcctgagtgtccgtaatctcttcgggtttggcaatcactctgatttctcgaccagcttgaattgcataactcttttgaacctcgtcaaagccatcggtaatcttttccagactatccaaacgatgaacaaagctttcaagggaatcactatgcgcgcctggacgcgacactgcaatcttttcagcaacagatacaagctcagaaataatagtttctggtttgtgaccttcttgataaccttgaattgcatcaataactacggggctttcatgatactttttggccaaatcaacgccaacttgaacatgtgaaccttggacaccgttgttaacagcttttccgatatcgtgtaataatcctgcgcgtttagctaaagtaacatcctcacttaattctgcagcaaaagcaccagccaattttgcaacttcaattgaatggcctaataagttctgaccatgataaatcttaaagtttaattggcccactaacttgatcatttggggactcattgaatgaattcccaaatcaaatagtgtctcttcaccaatttcttgaattcgttcgtcaagttccttccgactcttatcaaccatttcttcaattcgtgccggatgaattctgccatccttgataagcttttcaagcgtcatcttggcgacctctcgccgaattggatcaaaaccgcttaatacaactgcctgcggcgtgtcatcaataattagatcaataccagtcaatgtttcaaaagttcgaatgttacgaccttcacggccaattattcgacccttcatatcctcattcggaagactgacaactgatacagtcgtttcagacacaatatcagcagaactttgctgaattgcttcaacaattaaattctttgcgttttcatcagcttcggtttgagcctgatagtaactttcttttaccatccttgctttctcctcagccaactgatcgctagtctcttttaaaattaagtcacgtgcctcgtcttgagtaaacgcagcaactttttcaacttcagcctgacgctttgcaataagtgagtttgcttcttcttgttgtgtaattaaattctgttgttcacgattaatcttttgctctttacgattaagggtactctcacgatgttcgaaagcactatctttacgatcgagagcttcttctcgctgcaacaatcgatcctcttgtttttgaatttccgcacgtcgctcttttaattccttttcaatctttgaacgatagcgatgattcttttcttgagcggataaagttgcttctttcacgactgtctcggcttttttcttagcttcagccaaaataccatttgccgaaccagttgctgtatgaagttctctttcctgaatctttttttgtgcagactttccgataacaaaactaataataccaacaaaaccgacaacaataatagcgatgattgcgaggattactccagccatactcatggcttcacctccaaatcatcataaaatgattgtttctaaatcaattataagatgttatttgattattgacacaactctcattttaatgtttatgcaccgcagtgtcaatcatcttatcgcgtcggaaacaataattgggtaatacaaataaatattaataatcgatttgttatatgatgcatttaattggcttcctgaggttgggaaaataatcgttttaaccagtctctgttagtataaacaaatacaattattacagagcaaaaatgtgtgacaaaaggcaaccttcggccgtgtcatctagctattcaaccattccgttcagagtatattcggataatccggttatctctggaagttaagtgccctttgtcccgctctgccctcccccatttaaaaatctttgctaagtttcgttccattcaaaaaggactaagatatgagtagatactcaatctcagtcccaggataattcaaattcacgcttaatggaatttcacaatagtcagttacttaccaatatttaaatcgatattgtcagccggttctggcttcttctctggcttttgaggagcctttttgtcagaaggtttgctggatgatttactgttggctttattatcagtctcatctggaatgccataagcatcacgaaccttcctaagaatttcatcgtacatatcctgatgctcttcaagatatgacttagcattttcacgaccttgaccaattcgctcatcaccatacgaataccacgatccagatttgtcaacgatatccttatcaacagccatatcaaccaattcacctgattgagaaattcccttgccatacataatatcaacttcagcctttttaaagggtggcgctaccttgttcttaacgaccttaatccgtgtccggtttccaatgatatttgtgccatctttaatttgttctgcacgacggatttcgaggcgaatcgttgcataaaatttcaatgcacgtccaccaggtgtcgtttcaggattaccaaacataacaccgactttttcacgaatctggttaataaaaattgcaattgtttttgtcttactaatggttccggacaattttctcaacgcttgcgacatcagtctagcctgcagtccaacgtgagcatcgcccatctcaccttcaatttcagcacgtggaaccaatgctgcaactgagtcaatgacaacaatatccacagcaccacttgtaaccaaggcatcagtaatttgtaatccctgttcaccagtatcaggttgtgataaaagcagatcatcaatgttgacccctaaatgggttgcataaacaggatccaaggcattctctgcgtcaatgtatgcggctgttccgccacgcttttgaacctcggccactgcatgaagtgcaacagttgtttttccagaactttcaggtccgtagatctccacaatccgaccacggggataaccaccaacgccaagagcttcatcaagtgccaacgaaccagttgggattgttgaaatttctgtatcggctttatcacccattctcatgatggaacccttaccgaattctttttcaatattttttaaagctttatctaaagctgctttcctttggtcagccattgaattcctcccattttctaaaacagaaaagtttaccagttaactatactaatgatcattagaaaaatcaataaaaaagcgaacaaaagttcgattaatttgattattgaattgcttcaattgccatttttagtccagcaacaaccgcagcttcgcgaatatcattacgttgacctttaaactgaaactttttagcataggtttgatgggttccaaaagcaatgccaatccaagttgtcccaaccggattgccttctaacgagtctggaccggctgcaccagtgaatgaaaccgctaagtctttgttcataatgctccgtgattgatttgccatccaaatagcagttggttcactcaccacaccattttcatcaatgacctcattgggaatatttaataactgctccttgacatggtttgaataagtaacaaagccaccctcgaacacttctgaaacacctggtacattacctaaagtgctttgaaatttaccagcagtaatgctttcagcggcagtaattgtaatgtgctttttaagtaattgactcactaactctttttctaatgacatttgtatcatgactcccttcatactatataactacgaagattaaggctcttttcatttaaaagatgccacttaatttaaaattaagcatctggattacttgtaactatcgttaattaaatgctactagtaattattgaaaaataattacctaaaaattgattaaagacactaacccgttttgactggttgcttgcttttagctaaattaagactggcaacaaattttctttgtcccagccttaattgtgcatctaaaaataatagattgtaaagttattgcaacagttaaaaacattaatttttgaagaaattacttttgagtctttgcctactaaatatatccaaaatgaaatttgaaaacttctaaaaggaatctgaaaagactgatcggttttgaacaaaataatcgattcctgagtaaattgtgaaaaataggcaaatgtacaaaagaatttgatcaagtggtatgtgaattgctgaaaagagtacgttattcaaaaacaacagaataattgccagcatctgggttgacgttttaattttacctggccacgccgccgccatcacctgaccatcattttcaactattattaatctaagccctgtcaccgcaagttcccgacaaacaataattgcaatcacccatgcgggaactttattgaacgctgtcaagaaaataaaagcagtcatcactagcatcttatccgctaacgggtcggcaaacttgccaaagttggtcactaaattattacgacgggcaatctgaccatctaaaaagtcagttaacgaagcaacaacaaaaataatagtagcaatccaccttgcattcgggatgactgtaccagcgattgtcacatttccagagaaaatcgggactgccaagattaaaataaaaaatggaattaaaataattcgaaacactgtcaatttattaggtaaattcatgagtagcctccaaccatcattctctaatatgagttatttgtggttccaccagtcgtgtctgtgttgccagtcgcaccagttgtattagatgaatttgaggtggttccggtagtcccagtgctcccctgagttcccgttgtcccagttgtgttagagctggtcgtgccagttgtggttgatgtccctgtagtagtggaactattagtagcgctggaagttgcacttgctttaccaaactgtagagtgattactcgaacctgattggaactgccatctgttggatcagtcagcttcaattttttaccagcaacataaatcacagtctgtggtgcattaccagtgttaaccgttgcggtggttacgctacttggaagactaactgtgtgcgattttccaccagctaaagcagcttgccataaagttgtcccatttgcactgactgatgaccaggcactgccactacccgttgctgcaattttaattgcagtctttttaggtgccccactgactcggtaggtcacattactgccagattctgttaatttggcaaaggcaacctttttggttggctttttagttttcttagccttctttgcagagctggaactcgtcttggtagacgacttttgattacttgaaacagaaaccttacttgtttcaatttgagttttgtccgtattacgagtgctgtgagctgctgcaacccagatggcaatcaaaataacgagtaccacaacagaaaccgatacaattggaatatatcggcgaatcttctcatttcgttgatcaacttttcgttgggcggatcgtgtttcgggattatcactattaactcgatcaacatattcaggatcctcagtatcgggtaatttggtgtcaaattgacttaacagttcactaccatcgagaccgactgagtcagcatattgtttaacaaatgcgcgaacataaaactcacccggtaatgcatcaaaatcattatcttcaattgcaattagataacgtttttgaatctttgtatttttttgtaaatcgtcaagtgtgtatcctttagccactcgagcatcatgcaatttttttccaattgttaacttatctttttcgtcgctcatactcattctccattacatagatattaatttttaccaactcaagtatatcatatgacaaattcaggccatttttaaataattcataagtcattggtgattcttaataacttctacttgaatcgataaatgattaagaaagcgttctgaaatcatttgaacatctttcaatgttaattgtttaagaatcgtaacctcatcataaatggttaggggttcacctaggaatccatcaaattgactcgaaattgcctcctcagaatccatcattgaaatgtaattaccaaataattcatttttttgaagttggaattcatcttgcaactcacttactttatcgggaattgttttgataatctttttgatttcctgaacgaatatagatggttgactggtatcaccactcaacaccgtaaaatgaaagccacgttcattttcaaactcccatgaaaacgaatcatcaatcacaccactatgatatagtctatcatactcaattgcgttttcactgaagaataaatcgaacataattgataaaccaatttcgtacttcaaactatctcgaccagtcggaacctggtcgtttccacgcaagccaacggatacttttgttctagagacattcatgaggtcggtgtgaacagcttcgaagggagtggctgaatagttgttaatccgttctatccgaggcgtttgagaaaatgtttttcgagcctgattgtcaataatccaattcaaggtttcatcaggatccagcttcccggtgatgaagagtgacatattacttggatgataaaatgtttgataggccagctcaacatcatctagtgtaatgctatcaacgcttttagatgatccagcaatatcatttgataatgcagaatccgggtataattgccgaattgtttgaaaataagcctgattattgggatcgtttttatacatgttaatttcttgatcaatgattcccttttctcggttaactttttccttggtaaaataaggaatttgaacgaaatcaagaaggatattcaaattatctttgaatgattccgtggtcgagaacaaatagtttgttctggtaaagctggtgaaggcattggattgcgccccagttttgttaaaaagctcaaagacatcatagtccttcttatcaaacatcttgtgttcaagaaaatgggcaattccagcaggttgaacaacttttttcccatttaggataaaggattggtccgttgacccatagttcacgcctagaattgctgtcgttttgttaaaccctgatttaggctgcaaataaacagttagtccatttgggagtttttgaaccaacaattgctcgtcataatcatgataatgaattattttcattgttagccccctgactgtttagtgcaaagatcgctctcaatttaactttcgcagcaatcttcttaatatcgtctttcgttactgaattaattcgttcttcccaaacagtgtcgggatagtcaatattcataatttgttgaatatagcgtttttcaataaccgcggaaagatgatctgcttccgaacgatgctggttaatcattgattgcttaacaccatccattagttgatcagaataatcaccatgcagcaatttagtgatttgagcaggaattaattctagtacttgctgttcattttgatagtcgatccctgcttgaactgtcacaatccctgccaaggaattataactgctatgaatatcataagctagactttccttttcgcggacatttgtaaatagcaaagacctggttgagcttccaaataattggttaaagataactgctggaaaatattgctcatccccaaagtaaactggtagttcataaccaacatttaggattgattgcgaaccatcaatcttttcatttgcactttggaggctctccactggctggggcatcactcgcaattcatatttagtaaccggtcgatcaacaaaataccggaaatgttcaacgccttgtaaaacctcttgatcatcaatttcaccagcaactagaatagttatagctgatgttttcataacttgttgataaaaactataaagtgattttgaatcaagctcactaatctcacggccactgccaagaagaaagttcccgtgatcaggatcatttggataatacaacttctgtaattttagaacggcatagtactccttgttatctgcaatggaatttagataattaacaagattattctgatgaatttcaaaatatgcttgattaaaacctacgcctgaaatataaggcttttcgatcatctcttccaagaattccaagatctcggtcattaatcgttccttagagggaagatatttatcatttggaaaggaaatcttaatctggagagtatgctgattaccatatcgcaaaactgtaacaccataacttgcaccatacattcttgataattgtcttgaaactaataactcactgtgatacttagctgaacaattttgtaatagctccgccaacattgctaattttccataattttgagaatgtgccggaaaagtaagattaatcaaaatttttgtattcttaaattttgtcgtatgaatggttcttaacttgacgccattagcaacctgatattccaatgcagtacctcctcaattagtcacaattttcatactagaataaatcgacataaatctcaatattaaatgtaaataataacaaaaaatacaaaaataaaagcatggttataattacacataccaattatggtatcggcaccagcataaaagaaaagatccggttaaaaactgaataaaatcagtcttctaatcggatccatccttagttgtaaaaggcaagtcattattagcccaaatcacaaaactaatgaaaactagttttttatcaaaggactattagcattcgtcccaaaccactttttattgattttggccaattgaccgtttttagctaaccgatcaagtccagcgtcaattttttgtttaagtgccgtatctcctttacgaatcccaactccatagtactcttttggaaattcactgggaattgtcacataactgttccgattcttctgatgaccaatatagtaccccgcataaatactatcaatcaataacccttgaatccgattagcattaagatcaataaatgcatcggtaaaagagtcatataaaattggtgaatgattttttattttatcttttaataatttaggcttttgatcaatatccatagcgcctgctgatcctgactgaacaccagcaacctttccctgcatatccccgaaattatgaatgtcacttttctttttagtcactagaacctgccgattaacaagatacggtttgctaaacattactttctttgatcgctgtggattaattgaaaaaccattccaaatgagatcaattgtcccgtttcttaactctgttacattcattgaccaatcaataggctgaaagtcaactttaatcccatattgcttaaaaacagcttttgccaaatcaacatcatagccaacaatcttaccacttttagttcgaaaacccattggtacgaaactgtcatcaagaccaatcacaatttttttctgcttttgaacaacggaccaagtgtctggattggtatccaatttttttcgattttcatatcgacatcccgaaaggattagcacaaacacaagtaaagcaatgattaatgggctttttttgattattttaaacataattaacccctcttcctaatcgatttgctcaacccgtttaatttcgtcagcaacattttgggcaaagtccatatcatgagtcacaacaatttgggtcatttcttgtttttttaaactaagaataatttcagcaacctcgtcacgtaatgcaggatcaagtgctgaagttggctcatcataacatagaattttggggctcattgccaatgctcgaacaattgctacccgttgtttctgaccgccggaaagctggtatgggtaaaggctttccttaccttccaatcctaagcgcttgagcagctctcttgcatcagttgtcacttttgacaagggttccttcttaaccaatgttggcgctaacgtaatgtttcccataacagttaaatttggaaacagttgataatcttgaaagacaactccgataatcgtatttttctggtcggtttctgccggatcaaatttcgtgccattccagaaaaattcgcctgaattgacatgttccaaaccggtaatacatcgcaaaagggttgtttttccagcgcctgatggtcctacgattgccataatctcattatccttaacggtcatagaaaggtcatcaatgactgttttggtaccaaatttcttagtaagattttttatctctaacattgtaattcccctcctattgccaaacgttggaacgcttttcaatgatcttcaacacaatcgtacatacagcagtcaaagctaaatagataatgccaaccaagattagcgggattaaagtaacatcccgagcagttgcaacatttcctgctcgtagtaggtctcccaagccaatcacataaaccaacgaagaatctttaactaaattaatgacttcatttccaatagaaggtaatacaattttaaaaacctgtggaataataattttgcgaattgtttgcccataactcaatcgtagcacgcgcgcgctttcaaattgtccacgcggtactgattgaaagccgccacgaaaaatttcaccaaaataagcagtgtaattcagaatgaatgcgaagattgcggcatcgtaacgttcgaaaataattcctagaatcggcaacccataaaaaacgaatattaattgcaacagcaatggcgtaccacgcattaaccaaacataaagattaagtaaccagacaagcggtttaaatttgctgattaatcccattcccactaaagcacctagcggaattgaaacaatcagggtccaaaagaagattgataaagtcatttttgttccggataataacgctggtaaaatttgttcaatatattgaatcatgttgacatccctccataaaaaaatcctctcgagttattaaactcgagaggacgatagttttcgcggttccacctcaatttgcaacaagttcacacttattgcctcacgaagtttagttccaaataaaaaatcctcttaagtcgttattgacttaagaggacgattgttgatcgcggttccacctcagctttgttctttgctcatgcaaaaaaccttaaggagtttagatactaaacttcagcaataacgtgctcaccgctttttcctacttgtttcagaaaaatgacttacagatgtgaagcaatacgcctaaacacttgatttccagcaatctcaagctctctgtaatttaatgcgtgttacccttctgatcaatgtctttaacttcttcaattaatgttgaattcataataatcggaaatgccactttcgtcaagaactttttatccctttttgaaccagttgccaattttcttccaaaacgatggctgagtttcatccttaagttccattagcggaacagattccccttccagacgccgagcaatatctcgatatccttgaccagccggattatcaggctgtaaaacaattggctcaccatgatttgaagtcgaaattaccgcatcatcatcaataatgattcccaataattccacgcccaaatgatgcgtgatttcatccacatccatcactgaaccatctttcatcatatgctggcggattcgattaataatgaggtgtggagactcttgaagtggatgctgttccaacaagccgactacccgatcagcatcacgaacggcggaaatttccggagttgtcacaataatagcactatcggcaccagcaatcgcattcataaatccctgttcaattccagcgggacagtcaattaggatatagtcaaaatcgggctttagttcatcaacaatctcgaccacttgatcttgatttaaggctgacttgtcagtattctgagcagctggcaagagatagagtaaatcgtcgaagcgtttatccttcacaagtgcttgcgcaagcttggctcgaccagttgcaacgtcaacaatgtcgtacataattcggttatctaagccaagaacaacatctaaatttcgtaacccaatatcaagatccagaaggcacacttttttgccaagcattgccaaagcggttccaatattagccgaggaagtagttttaccaacgccaccttttcctgaagttattacgtacgacttacccattcatgactcctcctatctgattaaagaactttggatttatctgttttaaagcttcaactttaccataatcaagtacgtgtaaatcattcacataaataaccgtactattatcaatttttcggtttgtatcatccaatatctcaaactgttcaccaattcgaacttgctgagcgttatgtacatccccaataatcattttatcttcaaaatctggtgttccagcctgaataacccctcgaacatcaccgagcacataaacgttaccactcaccagaagcttaccgccctcatgaacttttccgagaaataatacatcgccttgtacatgaacttcctgaccatttcgaataattcgatcaacaatatggacactttcttgttccaaaattcgattggattcttcctttgtaatgacatcggaagtgatcttatggacagaaaaataatcataattggcaaatatcttttcaatttccgatcggtcatctgccgaccataatcgcataccggtataaatgtcaaacgcaattgtttgtggatttgcagaggccgtctgagttcttaagttatcaagtagatgatgcaacgagacaaaaatgtcatcgaccttagcattatcatctaatataatttcgtacccatctttggttccctttaataccgccggatcttgcattgtttcattcgccccctcttatcgtttatgagacctgtataatgccccaatcggaaaataagataatgccataaagacaagattgagagctaatgtcggtgccagcgtatttaccataaattctgagatagaagcgtcagcctcaccgataaacgcgtttgcaacaaatcccagactaactaaaactgtaattcctaaaaaatacaccaaaaagccactcaaaaagtttggtggcagcatttggtatactgtgtaacaaagataaacaaccagtggaaagataaacacatacacaccaagcaacccggtatagtacatatcgaatatgaaaccaatcactgcagcccataattcaagatgcaacttttgggtattgccaaagaaaacggctaaaatcagccatagcaatgttaaattcggcaccaatgcattaggatacttaaataaagttcctgaaaacatttggctgattgaaccgtccagaaaaaaagcaataaacaagccgatgataaaaatagcagcgatcggaactcttcgtttcaattattatccctcctattaatctttaatggcaatcgagacaacctcgatgtcatttaagtttgcggctggtttaatataaacttttttggccaagccataatcgtcctgagcaactttagaaacagttccaacataaataccctttggaattacgcctcccaagccacttgtggtgacccggtcacccttttccaatttggccttagacgtaatgttccccatcacaattcgattggattgtgaatcataagacgtaataatcccatttactactttgccatcttttccaacaatttgaatggcaaatcgattggaattttcggcagtattggagactaaaacaaccttgctatttgttttattaacttcagcaatcgtcccaattagtcccggtccggcaatcactggcatatcctttttaatgcctgctgcctggcccttattaataatcacttggcttgcccaagatgaaggcgttcttgtgataaccgctgcatttattttttgataccctgttaaagtgttaccaacgttcaattgacgttttaactgcttgttctctcgttccaaaacttgatctttaacttgtgtttgtgtgagttgatcaacttttgatttgagctgttggttttcttgataggtgttaagcaaattcttaacagaaacaaatccgtgatcaataccattcatcggtgttgcaacaattctgtcagcgaaaccgacaatatcattaccaaattgttgaatgattggcggtgtattccgcttgttccgaatagcaaccgacagggtcatcattccaaagctaatgatcaagcacacaatgacaattacaagttttcgactggagaaaaatttttgcataattgcctccattcgttattcataacaaacaagccttaataatcaaaggcttaagtgtttattgctttttcttcatgacattgatgctctttagcgattcgccggttccaatagcaacgcagtctagtgggtctgatgcaattgaaaccggaacctgggtagcatcagcaatcacatctgttaggtttcgtaaaagcgcaccgccaccggttaaaacaattccatgatcaattacatctgcagcaatttccggtgatgtttcttccagcgtttctttaattgtcgcaatgatttcggcaactgcttcattgattgcattgttaacatcagtgccgcttacttgaacggttgttggtagaccggttactaagtcacgaccacggactggaacactttcaatcttcttggcagcatctggagaggctgatccaatatcgattttaagctgctcagcggttcgttcaccaattaataaattgtacttctggcgaacatactgggcaattgcttcgttcaacttatctcctgccattctaactgaacgactggaaacaatcccacccaatgaaattgttgcaacatctgtcgtaccaccaccgatatcgacaaccatgctgcccgttggatccataacaggtaatccggcaccaattgcggctgcaaatggttcttcaatgacataagcatcacgggcacccgctacacgcgttgcatcaatcactgcacgcttctcaacagcagtaattccagtcggaacacaaaccataacatatggtttaccagatgaatgtcccaaggctttttgaataaaatatttcatcatcgcaactgtagtatcataatcagcaattactccgtccttcattggtctaacagcatttatactgctaggggttcggccaatcatggcacgagcttcttcacccacggcaataatctcaccgttttttgtgctcttggcaaccactgaaggttcacgaaggacaattcccttaccttcaacataaacaattgtatttgcggtcccaagatcaattcctatgtttttttccccaaatccgaacacgttatccatcccttcgttgtctctcatgtttttgacaggcacatttaattcgatttgttagttattaattgattattgtttaacgaaacaagtatatcataacgagttaaaaaataaatcaattcccaataatcaagcaatgatttaatagattattaaattacggccggtttgtctctaaatacttgcgaacgtcggaaataaaatatagtgatcccgttatcaaaagcatatcatcatcgtgcattttacttaaagttgatttaatcgcatcacgccaatttttaatggttgttacagtttcaccgtctttgataacgtgatccttaacttgatccggatttgccgcgtgacggttacccggacctttaaagctcgttaaaataatcgacgcgtttgaaattgtccccattttctctaccattttgtctgcctgcttgtctgcaagaatccccattaagataaagacgtgtccggttgtaaagttcgtttgaatcaacgggacaatttggtctatcgcagaaatattatgggcaccgtcaatcacaatcgtcggccggctgcttatcttttcgaagcgaccagcccatcgcgtttctttaataccatcaatcacactttgacgattgactaccgaatgggtctgactacaataagttagataagcttgaattgccaacccagcgttatgtgtttgataatcgccaagcaaactggtttgcagattattaaaatgaaacgtccccgcctcaaaatcaaactgctgaatccaattttgaacgcccctttcgactactctaaagtcaatattgaacatttgaattggactttgtttctcatgggcaacgtgtttaataacgttaagtggctcaggaggaatgtttccaacgatgaccggaacccctgatttaataatgccggctttttgatacgcaattttaggcaaagtgtctcccaaaatgtgcatgtgatcccagccgatggtcacaattactgagagctttggcaaaacaacgtttgtcgaatcaagcaaaccaccgagacccacctcaatcaaaacaatatccgcatgtccttccgaaaaatatttgaacatcatggcagtaataatttcaaattcagttggcccaccttctggtaattctttatcaagtttttcaacttcaggataaacaaactgagcaagcctgagaatctccgcatcagaaattggaacaccgttcacgctgatccgttcattaaatttgattaaaaatggtgacgtaaagctgccaacggtatgaccatcagcctgcagaatatttcttaaaaaggctaacgtcgaaccttttccattagttcctgcaatatgaatcgcattaatctgcttatcaggtgcaccaagatcatccagaaatcgacgcatccgtttcagtgtgggaatctttttaaattttgtccgaccatggataaatgataaagcttcatcatatgagttaatcatcgttcaactttttctccttaaataatcacgtaaaccgtaaccaagaaaagaggcctaggcaaaataacttttgtcccggcctcttccttgttgcatgactaattgttccagaatacctaattcaagttacaattaaagttcatttgcaatctgttgcaggcgatctttggctgcatccaattttgattgataatctgcttgtttcgtacgttcttcgttaacaactgtgtcaggagcattggcaacaaacttttggttagccagttttttgtcagaacgtgcaacctcagattcaaacttgtcaacatccttttgaacccgggccttttcttcgttaagatcaaccaactcagctagcggtacatagattgttgcgtcagtgataacggcggacattgaaagcttaggaacatcaaccttttcactgattgttaattctttcgtatggcaaaaacgatcaatgtagtctcgattatcttcaaaaaccgattttagtgttggattatctgtctgaaccagcatatcaattggtgatgataaaggtgcatttgcttcagaacgaatgtttcgaaccgctttaatcagatcaatcagagactgcatctcgttttctgatttaagatccgtaaagtcatcatgagtaattggatattctgcagtaactagtgacttgccttcatgaggcatcttttgccaaatatattcagttacaaacggcataattggttgcaataaccgcaacgtttggtcaagaacatatgccaagatattctgggtattcttcttgagcttttcatcgttaccgttcaaagcttccttactcatttcgatgtaccagtcacagaaatcaaaccaaatgaagtcatataatgctcggccagcctcaccaaaattgtacttatcaaatagttcggtcacatggctaatcgttgcattcaatcggcttaaaatccatcgatcagataattgccactcggatttttcaggaagcgttggcttatcaatgccatccaaattcatgataacgtaacgactggcattccaaattttattgataaagttccaagcagaatccattttatcataggtaaatttcaaatcctgacctggtgtcccaccataagctaagaaccagcgaagtgcatctgcaccgtatttatcaataacatccattggatcaatcccattgcccaatgatttggacatcttacgaccctgagagtcacggatcaaaccatgaagcaaaacatccttaaatgggcgacgttgagtaaactccaagctttggaaaatcatccgggaaacccagaaaaagatgatatcatacccggtaactaatgtatccgttgggaaataacgtttcatatcatctgtatcttctggccaacccatcgttgaaaacggccagagtgcagacgaaaaccaagtgtccaaaacatcaggatcttgggtccaattttctgaatccttgggtgcttccatcccaacataagtttcaccggtttttttgttataccacgcaggaatctgatgcccccaccaaagctgtcgtgaaataacccagtcgtggacattctccatccaatgttcaaaggtaccttcaaaacgatcagggaagaaatgaactttatcgttagtctcttgatttttaatggcttgttcggctaatggcttcatcttaacaaaccattgtgttgacaaacgagcttctacttgaaccccagttcgttcagaatgcccaactgaatggacaattgggtcaattttcaacatcaatccctgatcttgtaaatctttgaccattgcctcgcgggcatcgaaccgatccattccttcatacttgccagcattctcattcattgtagcatcttgattcatcgtgttaattcgctgaagatcatgacgatttccaaccttaaagtcatttggatcatgagcaggggtaattttaaccatcccggttccaaaatccggatcaacatactgatccgcaattattgggacttctcgattgattagaggaacgagaactttcttaccgacgattgacttataacgatcatcacttgggttaacagcaacggccgtatcacccatcatcgtttcaggacgagtagttgcaatttcaatataatccttaccgttaaacttggttccgtcagtaaacggatatttaacgtggtaaaaggcacctttatcatctttgtgaataacttcgatatcggacaacgcagttcgggcttctggatcccaattaataatatattcgccacggtaaatcaatcctttattgtaaagatcaacgaatacttttctaactgctttagacaatcctttatccaaggtaaaccgctcacgttcataatcaagggagaggcctaactttgcccactgttctttaatggttgccgcaaaagtgtctttccattcccaaaccttctgaacgaacttttcacgtcctaaatcataacgagaaattccttgtttacgaagcttggcttcaaccttggcttgagttgcaattcctgcatgatccattcctggaagccataacgtatcaaagccctgcatccgcttctttcggataatcatatcctgcaaagtcgtatcccaggcatggcctaaatgaagttttccggtaacatttggcggtggtaaaacaattgaaaatggttttgccttcttatcaccactaggtttaaataccccttcatcaagccattcattatacctgccattttctacggcagttggatcatactttgtcgacatttcagtttttgattttgtgtctgacataacgtcgcccctttctcttatgtaacaaaaaaacacctcatcctgtaaaattaggacgaagtgttcgcggtaccacctaaattgggccaaaagccccacttattatcatggtaacggttagatatacccgacccgttctcaaaatttgaacgagtagctcacaagttactttctcacaacagtcggtaaaaatctctcatcattgattttctttctgaaacctcactggcggatactctcttgctcaatgcattaatttaattttaatcttacccaacaatcggctaatcgtcaatacgctttgccaatttttctaaagccgataatgcgtcttgatagtcaggttcatcagtgatctcaggaacaatttgacgataaacaatcttaccggtctgatcaacaataaaaattgtccgagctaatgcgccaaaatttggcatatacagtttcattgcatacccaaatgacaagctctcgtcagataatagttgtaagttttcgactccttgagcagcacaccaatctttttgctgttcaatcgtattattggaaattgtcaaaaaacgggcatccggatatttatcagcttcttgattaaaccgtcttgtctcgactgaacaaaccggtgtatcaatatccgggaccgtcgaaataagtgtaattcgaccaacaatatcagccgttttaaccttttcagattcggcactttccagtttaaactttggtaattgttcgcctacttccggcgggttaccaaataatttttcctctttaccattgatagtgacttgcatcaaaaacactcccttggtggttgaataagcttatacacaatgtagcccattcgaccgaattgcgcaagtattctgaaaaagtttaaagcaactcggcaaaaacatcttcattttgattcataaattcatcgccgggtttaatatcggtaattttaatgccatccatcgcccgttgcattaatccatcaacatcaatatagccctcaaatttccgcgatttttctaaattcgggtgagttttaggagctggcggtgtaaaaattgtacaacaatcttcaaagggcagaatcgataaatcatatgttccaatatttttggcgattttgataatttcggtcttatccatcgatactaatggtcgtaaaacaggcatcgtcgtcacatcattaattgccatcatgctttcaagtgtttgcgaggctacttgtcccaatgcttcaccagtgaagacacccgtacaatgtcgatttttcgtgatggcagctgcaattcttaacatcattcgccgttgaatggtcatcaaataaccttcaggaactttttctttaatcgtttcctgaacttcagtaaatggaacctgaatgaactgaatattacctgaatattttgccaaaactgacgtcaattgttttgccttatttaaagcttgttcgctggtataaggcgggctgtaaaaatgaatcatatcaatttttacgccacgtttcattgcttgataagttgcaactggggaatcaatgccaccagaaagcatcattgttgcccggccgccggtcccaacgggaaggccaccagcaccctgaatcttttcagaagacagaaaagcgccgttcatccgaacttcgactcgaatggcaatatctggatgcttcacatcaactgaaattccatcaacattcgtcaaaacatagtcgcctagaatgttgttgatctgattagtattgtaatcgaaatgtttatcttgtcgacgtgtattaatcttgaaagttgcgccttcccgatattgctcacgcaccatttgcagtgcagtttgtttgatggcatccatattcttatcaacttgaatagaaggatagaaattttcaataccaaaaacgcccttcaaagcattaataacggcttcatcatcttcatcatttaatgaaacatgaagtcgatccctctgggcttttacctcaagatttgggaatgggtgcaaaacagcacgaacatttttaccgagttgtttgatgaaatcttttcgattctttcccttagttgatagttcgccgtaacgaaccataatttctgaataatgcatattttctcctaacttaatttgtcaaattcttcatacaactggtcaaaaacttttacgaattgtttggcttcatcaagtgtattttgatcacccagagaaattcgaacggcactggttgaaattgagtccggtacatgcattgcactcaacgtactggaaacaacatgatccttggatgagcaggcactggttgttgaaatataaatctgatatttttcaaatgcatgaacaatcgtttcgccacgaacccctttaattgcaaaacataaaatatgtggggcaaaaccatcgctattttttgagaaaatagtaaccttatcaaatttgctaatatgatcggttattaaggttttaattgcccgctcggtttggtttgcctgtggctctttagcaagtaacaaacgtaatgcttttgccattgcagcaattgccggtaagttttcagttccagagcgttgatttttctcttgcccgccaccactcatcaacggtgcaatttgtcgacctcggcggccatatagaaaaccaatcccgcgtggtgcatgaaatttgtgaccggaaaaagtaataaaatcaacgcgatcattgaaaatttgattctcaattcccttaccaattccctgaaccgcatcaatatgaaaatgaattttaggataactttttagtaattcagccgcttctttaattggctgaatcgttccaatttcattgttaactgccataattgataccaacgttgtgtctggccgaatagctgcctttaaatcattaactgaaattcggccttcttggtcaactggcaaataagtaatatcgtaacccagctgtcgaagctgttccattgaattgtgaatggccggatgttcaactgctgttgtaatcaggtgctttccaaattcccgcttttgaattgctgttcctttggtcacccaattgtcgccttccgttccgccacttgtaaagtatatttcatcaggatgaacgtgaaccaagtcagcaatttgttttcgagattgttccaacaaactaaatgcttgctcgccaaaattatgcaaacttgagggatttccccaaattcgttgactaactttatcgtacgtatcaactatttctggtagtgcttgcgtcgtggcactgttatcaaaataaatcatttgaaaccttcttctctaaaaaatagtgtctaattcgaataaatataactcacacgataatacacccaaaatcaacgggtgacaactacggtgacactttcacaaaacaaaaagagtcaacctaaagcaattaatgattgcctatgattaactctcttatttatcagccatgggggctacttagttgatgatttttgatcatcttgcctgggccgcgtcacttttttagcattaaagtaatcttcccttattttatcaatcacaccagatgattgcttttccaacgcaatcgaaattgtgtccaagctcttttgataatcgtattgatgatcaaagtaaatccgtgccttttcacttgcttcggcaatttcaggatctaaattaataaatcgattggcatattgcatcgtttcttcagccaaagccgcattatcaatgagtttctccgtgcgatcgttcaatgtatccatatcagattgaataataatcacttgcttagaaatatcatcaatatcaatctgtggtttactcatcgcatcattcagatgattgatttcgcgaacaacagaggcaaaatcatcctggtaatcgtctggaagccctggcaaattgtggttatcaattcgacgctttttattacgcatttcgaggtcaaatttagccaatgattggcgtgcttcctgctctttttgtggcaattgaataatagtctggaatagttgtttttgtaacgtctcaatttgtcccaagtttttaaccattgcctgctgctcatcgtcaataaccgaataaacagccttgcctgtcttgatctcctgggtttgattatcgaattgtttctcaattgttgagatttgctgatcatattgatgattattttcaatttccttgtgatttaacacataacccttattcaggttttcaagtcgaagtgccaaatcactattctgccgacgaacatgatcaatatattcatcaaccatctttgtgtttgcttcaacatccggccgcgcttttaattcatcttctaatgcatcatataagtgatcaatcgcaccagcaatttgatcattggttttctgaacactttcaacatttaaggctgcaagtttatccacattatttttgatttcttcacgtaacgtctcgattgtttccataaatgaatcatttggaaaattgtaatgtttcgccatcatctcctgataaccagtcttgatttcgtccagctgatcaataaactcttttgaaagcacgtgataaagctttgggatacttgccatatccgactccaattcagatgttgaccggtttaagtcggtcaatacttcctcagcactattaggatccccactcttggtaagctcggtaaattcatcgaatgtcccttcgatatcagccaacagcttctcaagagcatcgatactcggaccaaaagattcattttggttaagcatgtcctctcttaaacgcttatactttttttcaagttcatcaacagccaaatgatgctgtttgtttaaatcataaagctgagccagagcagcctgaattcccttaattgtgctatcggcatcttgaatggcctggttagcactttgccagtcattcttagttttaataaagttaatccccttaccatcctgcttgacagttgcaattttttgctcaatgcctggcaataattgatctgtataatgttggtatttttttaataattcatcatattttttctgcgattcacccgtcaagtttaatttcttagccaatgtaaattcatcatcaagcggaatcttatttaaatcccgtttgttttcatacacatcagttgccattttaatcgttcttctttgataaaacacaaatcctaggtagcaggccccaactaccacgataattcctatcagcaaagcaagcatttgatcccatccttcaataataaagattttaattgtacgttattatagtaaaatgatgcaaaagcatttattatgtattaataattagtgaaaagtactctaatttgaattatatcatagtagctaggtttcaccagataatttttaaagtgaggaaaacattatgcaaaaaatgacaaatttgctaaatcagcaattggatgcattgctcgaaaatgaaaccgacattgtttcaaatatggccaatgcctctgctttactaaatcaatcacttgagcaaatcaactgggtgggcttttatcgatacgttaaaaatcataatgaacttattctcggcccattccagggaaacgttgcctgtatgcatattaaaaatggtgatggagtctgtggtacggcgtttactgatcgtcacccactccgagttcctgacgtccatcaatttgccggacacattgcttgtgatgcaaattcaaaatcagaaattgttattcctctctacaagcaagaaattccgattggtgttttagacatcgactcgcccgttcttaaccgattttctgaagacgatgaacgtatgctcagtgagttcggaagcgtcttcttaaaacatgtggccttaagttgacttaatgtcaaaaaacttatacaatgtcctttgtgtaaaataatgcagcggtaggcggtaagctcgtcaacatgttgttgccattcatttggttctgcaagtaactcaatcggctgcttgagcgaacgagcaaagcaacatgcacgaatactaagtctgcaatgggttattttactccaaaaaaatattggaggatttacttatgtctagatatacaggtccaagttggagagtttctcgtcgtttgggagtttcactttcaggtactggaaaggaactttcacgtcgtccatatgctcctggcgatcatggccaaggccgtcgtcaaaaactttctgaatatggtttgcaattaaaggaaaagcaaaagcttcgttatacctatgggttaactgagcgtcaattttctaatttgtttgtccgtgctggtaaaattcgtgaaggtaaacatggtgttaactttatgattttacttgaacgtcgtttggacaacatcgtttaccgcttaggtttggcaacaactcgtcgtcaggctcgccaattggtaaaccatggtcacatcacagttgatggcaaacgcgttgacattccatcatacgaagttgaagttggtcaagttgtttctgttcgtgagaagtccaaggatcttcaaataattaaggatgccgttgaagctgttgtgggtcgtccacaatatgttaatttcgacgctgataagcttgaaggatcattggttcgtcttccacaacgtgaagaacttgacgctgatattgatgaatcacttattgttgaatactacaacaaacttggttaatttattggcaaaggtgttccacagaaatgtggaacactttttttattctaatcattaatttggttggattaattttcaatcattattcacaatagcactcaatcatgattgacagatgttataatttattttacgcgaatcaaacctgatcaattctataaaagtttagaaaggagcttcctgatgcaacaacctttggcttatcggatgagaccaacaaaaattgaagacattgttggccaacaagacttggtcggccctggaaaaattattagtcgcatggtgaaagcaaaaatgttatcatccatgatcctttacggcccccctggtaccggaaaaaccagcattgcaagtgcgattgccggttcaactaaatatgcttttcgagttttgaatgctgctaccgatactaaaaaggacctccaaattgtggctgaggaagccaaaatgagcgggacagtcgtgttattacttgatgaaattcatagactagataaaaccaagcaggatttccttctcccactgcttgaaagtggctcaatcattttgatcggagcaactaccgaaaatccctatattaacattaatccggccattcgtagtcgagcccagattttcgaagtccacccactgacccctgacgatatcaaactggcagttaaacgagccttaaaagacaaggctaacgggcttggcaactaccctgttcaattatcggccactgctcttgacttccttgcccgcgcaaccaacggagacttacggagttcactaaatggattagaactggcagtgaagtcaaccgagccagataaaaagagcggagacattcacatcactcagaccatcattgaagaatgtctccagaaaaaagcgctaagtgctgacaaaaacggtgatgcccattatgatgtcatttccgcctttcaaaaatcaatccgagggtcagacgtagacgccgccttacactatgccggaagattaattgagtcgggcgacttaatttcacttatcaggcgactactggtgattgcttatgaggatattggcttagccaaccccagcgcttgtgaacgaacagtgcaggcagtcaatgctgccaaacaacttggacttcctgaagcaagaattccgttagccaacgtcattatcgaactctgtttgagtcctaaatccaattcagcgatgacagctattgataatgcgttgaaggacgttcgggccggcaattatggggaaattcccctccacctcaaagatgctcactataagggagctaaaaaacttggccggggggttacgtaccagtatcctcacgactttccaaacgattgggtaaaacaacaatacctgccggacaagattaaagacgctgaatattactatcctaaagataatggtaaattcgaatcagccttcaaggttcaatactttaaactcagacagtcatcaagacactaatcaagcattggagtgacaaacactatgatcattactattctggttgggattgcaattctaattgccctatttattggctattacctgctttcccatctcaacaagcaattattcaacatccccgtgcgggataatccgcaacttgaaaaaacaaccaaatttggtggattcacttttatcattttggctattcttggattgattgctttatttctccaaaacgatatcttaatattaattgttctgctatgtacaacggttaccggaacacttatagaaattattatcatgggaattataagtcggcagaatcgataagtgaatttatttctttgtatttaagtgaaaataacgtacaattaagttaatagatgaataaaggggtgggcacaatgttacaacaatacaaacaaattctagtcccagtggacggctcgtatgaggcagaattagcttttaaaaaaggtgtagcagttgcactgcgtaataatgcatcacttcacttagttcacgttgttgatactagagcattccaaaacatttccagctttgacacgtcaatggtggaacaagtcactgatactgctaaacagacgcttgataagtacgttgatgaagctaaacagtcaggtctcaccgatgtggactactcgatcgaatacggtgcaccgaaaacggtcattgcacgtgatattcctcaaaatcttaacattgatttaattatgattggcgcaacgggcttgaatgctgtggagcgattgctgattggatcagtgactgagtacgttacccgaaccgcaatttgtgacgtcttggttgtcagaactgacttgaataacaaaccagctgttaatccaagcaaacgtgttgattaataaaaataacgcaactaaaaaatggttcatgacaagacgtcatgaaccatttttttcaagataaattccaaaaacagttattagtaatgttattaatgccatcatccaacgaaacagaacaataatagcccataatcacgctttcacttgaccatcactgaatcaccaagattttttgcaagttctttttttaccagctcaacaatgtgagcctgattttgtttaagaattttatctgacaaggcggtgtttccacgtaactcggcaacaaacattgcagcaaactgtttcattgtcccttgcacaatttgaccctgtgcgtacaaacacttggattctaattcttccaagatgtcaattttataaattgaatttgatttagttaaacgatttaatatattcttacaaagatccaacgcccgctcataatgttcaagctcaacttggaccgcaataatatcaatgtataaatcaacaattgcaaaaaagtcaactttatcatcatttttaatttgatttaaaattttaatactttcctcaataaatcgctccgttcgatcctccttaccactcttttgataagctaatcccaaacctaaattagaccatgcccgataaaaagctaattccgactgcgaatattgagataacattaagttaaaattataaacggcttcttcgatatcatcatcaatatacaagctggcatatccctgataacaatagtacttcccttttgatagttgtgtttctaatttttcaaaggaaacccgaccaattctctcattcgcctgcagataacagtggcgacgcatatcatcttcaatatatgaaaataatcggtcaccataacgagaattatgagtcacatccgtaattttgagatccaagcgatggcagaccttgcaaagaatatctagatttttgtaagaattttggttttcaattgagctgatggttgcttgggtacagatatcagcggctagttcagcttgtgacatttttttcgccttacgcgcttttcggatcgctgacccattaatcatcgtagtcatgtctaataccttattcctttccctaattcgttaactatacagctttattatcatatgataattaaagaaaatctgcaagaattattttcaaaatctcattaatgctcatcttatcaatttctaaactgacaagctaacaaatgatcatttactaccccaatagcttgcagaaaactataagtcgtaacgggaccaatccgctgtaatccaagctgtttaaatgctttcacgtacggttgaataaaataccgatagtcgtcaggatgaagcggtgttactaaataatggtcaagttgggtgaaatgaacaggatcccaagtcatctcaaccaattggcttggattttcttgtagcatcttagcattgtgaacaattgcagcaattttttgatgattccgaatgacctttgaattttcacaaatcaagtcaacgtcatctggacttagctgtgccaggtagttaatcgagaaatggtgaaggacttcatttaatccttcctcatatttaagtatcgtttgaaacgtcaaacccgcttgcataatttccaagctcaatccgcggaatagaccggcagcacttttgactggcttgccccaaattgtatcgtgataaatgagtagctcgggacttttctcggcccatgaacatctgttggtcattgttgacacctcctgtatactaactacggaagtttacagataatccactaataagtttaaaatcagcacccattcatcccgctgtggtttaagtgaaagttgctttaatttgacagcttgatcagttacttgaccatttacccccattaaccacatccgcttcatggaaagttggtgatcgtctgtccatgcatatataggccgattggttttatgaatcgcgtttattacccgcgcatttaaagtaatatgttgtaatgtataaaaatttacttggtaccgattgagatcactaaaattcagcatggttaccaacccaactcgaatttgaggctcccgccgtttaatttgttgaagatatctgtatccaatggaatgaacctgatgatgctgtttaatcaattctgacctaaactgattaataaattgatcccccatcttgggatcagaattgttggtcacttttagttcaataattaacggctgtcgtaaacgattggcaacgcgcaaataattgccaaacacctcgacgtgatgatatttctcgattgttgccaatcttaggtcattaatatccctaagccccttgccgggaattttaacggcatcatcgtgggcacaaataaagtgatgatccatggtttcttgaatatccatttctacatatgggaaatgatagcgactatttttctttaacgcgctaatagtattggcttgactgttatggttaatcacaccacgatgaataataatggtttgattcatcggtttggttgcttggtagctagaaacttgaccattaaagaaacacatcaagacaagcgaaataaacgccaacacaaacaatgtaaaagagggtttgaaattgatcactctaatttctaataatcggcaaataaacaaaatttcaattaaagccaagctaaaagtaaggattcctgccgaaacaaaaaacacgatgtggttgttaatcattgaatttagccaagcaaccgcaatgatcattcccgttaccacgatcattaatagcaaaccaaataatgaccattttaacaaatctttcgctgatcccttgcgaaaggtcaactttaagacttttattggatgatcactattttgggtaaacaaggcttttaaataaccccgcaaataaatcgcaactccaattccaattaattctaatccacccagaataaatactagtggccgtcgattaattgtaagccatgtaaactgggagccagacaaaggcaatgaatcttcaatgatgctgctaaatcccaataagccaaacggtaatcccaaaccaaggtataagatataagtcaataaaaaagccagcttcgatttgatcatcccactaagagaacgccgagtcgtttgaaaaaggccaaaatacaacaaccccataaataagatcgcaaaaatagtgaaacaaaaaactactggttcagaccgtgaagtgaacgaaatagctttctgtaacccagctgttatgcaaattatcaccactaatacgtaaataaatcgttgtgacgttactttatccatcgtttcctccaaaacaatcaatcgtttagctcacttttttggtaatcaaaaacggagctgagacaaaaatgattttgtccagccccgttttgtgtaatcatgattattaccatgcaaaagcgtgacctcaaaggccatttcccgccgtgcaaccgaattctcccaatatttaattgcactttggaagttaaaccgccctttgtcccactcagcatcattttccgtgtataacccccatctcaagctgtgtttcaatgaaaggccaacaatcgaaaaacatcagatcacagtaatgattatcggctacttattgtcaacatcttgatcctttggtggcaatggtttgaaatcataaagaatctttgactgccgttcaaactcctcgtttgcaagttgaattaaccgatcaatcaactctgagtatgaaatccctgaagcagcaaataactgagggtacaaactgatgttagtaaacccgggaagtgtattaacttcactgacataaggcttaccatcttgtgatactaaaaagtcaattcgtgccattcctttaagtccaagtgcacgataagaatctaagcccatcttggtgagttgctgggccaacgccactggaattgaaaccggcacatcaaattcaaccttgctggcatccacaaatttattatcatacgtgtaaaaggcatcactggcaggtactttaatggccccaactttagaagcgattggatgatgattacccaaaattgaaatttcgagttcctcaggtccctcgatggcttcctcaactaatactttactatcatatcggaatgcatcccggattgcttcagaatacgcctcttgactctctaccttatggattccaacggatgaaccttgattagcaggtttaacaaataaaatacttcctagttctttacttaaacgctcatacgtatatctttccgctgtaagtggtgttaataattcgtatcgggttgttggaacaccggcaatcttcaaaatcttcttagtaatgtctttatcaaaggacattgcggaacccaaaacgccggaaccaacgtaaggcttttgcaacaaccgtaataacccttggattgtcccatcttctcctaaattaccatgaatgatcggaaagaaaacgtcaatgtcagaaacttcacctaaattcaaaattggcgccaacggattacgcttgtccaatttggatagttcctgtttagctacttcgtcttcgggctcaccatcaaaaactcgagaagaagcatcatgacccaggaagtacccacctttggtaaccaaaaacaagctaacgtcatatttgctcttatccattgcatcataaatattatgtgcagaacgtttggaaacatcatgttcggaagaattaccaccgaagattaggccgacgtggagctttttgttattttccatgatttctcatcctattcgtatagatttcagaaacctcattataccatgtaaacgtatcctacggaataaatacagcatgttttaatggtgctcttagaaaacattcatttacaccgaataaaaagcaacttttaacaacaaaaaagtgcatcccactaataatattggggacacactccttgtaaagataatctgttgtattacgcttttttcaactgctttttggcaaataaataccgaataatgacaatcatgatggcactaagaaccagtagaaatcccatcattggaaatggattgaggacatcattgccattttcaccaataataaatttagcaaagttgacgacccaactcatttgataatgagcgttattggttgcattggcaacataagccatcgtgacaacaccaacgacaggcgtcgcaattaaaataattctttgggtcagcttcgaaaagagtgtcataaaactcccgacagtcattcctgccaacgcgccaaaaactaatagtaacgcgctaaagataaagttaaacgtcacactaacaaacggattatcaaaaaaatctgcataaagtgacatgaacgtgttaaaagtacttgcgtgtgtgagcggcactacgattagataatcataaaacaagttaatcgtatttccaattaaaataagaatgccgtataccgttaattgtgcttcaaaaaaagttttcctagaaataccattttgaataagaaacttaaaattctcataggatagcgttgaaattgcgatcataaaaataccgaataacgctgcaatatgagcgccctttaacaggccaacaaatgaatagtcacttaatgttccagaaataaccgacaaaagcaatggcaggagaaatattattgcaaaagcgaacaaatataattctcccagtaacacgatttgcttcttaaataagtacttcgtcacttgattagttttcactatgcatgctcccttcatacttatttgtcaggaaaatgaataacttctgtaagtcgaaattagatagttgaacggtatctggtaaaggtcgatcatctaaatcaccataaacataattagctttaatggttcccattgtatcatgaccaatgacattcaatcccttggtgtatcgttcaacatctttggccgggccgacaacggagtgagtcttcgcaagcacatcttcaacgggttgatccaacatgatcctgccttggtcaagaacaatgacgtcactaataatattagctacttcctcaatcaaatgtgttgaaataataaacgttcgtggattgtcagaatatgactgaataagctcagaataaaagagctcacgatgattggcatccaagcctaagacaggttcgtcaagtaacacaaatttaactgggacgcagagcgctaaaatgagcttaaaaattgaattataaccagtcgataatttaccaaatttctgattaatatcaatcccgaattcatcaatcaggcgagctgcaaacgaatgatcaaaatcaccgtacattaattcggtatcactaataatctgttttagtgtcgtaccatttgaatataaattaacctcgctcattaaatacattaggcctaattttgtatcgttatcgttgatgttttccgaatcaagttttacatcaccagcgtctggaaagattcgattagtcataatattcagtaatgtacttttgccagcaccatttcttcctaatagtccatatattttgttctcctcaaatgctaaattaatatcttgaagaatcgtatttgaaccaaatgactttgatacatgattgacttccaacacactcattgatcgtaacctcgctttactaacgctaataagtcatcttctgaaatatttaagttccgtgcttccttaactaagttaaccacaaattcttcataaaagctgtctcgcttagcggctaaaattctgccttgagcaccactagtcacaaacattcccaatccacgacgcttctcgattaattgtttagataccgcaatattcatacccttcaaaacggttgccgggttgatatgaaactccttggaaacctcagttgttgaagggatttgttggccttcctcaaacccgccagaagcaattgcgtcctcaatttgttcagcgacttggcggtaaatcggctcagcactattaaattcaaattgcattcgacaccatcccaccactttatttttttacttttcgactttcgtccgtggcacaacaattcttgaataaatcaggactgttaaaccataataaattaaatataacacaacaaaggcaattgcagaccaactaaatatttgataagaaccatataacatatttgattgctcaaacatttggagaccgaaagcaacatcaatcaagccaagaattgccggaagtccaaataggccaaagacttgaatcataatcgagtgcctcaaagctgattttttagtcccaattttattcaacatttcaaaacgccgcttatcagttgtcgtgccactcagaatcttaaacatcaggcaactcgccagcatcgccaagaatgcaattccaagaaaaatccccataaattgaacactggcaaagattcctttaacctgttgatagatactgaatgaaccaggcaacatctcaatatatttagagctggttctttgactctcgagattaaaaattttcgttaattgtttactctgcgaattcatatccgttacagcaacaaccagcaattgtttaggctgtgcctgtatgtgactaaagttgtcatcagaaacggcttttaactgaaaagactgaaactgaggtgcctgcaatctttgagcgcttagatattcttcagattgtgggtctctcagttcattaaggccaattgacttaaccgcagcttttgcaacatcattgcttttaaaataggcatatttcagcggctgtgctttaaattgctgttgccggtaataaacggtttttccgacaaccttttgttgataagtggtttgggttgcgtgatccaaattgttgatcattgacctcattttataagttggatttgtcaaagctaacgcatatgggctattcccagccgctaatttaggagccatttgttggaatccaatccccaccgtgattgcacccaatgcaagtgcaaacaataatgatactaccgaaaggattttggtataatccttaattcgaaatttcagctgcgcaattgtaaagctgttaagtccttttttaccaattgatgaccgttgaagtattgttagtaacataataaaaaatgagttgaatacaaaataggttcccagtacaattgtcaccagcccaattggaattgacataatttttagctcttcaatatcatacatcgcgtagtaaccaccggctaataatgccaccccaagaagtgcttcgatcgctagaattaactttttagcgggcttccaatcactttgctgttgcgattttagcaattgaagtgccgacgtccggaaaaaagtaattgcattcaacgaaccggcaatcaaaaacagaatgatgaaaaggataaaggttgcccgaatggcaggaacataaagggcgtgaaaatgcgttagtgtaatatccaactggctgacaagcaaaccgctgattccctttgtcaatccccagcctaaaataatcccaatgacggttgaaccgaccccaattattagtgtttctgtcataattaaacggctaatcaccgaaggcttggcacctaacatcataaataagccataatcatgtttccgcatactcatcaaaaaattgttggcataaaaaatatagacaattgtgatgagtgacaacagcacagatccaaagatgaacacaaattttgcattttgaccaactcgactcgcagtggtaaacgcattatttgttgagacagcttcaaacatgtaaaaaattgccgtggtcattagcataccggaaaatagaaccaaataatctttccaacgcgccttaagaccagcaagtgaaattttaaacttcattttatctctcctttcttattgctcaaatgtgcccaatttatttaaaatttcttggtaaaattcatttcgacttttgccctgagccgaaagttcgtcaccaattttgccatctttaatgaacatgattctttggcaaaaactggcagaaaacggatcatgagtaactaataaaatcgacaccccttttttgttaatcgaagtcatcgtatccagtaattcacgagcattcttggaatcaagggccccggtcggttcatcgccaaaaataattgatggatttgaaaccagagcccgcgcagcagcaacccgttgcttttgaccacccgaaagctgattcggatatttagacaataattcgtctatcccaagctgtttggcaactttatcaacagctggttgaatttgagaagtcttaacgttttgcaaagataatggcagtgcaatgttttcactggtcgtcagggtttcaagtaaattaaaatcttgaaaaataaagcctaaatgacgagatcgaaaatccgccatttgattagatgttaaatgggtgacatcttcaccgctaatctggaccgtgccactagttggctggtcaagtgttgccataatgtttaacagagttgtcttaccagagcctgaggcacccataatgccgacaaattctccttgcttaactgtaaaactgatcccttttaaggcttcatagggtttagccccgtttttgtcataaattttgtgcaaattagttgttttaacaatttcgtttgtcataatttcctccattggttaattacttatgcaagtaactatatatgcaacaaataaaaatgtcaataaaaaatggttttgaattaacaatcagaattgttaattcaaaaccatttcatttgagttccctaaggtattgttaaaaatgagttagtaaaatcaatcatcaacttaaatgcacagcgggtttgctgatcaagcaatcgttcgtcacgactctatcttatcagtattgatcacgttttgtgtcccacgttctgtaataatggagactagaacgttattgatcatctgaatcttttgctgatccggaatttcaatactgatctccttttgaagttttttaacagcttcttcggaaatttcaacagcaccttgaacaatgatctgtcgtgcggataaaattgcggttgcttgctgcctttgtaacatagcactagcaatttcagtagcatatgccaagtgagtcaatcttgtttccataatgtccaaaccagctacatcaagccgttcctgcaactccttttttagtgcctctgaaacctcagttgaatttccacgcagcgttaaaatatctgtcgcctcatcaaaactatcataaggatattgactggcaatatgccgaatcgccgattcactttgaatttcgacaaattgttcataatcctcaacactaaaaattgctttagcagaatcaacaactttatagacgataacggcagcaatttcaacagggttccctttcgaatcattaaccttgataatcgagctgttaaagttgcgaacccgcaatgaaatcgtttgtttgcttgttaatggaactgtcataaataaaccagaggttcgaatggttccgatgtatcgaccgaaaaatgttaacaccttcgcctcatttggttgaataattgtcagagaactggcaaacaatagatctaaaatcacgatgactgcaccaaggataatcattcccatcgcattttcctgactcccttgccatagcaagtaggcaccaccaataataatgattaaaacaccaattaaaccagcgtagccattaacatgaaatacacttttttctttcaaaataacgcccccaatatttattagattgcaattgctcacaaaccaagtatatagcgcacattgattaattgaaactgtttactccggaacattaagtatccatatttcattcaactcgctgttaatttctgaaaacatctccaaattaaaaaagatcatggacaacaactcgcttgccccatgatctttttagttagttcaaaaactacttctgaattttagcaatccatgatgttgttttatcggcgccgtttaaaactgaaggatcatcctcagcctttttgttcacgtcaataatcttaccagcgactggacttggaatatctgaaacggccttatctgcttcaacattaagtaatgaatcagttgttgataattgtgtcccaactttagggatcgaaacaaacgtaatatttcctaattcatttcgaccgtcctcagttaatccaactgttacaacaccattatcttcatctgtccaataatactttttgtccattataatccacccttttatgagaattctttatcttctccgaacatataactcttattatggtactgcattgacataatcagcccaattccaatcatatttccaatcagtgctgaacctccagcactaacaaatggaagtgggattccggttaatggtaacaatccaatactcatcccgacattttcaaagacgtgaaataagatcatcataataactccggacgagatataagcgtaaaacacattcctagtatcaaatgtaacctttatcatttgataaatcaataagaaatacaagaggatcaaaatacaacttccaaaaaagccaaaattttcaccaatgactgaaaaaatcatatcagattctcgaacaggcacatacacgtgagactgattaaatccagttccaaaaataccaccagacccaattgccttcatactttgccaaagttgataaccttggttactagtatcagatgccggatgaagccaagtatcaactcgggcaaattgataagcttggaaaccgactttttccaaaatccgtctaccagattccgggataactaatgctaaagccgttcctgcaactccgaaaataattgtgaccgatggcaaaatgatcttccaagtaatcccggaaacaataatcatgccacctaaaatggcaaagaaaaccagcatcgttccaaaatcattttgcaatttaagtaaaacggcaattggaattgtccaaagcaacatcttacctaataacagccaatcactttgggcgctgcgaatcggatgatcgtcgttatgctgaacgatcactcttgccatcattaaaatgtacgccggtttcataacctcggacggctgaaatgttaaaccaaatagtgaaaaccaactttttgcaccagtattcaaaaaataaactcgactgtataataccaagacacttgccagtaataatatgccagcccagtagacgattggtgcaactttccataattgttctgagtcaaattgcatgataatgaccaccgcaataattccgatgacataccaaaccaactgagaaaccacttgtttaaggacgcttgtggcacttgaatcatgactggccgcaacgtaaattgaagccaacccaattaatgcaagcatcagaacgcagaaaatgattccccagtcaattcgagaatcactatcctttgtgttctttcgactggtatccaaaaataaacctcctcatgatgagtctgttactaatgatgaaggtggaaatctttaattaacagtgtaactccttcatcaaaagtcttgacatgaaattcttcttggtgggtattggttgcttgaaacttattggtctcaatttgtttaattgtcccaatcagcttcttaccaataaacagctcggaaattgcctcaccatttgtatcggtattatcctttatttcaacattaatactcttattagccttactcattcattctacccttcttgtccaaactcttcaggtgcattgatttacggtactcatcacgagcagccttatttctaaaaatcgtaaaatgatctgggaccggatcatagccaccctttacaaatggatggcacctcaatatgcgagcaacccccataatcaaacctttaatgacgccatgctttttaagtgccgttaccatataactactacaagttggataataacggcatgtaggcggaaataagggcgaaataaaacgttgatagccatgaacaatactaattagaatttttttcaatgcttcacctataaatcagactatttttcgcgactctttagcttgggatttttaatatagtgttccaataaaatgccagcacccttagcaacattatccaaggggctctctgaaataattactggtaccgttaatgcatctgcaatcacttgatcaatattttttaatagtgccccgccaccagtcagcataataccacgatcaacaatgtcagaagcaagttcaggtggaataacttctaagacttccttggcaccgtcaataatcaattgaaccgtatcactgatagcttcagcaatcccattactatcaattgtgatcgcacgtggcatcccagaaacggcatcccgaccacggacttccatttgtttaacatcatctttgtcagctttggcagtcccaatctcaatcttaattttttcagcagtatgttcacctataatcaaaccatgtttttgtttaatataattgacaatctcagtgttcatcttatccccggcaattcgaattgacttgctggcaacgatatcgcctaatgaaataactgcaatatcactggtaccaccacccatatcgatcaccatattaccgcgtggttgaaaaatatccattccagcgccaacagcggcaactttgggttcttcttccaagtaaacttggccgccaccagccttctcagcagcttggataattgcatttctttcaatttcagttacattagtcggtgcacagatcatgatctttggcttggacatgaaccctttaacatctagcttattaataaaataagttaacatttcttcggtaatatcgaagtctgaaataacaccatcctttaatggtcgaattgcacgaatgttacttggcgttcgacccaccatccggtaagcttctgaaccaacagccaatactttacctgttcgagtatcaacagcgacaactgatggttcatttaatactattccctttccagcaacgtaaattaatacgttggcagttcctaaatcgattccaatgtcttttgccatctgtgaacttcctcctgaaaaaactttaatctcaaaaatttattataccacataaaattgatgtttctaacaagcgataatccttgtcgaaataagggatcctgaacaacttcgtctcatataacagcatacataatttaataattcttaatatccatagaccggctaccataagataattggacaaatccaattgtcagatatttataattatcgaaaagaagaggctgtaacaaaatgaatctttgtcccagcctcaacgtaaacttattaatgatttttaagtgattgattcaatacaatcgagtcatcctcatcaacatcaactcgtttaatttgggctcccagactagctagttttttgtgaaagtcatgataaccccgatctaaatactgcaagtttcggacctgagtataccccttcgcaactagaccggcaatcacaagtgcagctgcagcccgtaaatcagtcgcagcaacttcagcaccattaaagtctgtcggtccatccataacaaccgttcgccctgaaattgtgtatttagcattcatacgacgtaattcttccatatgcatgaatcggttttcaaaaaccgtctcagtcatggaactactaccattagcagctaactgaagaatcgtcatttgtggctgcatgtcggttggaaaacctggatgaggcattgttttaacattagctggctttaggtgatcggtcccaattacccgaatgcctgcatcgctttcgacaaccgtcacacccatttcacgcatttttaaaatcaatggtttattatgctctgcaatcgcatcttcaattaaaacatcaccattggtaaccgctgcagcaatcataaatgtgcccgcttcgatccgatcctgaacaacagcgtgatcagttccgtggagcatttcaacaccttgaatccggatctgctctgttccagcgccaatgacattggcacccatcttattcaaaacattcgcaagatcaacaatttcaggttcacgagctgcattttgaataacagttcgacctttcgctagggttgccgccatcatgatgttttgagtagcgccaacacttgggaaatcaagataaatatctgcccctacaagtccattcggtgctgaagcctcaacataaccatcgtgctgttcaatttgggctccgagagcttcaaatcctttcaaatgtaaatcaattggtcgcgaaccaatcgcacacccacctggtagtgcaactttagctttccctagccgagccaacaagggtcccatgacaacaatcgaagctcgcatttttgacacatactcaaaaggtgcttcacttgaaagctttgatgacgcgtcaaacgtaatttcattttttaattcgttgaaatcaactttgacattcaaaaagtgtaatacttcattcattgtataaacgtctgacaataatggtacatttgaaatggttgtctttccttcacttgcaagaatagttgcagcctggatcggcaacacagcattctttgccccgtcaatatgtacgcttcccttaagtggttctccaccatgtacaattattttttccacaagaacgcctccaatttattatttaaccaaatagattaattgctgaatattagtaatgactgagaggaaaaatgagctacaggtgtaaccaatcgttatggatagtaacacgatcagcatttttccttgtaaagcccttaaaggaacatatcgctcgatgtggatttcttgcacactccaaaacgccattgcaataaataaaaaatatgtacccagcgttgcgattgcctgaaggccaaatattttcatttatcttttcccccaattcattgacaactatatcataaagacgcgaacttgtcccaagtttttcgcaggttttcgcgatatccagcgtaaatgtgcaaaccaaaccgaacaaattgttcttgaagctgagcatggatccaatactaattaacaaggttgactattttcttattctacacacaaaaaaagactgatgcaaaacatacgctttgcatcagtcttagaaatttaaaattacattttttttgcggtattaattcgattaattgcgcgacgcaaggcaatttgtgcacggtcaaggctagcttgatcatgtttttgcctagcttgggcaattagcttttccgcacgttgacgtgcattttgtgctcttgcaacatcaatatcgctttgattctcggcactatcggcaacaatcgtcgcaacgttatttgagaattcaatgaacccgccattaacggcgatttcatcctcgttgtcatcatacttaactcgcgtttcgtcaacagcaagcgttgcaataaccggcacatgatttgccatgattccaagttgccccgactgggttgaaacaactatcatgtcagcagtatgatcgtaaacttttccatcgggagtaacgatactaacggtaataactgaattatcagccaattagaatccctccttagtttgcggcactctgcttttcatcatcggcgccatttgtttcttgattcatctttttggcgttctcaacaacatcctcgataggaccacagttacggaaagcatcttctggaatatcgtcatatttaccttcaagaatctccttgaaacctttgacagtgtcctcaactgacacatatttaccgggcaaaccagtaaattgttcagcaactgagaaactttgtgataggaagaattgaattcgacgagcacgattaacaatcgtcttctcctcatcggataattcatccattcccaaaatagaaataatatcttgaagttcacgatacctttgaaggacatgttgaacttccgtagcaacatcataatgttcttgaccaacaatcgctggatccaaagcagatgatgttgacgcaagtggatcaacggctggataaatcccttgttgtgttaatgaacgctccaagttagttgttgcatccaaatgggcgaatgtcgttgctggagcagggtcggtataatcatcggcaggcacataaacggcctgaatcgatgtgatcgcacccttcttagtggaagtaattcgttcctgtaattgacccatttcagtagctaaagttggctgataaccaacggccgatggaattcggccaagcaaggcagaaacttctgaaccagcttgggtgaatcggaagatgttatcaataaataatagcacatcttgaccttcacgatcacggaaatactccgcaattgttaaaccggttaatgcaactcgcattcgggcaccaggtggttcattcatctgaccataaaccatagcagtctttgcaagaactcctgaacctttcatttcaaagtacatatcattaccttcacgggtccgttcaccaacaccggtgaacactgaaataccattatgcccctgggcaatgttatgaattaactcttgaattaaaacggttttaccaaccccggcaccaccgaacaatccaactttaccaccccgaatgtatggttccaataaatcaatcactttaattcctgtttcaagaacttcagttgatggatttaattcatcatacttcggagcatcacggtgaattggccaacgctcagcgtctgggccaaattcagggccgccgtcaattgtatctccaagaacattaaatactcggccaagagtatctttaccaaccggaacactaatggatgattcagtattttcaacttccattccacgacgtaaaccgtcagttccgtccatcgcaatggtccgaactaccccatcacctaaatcaagggcaacttcaacaacaagatttttcttgtcgctaacgtggataaccaatgcagtgttaatttctggtaacttatcgtccaaggagaactcaacatcaacaactggtccaataacttgtgtaactttaccagtactcatgttagttaattcctccatctaaattattatctacttactaagagcttcttgaccaccggtaatttcggtaatttcggtcgtaatcgctgcttgtctagcccggttatactgtagttcaagcgaggaaatcaaatcatcggcattatcagaagccgacttcattgcggttgaacttgatgcgtgttccgacgttttagcatccaaaatagcaccataaaccaagctttgagcatattgcggtaatacgacgtttaatacttctttttctgatggttcaacatcatactcagcagtcatcggtttgacttcgatatcttgactcgcctgaccttgaattgcttcatcgtcaactggaagcattttttcagcccggaatcgagataccatccggttaacaaaatgttcatagcaaacatagagttcgtcaaaattgccagcatcatacattgatgtaattgttttgacaatctgatgaacttcaacgaaagttggtacatcgctaacgccacggtactcataagaaacgttttcgccacgtttcttataaaattccgatccattaccaccaacagctaaaatctggtaatctttggatttaccagaatgttggttaataaactgattggtttcccgaataacgttactgttataactaccaaccatgccacgatcagacgtaataaccaaataagcagttctcttaggtttagattgatcattatcggctgaatgacctgaggatttagttaacccatccagaatgtgagtctgggctaaatgtaatactacagattttacttggcttgcatattccgcgtaatttttagtgtgcttttggatttgattcagctttgcctgtgagaccatttccattgcacttgtaatttggcgcgtcttctttgtagaagtaatccgatgtttaacatcgttcagcgaagcacccatgtaatctcaccctccttaaaaactagtcatttgaagtagctgatgtttgatcttggtttgaggtcgttgacttttggccatcatcctgtttgcttggttcaaatgtttgttcaaattctttaattgcagcatttaatttagattcatctggtaaattaccagtctttgcaatttcatcgagtaactctttatgtgaattgtcaaagaaggcaaaaatctcttgttgatatcgtaaaatatcatcaatggcaactttatccaagaatccgtgagtcaaacaatagagaataataacttgtttctcaactggaactggagaatgaagtggttgcttcaaaacttcaactgttcgagccccacgattcaacttcgcttgagtagcttcgtcaaggtcagaaccaaattgtgcaaatgattctagttcgtgataagaagcaagatcaatacgtaatgtaccagaaactttcttcattgccttaacctgcgcatcaccaccaacccgtgaaacagaagttccggcatcaacggctggacgaacaccagaatagaaactatcggcatccaagaaaatctggccatcggtaatcgaaataacgttggtaggaatgtatgcagaaacatcaccggcttgggtttcaacgattggtaaagcagtcattgaaccaccacctaatttgtcacttaacttggcagcccgttcgagtaatcgtgaatgggtatagaaaatatcaccaggataagcttcacgaccaggaggacgacgaagaattaatgataactcacgataagcatcagcttgctttgacaagtcatcatagacaatcaaaacatgttgacccttgtgcatgaagtattcacccatggttgcaccagcatacggtgcaatgtataagagtgaagcaggttcggatgggccggcagaaataactgttgtatagtccattgcaccgtacttttcaagcgtattaacctgcgcacgaacagttgattccttttgtccgatggcaacgtaaatacatttcatgttctgatctttttgattcaaaattgtatcgatcgcaattgacgttttaccagtcttacgatcaccaataattaactcacgttgtccacgaccaattggaatcaacgaatcaattgatttaattccagtttgtaatggttcaaaaacggattgccgttccataacaccaggtgctttgtgttcaatggcggcgtgcccgtcagctttaatagaacctttaccatcaattggttgaccaagtgaattaacaactcgtccaatcaaatcatccccaacagggacttccataattcgaccggttctttttacagaatcgccttcccggatattagtgtcatcacccagaatcataataccaacatcattggtttcaaggttttgaaccattccgaaaacgccgtggccgaagtcgagcaactctcctgacaacgcattttcaagaccgtgagcacgcgcaataccatcaccaacatatgtaacgatacctgtttctttaacatcgagctcgttcttatagccttgtaactgttgcttaataagagcactgatttcctcagctttaatgctcataagattcacctctttaaatagatatcgttaattcaacaataattctttaactttattaattcgtgttctaacactaccatcgataatcacatcagatgatttaatgacaatcccaccaattaatgatttatcaactttgatgttaaaaataacctttgcagcgccaacccgtttttcgaaagcttttgctaaccggtcgcgttgatcattatccaactctgtcgcagaatacagatctgctcgaacaatctttttatcgttctcatacaaattctgaaactggtcaataatggtcaagatatctggaaaacgccggtaactcgcaaccacctttaaaaaattgttgatgaagtcggatgcattcgttgtgattggcgttaataatgactttttttgatcatcagaaactcgcatatcatcaagaacatcaatcaactttggattagcagcaaaaatctttctgatctcttgaagatcagcgtagccggtttcaagatcatcagaatcactcaaaacttcaaacattgcttttgcatacttttttgcagctgagagactatctaatgtcatttttgcttacccaacccttcaatataagaatcgacaagccctttctgatcatcttcatttaattgttttgaaatgatcttggatgcaatttcaattgataggcttgccacatcttttcgagaattagccaaagcttcttgtcgttgttgctcgatatccttttcggcagaacttttaaggttagatgcttcattacgtgcatcttcaacaatttgatcacgctgctgttgcccattttgctttgcggtattaataatgccactggcatcttcacgtgttttatctaattcaacttgacgctgttgagcaagttcagctgccttagttcgtgaatccttagcggaatcgatatcattagcaatcttatctgaacggttctgcatcatcttagtaattggcttccacgctacaagcttgatcaaccacatcaaaacgatgaaagcaatcataacaaatatcatgtcaccaacataaagctgagctccaactaccgaatatgaaaacatcaattggcacctccttctttgtatatttaactaaactagtcaattacttgttcataactagtaaagcaacaacgaaggcgatgataggcatagcttcgatcaaaccaacaccgataaacatgttactacgaagttgaccagacaattcaggttgacgagccataccttccaacattttggcgattaataaaccatcaccgattgatgcaccaatagcggcaccagccatacaaatacctgcagcaattgctcccataattaataatcctccttaataatcttgctaatcttctaattctatctttcgcgaaatgtataccgaagacaatacgacgaaaacatatgcctggatacatccaataaagactgagaaaccttgccaagccaactccagtggaaatgcagcaatccacatcttagggccaccattcatcgccatgctggtaatcattgacagaagcatttcccctgacagaatgttaccaaacagacgtaaacctaatgttaagaaattagtaaactcctcaaacaaattaacaataataaatggccaaaatggtttaaggtaattctcaaaatgtcccttataaccaagtgttcgaattcccaagaattgggcaagcgtcaaggtcataagagacagggtcattgtcacaaccggatcggaagttggactttttacaaatgtgattcccgaaatgtcaacatgcagaaacaaaccttgcaaattggcaaccaagagaaacatgaataatgaaaagccccataaacctaaacttttagctgcttcaccggaaactgaactgttcacaatgccgttagtaaagtcaacagcatattctaaaacgttttgcgctttccctggcttcatagttaaatgcctagaaagagcaaagactaaggctaacacgatcacacaagcaatggttactgaaatgatattgcccaagttaaacgtcagtcctaggaagttaaaagtagaagtggaccctcctatggtcattaaaatctcacctctttccacgacataatctacgcaagcgaatcaatctggtcatctggtcaggaagacatcaataccaaagtgaaatttgcgatggtaatgaatacatatcagcatccaaatacaattgaaactataccaccaatcaatctaaaattcaaaacaatcttgatagataatgtcccattaaaatgccgtcatgaacacatctgccaaaaggatgtgagttgttcatcattcatgaacaactcaattatgactcaccatgataatccctttcaatgagcatgaagatgaccctaccaccagtagatatgtttatcaaggacttagttagaaaaaaaggggctggaacaaaattacttttgtcccaatccccttttgtgtaatcacgatgattaccgagtggaagcgtgcgccaaagggcaacttcctgccatgtaaccgcctttcgtcccactctccacatgtagcgtgttactttgtcccaaagagccgatcgccagcatcgccaagtcctggaacaatgtaacctttatcgttaagtttttgatcaagtgctgccgtaaagatgtcaacatccggatgcgctttttgaagtgccttaacaccctctggcgcagcaaccaaacaaacaaatttaatatttgaagcaccacgttttttaagtgcgtcgattgccataattgaagagccacccgttgccaacattgggtcaacaacaaaaatctgacgttgcccaatatctgaaggtaacttaacaaaatactcatgcggttccaatgttttttcatcacgatacataccaatatggccaaccttggcagctgggattaaatccaagattccgtcaaccattccaattccagctcgcagaatcggcacaattgccacttttttaccagaaatttgtttggcatgggcaatgccttccggcgtttcaacatcgacatcttccaatggcatgtcacgtgtaacctcgaatgccatcaaattggcgatttcattgacaatttcccgaaattcctttgtcccacagttcttatcacgaataattgtgagcttatgctggatcaacggatgatccataacttgaaacttacccattatttcccactcctttttctatttcgaaataattgtatcacatatattgataggaaaatgtcccaatccgaaaaagacaatgagacatccacgttccaattccgatttaaggtaaattcatctcttcgccttgtctcaatcgattttatcccaaataaataatggcataaaatcgatatgccaaacgtacctttaatcgtccaaaacaaaaaccggaatagcatttgctaactcccggctcttggttttaaaaattaaattcaatccaacttcatttgaacctaaatgcaaaattaattactgcaattcagctggtaaaactaccatatattaatcggcaatcggatgagcttgtgttagtttttcaaccttatcggcaacctcatgtaaattactttcatcttgtggatcattaatcacttgcaaaatgagtttagcaacttggctggcatcttcttctttaaagccccgagttgtaatagcaggtgttcccaacctcagtccacttgtcttcgaaggtggcaaaggatcgttaggaattgcttccttattagtagtaatgtgaactgtatctaaaatgttctgtaaatctcttccatttaaaccagtctcggttaaattaatcgtcatcaaatgattgtctgtgccaccagttagtacagacacctttgatgaggactgaaaaacagctgccattgctttcgcatttttgatgatttgttcaccatactctttaaatgatggttgtaagtcctcataaaatgcagcagcttttccggcaataacatgttcaagcgggccaccctgactacctgggaaaacagccgaattaattttttgggcatatttggcctttgccaaaattaagccgccacgtggtccccgcaatgttttatgggtagtggttgtgacaacatcggccactggaactggatttggatgtaagccaacagccactaaccccgcaatatgcgccatatcaaccatcaaataagcaccgaccgaatccgcaatttctctaaacttatcccagtcaataattcgactgtatgctgatgcaccggcaataatcaacttaggctgcacttcctgagcaattttggcaacctcatcatagtcaatgagctgggtctttggatccaagccataggaaaatgagtcgtatagttttcctgaaaaactgactcttgcaccatgactcaaatgaccaccagcatccaaccccataccgaggatcttgtcaccaggcttcaataaggcggcatatacttcctgattagcttgtgaaccagagtgaggctgcacatttgcatactcagcatgaaaaagttcctttgcccgatcaattgccaattgttcgacaacgtcaatgtactcacaaccaccataatatcgacggccgggatatccctcagcgtatttattggtcagaaccgatccttgagcagcacgaacggcatttgagacaatgttttcagacgcgatcagctcaatattatgttcctgacgattttcctcgttagcaattgcatcccagagttcaggatcttgctgtttataatcgtatttcaactgcaacacctcactaagtttttatggtacaaattgattataactgcttaaaatgcatttgcccagcggatttattaagccgattcatatacgcttcgccaatgccaaccggatcaatcccttgggtaaagattgttttgtattccggatgattgtcaaagtccctcagttcagcaaacaaatcttgagcagccgtcgtggcgtcatttcccagtgagattacatgagcattatccggccattcaattgatttgatcgtgtcatcaaatgccataacgccaaccggttgtggatgctgagcaatccattgggcaacatcatgccaatcactgtccggatccacgatatagacttgggcatccggcgcgtaatgtttatacttcattccgggagccttgggtgtttgtttggcacccacatgatgtaattcatcaataacccgacggtgaatgacggcttcaatatcatccttggtaaccgcccccggacgtaaaattgatggtgtctcaaccgacatatctaaaaccgttgactcaacgccaaccgttgttggaccatcatcaaggattgcggctatcttcccttttaaatcatgataaacatgttgtgcagttgttgggctgggcttgcctgaagtattagcagacgggccaacaattgggacgccagctttggtgatcaggtccaaggtcatctggttgtttggaaaacgaaaagctgctgtatcaaggccgccggtaacagttttagataatgcatccggctttaatttaaagatcatggtgagtgatcctggccaaaatgttttaattaaattccgagcgtcggaacttaatttttgaacgtatttttcaaccatctccacggatgaaacggtcacaattaatggattgtcacttggtcgcccctttgctttatagacctttttaactgcggcttcgttggttgcatcagctccaagtccgtaaaccgtttcggtcggaaacgataccagctcaccttttcgaataaaggcagctgcttgatcgatttcattcgcttttaaaattaacgttttcattctgtcatcctcatttcatttttaattgaaccattcgctggttaccagaaacatcgtgtctaccaatgacgactgcacggggattggcttgttgaaaaagcttaattaccgcttgttcctgatggaaaccaatttcaacgaataatcggccatccgttgttaaatgatcggcagctccccgtgctaatcgtttgtatatcgcaagtcccctatcttcgacatacagtgccaatttaggttcataatgaatcacccgttggtccatatcagccttttcatccgttgagatatatggtggattcgagacaatcaaatcaaacttgccgtgaatttgatcaaaaacatcgcttttcaagaatgaaaccgccacgttctgattttgtgcatttaatattgcaattttaagcgctttgtcggagatatcactgccaaccaaattccatgttggccggttttttttcaaagcaattgcgatcgccccgcttccggtcccgatatcaagaactcgcatgggttgctcaaaagacgttggaaatgtcgctaaaatccaatcaatcagttcctcagtctctactcgcggaattagcacatctgaagtaacgtgcaatgataagccgtagaaatccgctctaccaacaatatattgtggtggcattccgctgattaattgcctaatatcgttttgaaattgttgccactgaataagtggcattggtcgttgataccggatcagcaaatcggttgctgataaattaaaacgttgttccaacaaaaagtcaacgtcatacatatcaatttccgatctatctttaatagcaaaagaagcccacttgcgggcttcaaagtaagtcggtttaattggtttcattagtcaaattctcaagtttctttgcttgatccgataaaatcaatgcatcaataatttcatcaagttcaccattcatgatgcgatccaatttattcaacgtcaaaccaattcgatgatcagttacccgattttgtggataattgtaagttcgaattcgttctgaacgatcaccggttccgatcgcagatttacgttctgcgttatattgatcctgttcttgctgcgcatagtaatcgtaaacccgagccttcaaaattttcattgccttagcacggttttgctgttgtgatcgttcatcctgcattgccacgacaattccggttggcaagtgggtcattcgaacagcagatgacgttttgttaatatgctgaccaccggcaccagaagaccgataaacatcgacccggatgtcttttggatcaatatcaatatcgacatcctcttcttccggcataacaccaacagttgctgttgaggtatgaacccggcctgcagattcagtgacgggaactcgttgaacccgatgagcaccattttcatattttaattttgaataaactttatcgccggaaatcattaaaacaatttccttaaaacctccaacttcggtctcgttcttatcaataacttcaactttccaaccttggcgttctgcgtacttcgaatacatactaaaaagatcggcagcgaacaaacttccttcatcaccaccggctgcaccatgaatttccataatgatgtttttctcatcattaggatcttttggtagcaacataaccttcagctgttcttccagcttcgccttttggtccttaaaatcagagatttcgtctttaaccattgtctccaattcggcatcgtcaattttgccacgcaacatttcttcatcgtcatcaagttgcttggtaacttttttgtacttattatatgcagcaactgtatctcgcaattcgccttcttcttttgaaagcttcatgaacctttgagtatcagcaatcacttctggatcactgattaactcatttaattcatcataacgatcgacgactgcttgtaatttgtcgaatatttcgtccattaataattcctcacttcgttacttaataggtggattatagtagtggcggcgacaaaccgggtagtaagactcattaccccccatttgaatttgctcgccttcataaacaggcttaccattgtgaaaccgcagattcatgatcgcttttttaccacagaaccaacagatcgttttcatttcttcgattttgtcagcatataatagtaagtattcagaaccttcaaacaaatgattttgaaaatcattctttaagccaaacgcaatcacgggaatatgaagttcatccacaatttccgctaattgaaacacatgcttcttcttcaaaaattgtgcctcgtcaattaacacgcagcttgcatgaggatccaactcttgaacgcgctcaaagatattggtttgatcaaaaatcggttccgcctgacgttccaaaccaattcgggattcgatcatcccctgcttttcccgagtgtcaagcgcactggtcataatgataacacttttattttgctcctcatagttatgagcgaccttgatgatttcaatcgtcttgccactattcattgcaccgtaacgataaaagagttgtgccaaattttccacctttttccttaagagatccttctctattatacagaaattattgagaaattcgatagttacggtaaaatcttaacgctaatcggcacgcatatgataaacttaatgtttgattagtccgatacttcatctcagaggagtcattttttatgtcattaagaagttcaattgcaacagctgccggtaagtcctcttactggttcttacacacattctttaagggtggcagttccttacccggtaagatcaccaaaaaacttgatccaaacattttatcaactttaggtcgaaactacgatgtgattgtcatcaccggtacaaatggtaagacgctaaccacagcgctgactgttcaagtactaaaggaaaagtacgaaaacatcctgaccaatccgactggttcgaacatggaacagggcattatcaccaccttcctacacgcagcacccagccgaaacaaacggccgttagctgtccttgaggtcgatgaagctaatgtcatcaaggttacccaatacatcaagcccaaggcatttgttttcacaaatattttccgtgatcagatggatcgatatggtgaaatctatacaacctatcaaaagattttgaacggtgttgctctggcaccaaacgcaaccattattgcaaatggtgacgccccaatctttcatagtaaacaattacctaatcctatcgtatactatggatttgataatcaaccggacgaagacattaaagcaaccccaaatactgatggggtcctgtgtccacaatgtcaacacattctccactatcgtttcatcagttattcaaacctcggtaaatatttttgtccgaactgcggatttgaacggccaaagctgaattttgcactaaacaaaattacccacttaacccccaagtcatctacctttgaaattgatggcgaatcgattaaaattgaaatcgggggaatttacaatatttataatgccttggcagcttacacagttggccgatttatgggcgtaactcccgaacaaaccaagaaggcgtttgaacaagggaaacatatctttggtcgtcaagaggaaatcaatgttgacggcaaactggtcacacttatcctggttaaaaatccggtgggattaaatcaagtcattgatatgatttcaactgataaagatccatttacattcattggcttactcaatgcaaattatgcagacgggattgacaccagttggatttgggacggtgactttgaacgactccctaaaatgaacattaaacaattcattaccggtggtgaacgttacaaagatatcacttaccgactgcaagttgccggtgttaatcctgaaaagcacttagttgaaccggatttggacaaggtagttgaaatgatccccgacgcgccaaccaaaaaagtttatattttagccacgtatactgcgatgctgcgattacgaaaaacatttgcccagaagggatttatcaagggaggcatgggataatggcatactcactaaacgtttgtcacttgtatggtgatttaatgaacacttatggtgacttgggaaacattttagttttaaaatatatggctaacaagatgggtgtcgaattatcatccgaagtggttagtctcgatcaagacttcaacgcaggaaagtatgatattgttgtatttggcggtggtcaagattttgaacaatctattatttcccaggatatccaaactaagaaaaaggcgttgaccaacttcatcgaggacgatggatccgtagttgcaatttgtggtggttatcaattgctaggccattattatattggtgccaatggtgaaaagttattaggcattggcgcacttgaccaccatactgacaaacaaaaggatcatcgattcatcggtaacattaccatcgaaaatgaagaaaccggcgaaaagtatcatggatttgaaaatcaccaaggcattacatttcttggtaagggtgagcgaccactaggaaaagttctggaaggccatggcaataacggtcaagataaaactgaaggtgcgatttataaaaatgtgtactgtacctacttccacggcccaattttggccagaaataatcaaattgcgaaacacgttttgatgaacgccctcaaacgaaaatatccgaacgcagatttaacacaacaagaaacactgaaagtaacgccaacattttagttaaccatcataacaattagtcgctgcaaactagttgttaactacaaaaaggatttgcgcggcaattaaagttgccaaacgcgaatcctttttatttttttaattaataatcttcaccataaatgatctcatttttgaagcagtcatctaggaccataacaatgtgaatgctgtgatttcaacattcagcgcttattgttatagttggcactgcggccgaaaatcgatttcattcacatcggctaatgataatcattatttgcttcacgaataaatgtttgaattaattggctccgccttggtaaaaacaactgattggtcggatgtggatgaacccggttcgacaagaatactaaagcttgctgagcttgcctgtcgataatgatcattgttcccgtatatccagtatgcaaaatatacggatgatctttatactgtcttagaatccaaccaaaagatcgactttttagttggccgggtgtttgatcaataaagaactgatcgagccactcatctgacaaaaattccggatacctcacttcaccaagtaaccatttactgaagtgaagcaagtcgcttaaattagagaataagcctgccgaaccgcaatcggcacctaaaatttgtgcctttggatcatgaacactccctcgtaaaaggcctttgccaacaagattttcagttgggaccacgttagaaatgttacaaggatgaaaagttgtgtttaacatgtccagtggttgcaagacatccttagctattaattgttgaaccggttctcctaaaattttagaggcaatccaacccagaaaaataaaattgtaatcttgatagtgaatgactttgccaatgtctggaccactctttaaatttaataacgcggaaattaaatcgggtttagccaactcatttcgatgcggaatatatcccacaatatcagaagtatgggtcagcaagtgccgaattgtcacttggggcgattgccattcaggcaagtattgactaatcgaatcgtttaatgacagcttgcctaatacaagtaagcgcaatatcaagttggttgtcccaacgacttttgtcaaagatgctagatcataggtctccccagtgtgcaacggcaaacgctcaggaaccaattcctgctgaccaaaattgtcagacaaaacggcgccatgattaataatcccgtatgtcacccctggcacgataccgtcagcgacaagttgatacattgttgcaatcgtttttgcatatttcattaaaccgaatccagcctttctgccaaattaactgcttaataatgtattaccaataaattgggaattatacaagtttgcatagaagccatttttagccatcaacgctttatgactgccgatttcgacaatctggccacggttcatcacgacaattttgtcagcatttttaattgttgacaggcgatgggccaccacaaagctggttcgatcagcagataatttatccattgcagtttgaattaacttttcagtccgcgtatcaacagaggaagtggcttcatccaaaataataatttcgggattggcgagaaaaactctggcgattgtcagcaattgtctttggccttgagaaatattggttgcatcttcatttaagaccgtatcatagccatccggaagttcacgaataaataaatcagcatgtgccgccttggcagctgatatcacctcgtctttagtggcgttctccttaccataactaatgttatcgtaaatactaccgttaaatagccacgattcctgcagcaccattgccatcttccgtctaatctgcggccgttttcgattacgaatatcttcaccacccattttaattgatccggaatttacttcataaaaccgttccaataaattaatgatggtcgttttccctgcccctgttggcccaacgattgcaattttttcgcctggattaacaactaaattaaaggctttaatgagtggctgatccggaacatattggaagttaacctgttcaaacttaacagctgtgtgatcattcggatcaaccggataatcggtttggtttggatccatctccggttcatcaaaaatggcaaaaattcgttcagcagaagcaatggttgactggattgtatttgttaaatttgccatcctggtaattggctgcgaaaacatatttgtatattgcaagaatgcttgaacatttcccaacgtgacttgcccttgcatcacctgaatacctccaataatagcaacaaatacataatccagatttttaattaaattcattagtggaaacaagaagctggaaacaaactgtgccttccaagatgcctgatagtaacgaatattcttttgtttaaaatcatggatggttggctcttcacgattaaatgttttaatgacattgtggccgttataggattcctcgacttgaccatttaaaatgccaagttcacgctgctgggtcctgaaaaacttttgcgattttggtgcgaaaaaactaacaaccagtaagctaagtggtaatgtcagcaaagcaaccaatgttaatttccaagaaattgttaacatcatgaataacacaccaaagaacatgaagaagctggtaatcaactgcgttagactggactgcagcatggtattgatattatccatatcattcacggcccgtgataaaatatcacccttgttatgcgaatcataaaaagacactggtaaccgagtcattttttccttcaaatcttttcgcatctggtaaacaatgttttgagaaatccgggtcattacaacctgctggaccagctgaaaaattcctgagaaaacatacaggatcacgaccataattaaaatctgaataatcttgtcgaaattgattggaaacgactgaactggatttccagaacgcattttacgaatgccaatcataacgcctttaaaaatttcggttgttgcctgcccaagtattttaggcgaaacaatgtccataataactgaaccaattgccataaaaattgccagaataattatcggtaaccaacgccgcgtatatcgaatcagccgccgcgtggcaccccaaaaatcattcggcttagtcacaacgcccctaatcggtggtgttcgcattattcattcccccccttggccaatctgtgaactcaaaatttcctggtaaacagcattggaagcggctaattccttgtggctgccaatgccacttatcttacaatcatccagaacaatgatgagatctgcatccgcaaccgttgaaatccgttgggccacaatgactgtaattgctttcttgatttgaggatcattcttaagggccatccgcaatttggcatcggtttcaaagtccagtgcggagaaagaatcgtcaaaaatatatatttcagccggttttaaaatcgttcgagcaattgccaatcgctgcttttgaccaccggaaaagttgtcgccattctgttcaacgtgataatcaagaccaccgttttcagtcgtaataaattctgttgcctgggcaattgttagcgcataccaaatttcgtcatcggtcgcatccggtttcgcataatgcatattttctctaatcgttcctgcaaacagaattgcctgttgttgattaattgaaatttgttcgtgaaggtcatgttgggttaattggttaactgggacaccattgatttttacaacaccactttcagggtcaaacaatcttggaattaaattaattaaagttgatttaccagatccggtgccaccgataattgccaccgtttgaccagcatgggccgaaaaattaatatcttgcagtgtctgttgttccgcgtttgagtaacgaaagtaaacgtgttcaaaggataatgttccgctctgctgaaccggaaaatcaaccggaattgcaggatcggtgatggtatctttgacggacaagacttcgttaatccgagttgccgatgctgaagcccgtgggagaaagacgaaaatcattgataacatcataaagctaaaaagaatttgacctgaataggtcataaatgcaaccaggtttccaaccgccagtgattgatttgaaaccatttgaccgccaaaccaaataattgcaacattaataaagctgaagacaattgtcacgattggaataataaacgacacaattgtgaatgccctaatccctgtatttgcaaaatctttatttgctgcatcaaaacgacgattttcataatgatcttgattgaatgaacggattgtccgaacacccgtcaatgtctcgccaaaaattaaattaatgcggtcagtcttcttttgaagaactttaaataaagggaccacataaaacatcagcatcccaacgatcaaagcaatcactggtaaggtaatcaggaaaataatcgtcagccggggacttttaacaaatgccatcgtggaagcaccaatcagcataaaaggtgccattaacatcattcgcaaaatttgaaccatcacgttttgaatttggacaacatcatttgttgttcgcgtatctaaagaagccgctccaaatcggttcatgtcggcttctgaaaaatgagtcaccttatcaaacatatcatcacgaattttttggcccattttcatcgattgggttgcggcaaagaagatattgccacccgcagcagcgacacctaaaaaagaaaccaggatcattttgaatccttcctgccatatgtaaccaatgttattttgagcaatccctttatcaatgatatttgatgtaacagtcggtaagtataaatcgctcataacttgtaacactaaaaacaaaactgcccccaaaacagctaggtatgatatccggcttctgattaatttaatcaactcgatccccacttccccaaaacactacaaccagtttgtctattaattgtaacccttatcattcctaagataaagcaactaagcgtactagttggcagccaaccaaactctgataaatctttcatggtatactaattgggagaagattagaatgattggaggaatcatcctttggctagtaattccgatacaatttatcatgttctttcatacattaaggcccatcccaataaagttatgattaatccagacaggtatgacaacgttgttgaaatgtatctggatgatgatgtgaagctgggcaatccagaaatttattttccagaccaaaaactcgaagtgaatcgaatggcatcagagtttatttcaatgaataatgagttattggactactttcatgataaaactgccgtgaaagacaccagctatcatgagttgtggattacaacctctcatctggcaaataagggaaaatatctagtggatttatcatttgaataatcaatcgtcagcgtggataatggtctgttcccccatccaaatgggaatggcaccatattccacgttttttatcattggccgtgactacagtatcggcataaaacgcggatactggcccctctctatcttagattgataaatttacacaacggatacacggaagtacgtgatttttaatcattgggcatcatattcagcacacgcttaataattaagtggatggataatgccaccattaccgttacttcgagttatactttagttaatcaatgagtttatttaatcgcttgtgtgtatcaaattctctgttatcatgaattaagaagcattaacttgtaaacaattattggaggaagttaccaatgaacgtcaacaaaaaagtactctcgagccttctaattgcaacaatggcattttccactggatttttatttcagcaaaccactccaacgcaagctaagacaagtatcaaggttatttggcggcataagaccaaacagacgtcttataaaattgataaatccaaagctaaaaaggcctatgcttattcagcaaaacttggatcaaagaaattcaaacttgctgcatatgcaaataaaacttttaaagtgagttaccagcaaaaaatacgcattaacgggaaataccgtttatattactatgcaaaaaactcgtctaacaaaaaaattgctggttggatttggcgcggatacctcagtaaagttcagaaaacagcatcttcttcatctaatcaatccaattcatccgctaccaataataatgaatccaacaacaattcaaattccggagtcatggataacagcattgccctttctgcaccggatttaaatgacctgatcacagcttcaccggatttggatcctaacagcaaattattaactttaagtgcagcaacctatgcaaagtaccccagcacatttaatacacaatttaacctatcacaatttgcggatagtggtgtttttgttaatcaccaagcaacgatctacgttgctgacagccaattagttaactacgtcgatacggccataaataattggaataatgcacttggaagacaagtctttgttttgggaactcaggccaaccacaccttaacagttaaattcggggatggtagtgcacaaggctgggatggtttgttcagtggtaataccgttgaggttgatactaataactttaatgaccccacttatggtcgaagcggtatttcactatcacctcaattagctgcaaaactgagtagtatttctaaccagtcagctcagttaacagctgatacaaatgctcaaattaaaaagaaccgtaccaactacgagaatcagtacgcggcgcttcagcaaaaattagccagtgccacaacgagtgctgcaaaagccgctgtacaaagacagcttgcagttttgaaatcaacttacgaacagacagaccaatcacttcgagattcatacaatgatcaaattgaacaacttcggcaagctgtccaatatgcttatcaagatgctgcaacgtcagctggaaatcaacaaattaccaattattgggcaacagtgattatgcacgagcttgggcatgcactcggcttataccacacgccttaccaaaatgacgtcatgtatgcgcctgtcagtgacgaacctgatgcaacaccaagtccagtcaaatattcgtggaccagtccagtggatccaaatgaccccaaggcctatcaaacaggtcaattatcatcacgtgatgttgaccgcgctaaattaacaggcgctctgggttattggtaagacatttaattgattaacatatgtgcgccgttaaggggtgaatcattcagcctccagcggcgcactttttatcaccctaaaaagcaaagagattttcgatagtcaaataaatcttgaccttcgacctaggtcaaatgctaagatgtttttaatcaatcgggacaatcattgaccgcctagtaacattacggaatcgtttaatgatccatttaaaattgataataatagtcaaaggtcgtgaataatgatgaatattcaagaatgtgccaaacaaacaggctgcagtaaagatactttaagatattacgatcaacatcacattgtttcccctaaacgaaattcgaatcaataccgcgactactcaaattcggacattcgtctaatcaatacgattcaaaatttaaaacttgccggacttaagttagtagaaataaaaatgattattaatctgatgaactcgcctatttctgagagttgtaaagaaagcacactttcatttctacaagaaaagcgacaattgttccaagcaaaggcgcaattctatcaatcattagatttaatcgcacaagatatcgaaatttcggcacggcagcaagcgtttgcaaatgtccctcacctcattcaaaagataagccttattggaaatcagcttcgactggaggcaacgccaaaatgaaagttctcatcatctacgcttatcccaaccatagcggctttaatcatgaaattctaaagtcggtctcacaacatctaaattccagaaatgaaattcaaattttagatttatataaaacagatttcaacccactcttaaattttgatgctaaccatccacggcgaaacctaaaagataattctcaaatgaaacctttccgagacctgatctcttgggcagacgacttcctatttatttttccgatttggtggtcagggatgccggctatactaaagggcttcatcgatcgtgtctttacgtgtggttttgcttatcaataccacggcaaaagaatggttggaatgctttccggcaagaaagcttggattattacaacttgcaactcaccaattatctttaagccattcttggccgactacggccgagttctccagcgacaaattctgagactctgtggcgttaagcctgttaagctggacatcttatacaacgctgaacattgtcggcaacgatcccggacaaattttttagaaagaattggtaaaaaggctggtcaactgttatgaggttcattaaagctgcctaatacgcaatcattaacaaaattggtattgacaagtggcgcaaaactcgataatataattaactgtaatatttcattgggtattcgccaaattggtaaggcagcggactctgaatccgtaatttactggttcgagcccagtatacccaatactaatttaaccgttgttgcgagtgtgaagacgcttaaacaacggttttcttttacaataatatcaagataccccatcaattatttcacggtttcatcatatttttatcacattaaattcacggctatccactactattttaatgatagtaagaattattctagattaaaggatgacttttatgcccgataaaaaatctaataaaaaaattattgaaaagataaagacattccatgagctaacaattcaagaaaagaacgcgctaattttacgaaataccattcaaatcgatgaccacctccgctttaaagttcgttataatgatcagcatgaattgattaacgttaaaaccacctatgtcgagtagctccctttcttaattagctaggcaaaccaacgttactagattatttaggatctgttgttgacaaacgtttccaaatttcatatactattatagtggtttgagagtattgcccgctggtcaaactggtttaagacgtcgccctctcaaggcggagttacgggttcgagccccgtgcgggtgattatttgaacaatatggaaaaacatgagatcctctgagtgctgattttaaggcatttaggggatttttctttatcctcaaaaacacagaaaaataaatcgggactgattgcaacacctgtcctactttgtctgatagtgcctctaatttcatcatgattatttttactatggaatgatcatcacctatccgcatctttctcaatcgagatcgtgatatcagctaaataatttcgaatacctgtttaatataaaacgctccttgaatatttttaatttttattgacacaaaatccgtaccgcatattataattaaaatattcttgctaattgaagcgtttgagaaaggggttaataattacgaacaaaccatattgctgctagtcatcatagaaattattttaaggagtcctagcgttttctaaagccagttttgcacacgttttagaaaacgctatcattcctacgaatatgactcgttcgtcaaaggcttaaattttaattgagtcatttaatgactaccatctagcagcatattgccaacatccaggtcatgtcaaagatcttttcttgatactaattgttgttttaaaatatcgcgaggggtgatgtttacacacgattatgttgggaaccagttgcacaagcattaaaagcattacgacattcagggggataaatttatgaaattcaagaagttaaccaccatcggggctgcacttttagtcacattgagcttagccgcgtgtggcaataataatgataagaaatcttcacaggaaagtgccaccaaggtcaccgcaaccagtaacaatgaatcatcgactcacaaatcatcctcaaaatcacatcataaacaggttgcttcacatacatatcatgccgtaaaacaacggaataacactattttaaaaaagatgatttacgacaccaatcacgaatctgccggtccaactggtaattattattatgtaatcggcaaagctaaagattccggctttgctgatcttaaacgtggcgaatatcatttcactagtgacagtcaagggcggtcttcaactgctcgcgccgttctaacttattccgaatatcaatcatccaaggggtcacgtcagggcgatccccttgcaccgccttcgtggccgtcagataatcccgaggttgcaattcattatagcttaacaggtcgtacctatcacggctatctatacaatcgaagtcattcgatcggcgatagcttgttaggcactaagtcatacacctctcagtataattttacaaccggaacccgtcctgaaaacgttggcgccaatcagggaggcggtatgcgatatgccgaagaaacggctgaaaactactgggaaaacaatcctggaaccagcagcacaattgaatatgagaccaccccgctttataaaggaaccgaaacaattccacgtggatcaattgttaatattaaatcttcagatggtgccatcaatacctcgattgcagtcattaattcggttgagggaatcaagattaactatgatactgggagcagtaatgcaaaaccaatcacgcacatgcgtccccagatgcatcatcataaatcctcaacaagttatggttatgggaatcgcgacaccagccataagaatcaaagcacccgtcatagtccaaacaatcaaaccgaacattcaacgaccaagcaaggccaatggacagttgctggtgctgggatggtattcgtatcagatagtaacaaattctattcagaagtaaccaatcccggtaattatcaatatatgagcgaatcaaaagctcaaacaagtggtgcaacaagagctgctcgaggaaaccaatacgcccgaccataaacgttcgaaagtcaatcaactaaacttaggctaattgttaagtctttaatttcagaaaaacacaaatggggctgggacaaaagtaattttgtccagccctgctttgtgtaatcacgattattaccgagtggaaacgtgcgccaaaaggcaacttcctgccgcgtaatcgaattatcaaacattcaagcccggaatattcggacaatccgattacgctctggaagttaaccgcctttcgtcctactctcttaaaatcaccatttattctaagttacactatgattctgggctaatctcccagccgttgtccaacatctgatgatatttacgcccaactggaacccaaattttctcttgtaaaattttcttcattgactcccaaaataatggatcttggctttccttctccgacaaattaagtttccaatattgatgatcttccgttttaacaattacaaatggaaagaagaccttaactaactgtgcagcagcaatatttttaatcattttagtatcatcaagtagctgtttcattcgaaatctctcctctactttcaaattatgaatacaatgatattattcaaaaagtagtttaaattgaccttaaatccaatctaaataaaggttaaattttgtccaaataattaatctcaattaaaaagtcagcgactgagggccacaatgaacaatccccctaaagctaaaatcataactttagggggattgttcaacatcttacctcaaccgctgacttttttagttcttccaaaaaataaacactaattttgatcagcatccgcagattgttcatctttttgtttctccgctttcgtctggtctggaataataactgtaaatgtcgtgccctttccaggtgcagactcaacagtaatattacccccgtgctgcttaaccaattggtggacgattgccagaccaaggccggattcaccatacttaccacttcgtctggaggcatcggccttgtaataccgttcaaatatattcttctgctgggcatctgtcatcccaatgccggtatcagcaacccgaacgatcgtctcgttatacccacgttcaccagtaattgtaatcgttcccttatcagtaaactggatggcattattagtgatattaaaaacgatttggacaaaccgatcgtaatcggcgtaaataggtagatccttaggcgcatgcaggtcaatcttatcctttgactccgcagccttattttctagttgctcaactaaattatttaaaacttgagtcgcattaaagtgacgtttatccaactgaattgaatttgagcgaattttttcataatccagattctcatttactaaacggattaaccgttgcgtttcactactcatcaaatcaattgattttgttcgagattcttgcggaatgacatcgtacttaataccctcaagaatccctgagatcgtcgttaacggtgtccgcatctcatgggcagcatcagctagaaattcctggcgacgttcctcttgacgttgaatttccttatcagctttatccaacgattccgtcatatgattaaaatcgttaatcagttcaccaatttcatctttaccactggttttaactctgatttgataattaccatttgcaacctgattggccgcgttccgtaatcggctgattcggcgatttaaacgacttgcaatgaaaaagctaatcaccattgaaatgattaacgaaacacccaatccctttagcaaatcccggttaattcggtcaacattagaattaacatcagaaataaatgcaccggcactgactgccgcaactaatttcttcttataataatacggcttgagcacctcaatcatcgctggtcgcgtttttccgttggttaatcgaaaattcttattgtttacttttctgacaatctgatctttacgtaagtgtttccagtcatttttggtgattttgggtgacatgccgttatttggataaatgacttggtttttagggttaaataccgtaaaatgaaccgattgattttctaataaagcttcagttgtcttaagcgtggggacatcaaacgaaattttattttgaccctttgagttgatggtgagcgattgctgaaccaaactatccgaatacttttccaagtttcgccaagtattatcatacacaaacgttttagacattctagaaaatgaaaagcccaacaataagatggtcaccgcaatgactagaaagaatgacagaagttgctgataaatcatcttcattgttgattatccacttcactatcatcaaatttgtaaccaacaccccaaacggtttgaatcacttgagaaccgacccgttcaactttttgtcgtagttttttaacatgagcatcaactgttcgctcgtcaccgtaataatcatatccccaaaccaactcaagtaattgttcacgggagaagacctgacgcggcttttgagccaacgttttaagcagttcaaattctttaggcgttagttctggaatcatttttccgtccaagtatgcctcacgggtgttactattaagcttaaagtgatcggtcgtaataatgccgtcatccggcttttcggcgcctgattccgaatcagcttgcttctcagcatgagctctgcgttgaagtgctttgattcgcgcaaccagggtgattggtgaaaacggcttagtaacatagtcgtcagcacccatttcaaatcctaaaacctgatcactatctgaatcccgagcagttaacatgataattggcactgttttggacttttgccggatttccttggcgacttccatgccatcttttttgggcaaattcaagtccaacgtaatcatgtcccaactgtccggatcctcattgaacatgtcaacggcttcaatgccatcataagcaaacgagacatcccagccctctttttggaaaaacatctgcatcatctctgaaacagatttattatcttcaatcattagtaatttcatttgttttgtaacccccacttttaatagctaatcgcttctaaattgccatgatgccaatgtttcttaagatgattctgcgaaaccgattccaagcggccggtccacggatcgttgtaatagtatagtttgcggttaaatcctgttaaaataataaaactggatttcaaattatcaactccagcaactcgcacaacgattggccgacgacgaagcagctgtttattaagctggcgaaagtctactcggtttaagtccttaatcgaatgagtttctgaaataatcaaatctcgtaacccaatcaatggttcagctgaatcacgccacttttgcacagcttgctttaatgcctgatcggaaatttggctaccggcatcccgcaacaacattttaagggccgcacactgattatcgatatcggcctgcgtggcttgtttaatgggctcgacgtccagtctccgaaaagttttgcgaatatttcgctttggcagccatcctgataacccttcacaggaaaaatgataccaaatttgtttattaaaaaaactgatttgatcaattaaaaaatcctgagttttaagatcatcaggaattttggttcgatcactggaatccacatttttttcactatcagttgctaaataccagtgttcacctggaattcttcgtaatcgaacgaaaaaacgtttggttctttcgttggcaatggttgttttttccatttcgtctcacctcatatgtattctattttaccaagaaaatgagaaacttgcttgaaaacaagaaagattgttatgatattatagtgttggttttattatcaaccacttttaggataggatggttttaattcatgtataaagcaattacttttttcgatttagaccacacattatttaatgagcaaacacgcgttgaccctgaagttgcagacgccatgcaccaattgaaacaaaataatgttttacccgtcatctcaaccggccgaaacattttcgaaattccagagacgttggcggtcactgggattgatacggttgtttccgcaaatggcgactatgttatttttgagaaccaaccagtttataaagcaatcattaaaccaactattatcacagaatttatggacttcgcaaagtcccatcaggatacaacaacggtgatgaataatgaaggcgctcgaattgattacgttactgacgatacccgaagtaactacaagtcaatcaacacccgaatcccaccactcggtgcccgtgactttattaagagcaacgaaatttatatgatggttgtcagcacggttggccgcgatcaaaagtatattgatactttcaaggatacgctgaccttctaccgaaatacaccttttagtatggatgttgttgttaaagacggctcaaagaaacgcggcattcaagaattaatcaagaatgcccatcttgaaggcattccgacttatggctttggtgatggcaataatgatattcccatgctcgaatacgttgatcatgcagttgttatgggcaatgggctccctgcagtcaaagaatatgcggagtttattaccactaaaaataccgaccacggtatcgtgaatggtcttaaacactatgatctaatctaattacttctaaccctagtcgatgtatgatacaatatattatgtatctatacggggtcgttaaggattcgacgggtataggttgagcttggactgcgttccgtgcggcgtcacgttaatccgtccagtttaaattataactgcaaaaaataataacaattcttacgctttagctgcctaataagcgcttaacgtagatcctcctaatctcgcccatgggttagatctgggtcttaaatttagtgggctcacgcggttggctcccacctgaagtcaactgaagagaccaatcaggttagccatctgtggttgccttgatttgtggcgtttcaaatggtgaaattcaaataatagatctatgaacgtagaggtctaggtggcgatatgctcggacgcgggttcgactcccgccgactccattgataggaaaagactgattttgattaacgtctaaaacgttgataaatcagtctttttattttattactgttcgttttaaaccaaataatttagattcaatggtaagcattttggtaaacacgaaatcaaaaacatatttaaacattattgtctgccgtgaattggtttacatccttctttatgagggatgttttttaattttctgaatcaggatactgtttctgcaattctttcaaatgttcgattgcttttggatctttgagaagcctctctcttaacaatgattcatagaatttttttatcaccaagtcatcttctctttttttaacatcacttactggcaattggacactctcactaggccacaatggtgtatatagtcttaggtaggcttgccgccggcgctcttgttcactatatttttctttggtcaaaatatcgggcttccttctgtttaaaaaaatgctgtcatgctatcaacaaatcattttatgtcaggatacttttgatgcaatctatctaaccggacaaagtcattatatcgtctaatttcatcatttttctttaatgattcaagaaaacgtagccaggtaatttctgattcacgcttaacaaaggggctcactgaatcttgcccagttactgtcgggtaaaacaccccatctcgccgatacttaagtttagtaactatatctctaaccgattttttcatctttacgtccccttttatcaagatacccccaggcccacaagtctcttaatccgaaatctatttatttcacagcattattataaagcgctttcgttaatttgaaaataaaaagtctcccgttggggggggggacggaagacctcatgcgtatcaagatcgcaaggaactttccttacgacaaggtaagattatcacttttattttgatccacaagaaaagcgacgcattttaatgcataaattaagccaccctaagacatacttagagcggcttaatattgttggcgatctgtgttaacgaattgtgaagccgttatgtgcctaatcaatgcttcacaattagagaatacaacccccaaattaggattacaataaaaaacattttcagctttcaaacaaagccaagagaacattccgcctgattgggaaacgcaatacctaaaataacgtatggatcgatattaccttacaacaaatcaaatagtccatccaacgttaaagttatccctcctttttaccaacgcaatgttgtctctgcattggtgaaaaatggaaactcagagctatatgtaatcaccatttaacttaatccaattgaaataaaataatgtacgaataaaaacatattttctcattgtcattaatacctcctgtagctaaaatctaacccaatattttgttcagataccgatctaagttactctcaccccatctatttagttgctttccccatcaatctataatatattgatattaaacttactaaaagtaagcaagggaggaacaacatggtcaacgtaaataacttacatttcggcattgaaacctttggtgacattgtttcagctgaagacggcagcctcttaacagcgggtcagtcaatccgccaaattgttaaggaaggcgagctagctgataaattaggtattgatgtaatcggcgttggtgaacaccaccgaccagattacagtgtctcaagtccagaggttgtactgggtgcaatcgcttccgttactcaaaatattaaactagcaaccgccgttacagtcttgagttctgatgacccaatccgggtatacgaacgcttcgcaactcttgaaggcctctcaaacggtcgcgcacaagtgatgcttggccgtggctccttcacagaatcatttccactatttgggtatgatttaactgattatgatgacttatttaatgaaaagcttgaactatatagccaactgatcaaagaaaagccaatcacctggcatggtaaatttacaccatcacttaaagatcagaacgtttatcctaaaactgactacgctggcttggagacttacatcggcattggtggctcacccgaatccattatcagaaccgctagatatggctacaaagtgatcctagcaatcattggcggccaagctgatcgtttcgtgccctacattgatttgtataagaaagcggccgctcaatataaaatgccgattcaaccaattgcagttcattcccatggctttatcgctgacgatgaggagcaagctgtggccgttgcttggaaaaatattaaggccaactttgaccggattggtttaacccgtggttgggcaccaatgagtcgcgagcaatttgacggtgaaaccaagtcagggtcattctatgttggtaatccggaacacgttgcgcaacggattgcccggacgattaaactacttgatcttggtcgttttgatcttgtctatggtgctggcaaccaaacggctgctcaacgagaacgaatgattgagctttacgcaacgaaagtgattccacgggttaaagagattttaactaaagaggtggtctcataatgagtgaaattaaaaccgtcggcatcctgggagcgggaaaagttggcattgttttggcacaattggccttagcagctcattacaacgttagaatttccggatcaggatccgttcaaaaaattgcgttaaccatcgacacgttggtcccgggcgccacggcggctaccaatcagggggtaattagcaaaagtgacttgatcattttagcgattcccctcagccgttacaaaaatattaatcccaaactgcttaagggcaaattggtcatcgatgcgatgaattattggtgggaaacggatggcattcgcgaagaagtcttggatccgttatcaacatccagcgaacaggttcaaaaatattttaataaaagtacgatcgtcaaaacttttaatcacatgggttaccataatcttcaggaagaagcccgacctgcaggcacagagaaccgcaaagccctatttgtgaccggcgacaatccggaagctgtggatcaagttgccaagttcgttgacagcatgggatttgatacggttgttcactatcatttggcagacggcatcatgaccgaacctgggagtgccttgtttggtgccagtctcacccgttcggatcttaaaaacgtgattaaccattttgatgaaactgatttcggcaagaagattaaagccaatcagaaagtttgatgaatcgcagatctggctaaaactggctaagataagtttttacaactttttcttagccagtttattttagacacgacattttttgattattgatggatttacttccgtaatagttccgcttatccaaaccaatttataaatgtaaatcaatcagccaatcttgtaatccaccggccagctgctataatcaaagtaaaaattatatgatttcgtgatctggggtgcccaaatggctgagaaatacccattgaacctgatgcagttaatactgtcgaaggaagatcaggcactaccagtccgcttgatttttaagtggacttttcttttacttaagttggccccctcttacgaaatcttaggaggactttttatgtcactatctgaagaaatgatcactgaagctcaaccttacttaactgcaaatgaaaagcatccattcgttcagggaatcatcaatggcacattatcgcctcaacaacttcgttactacgatgaacaagatattgcctttgaatacaacgaagtggctgtgatcaacgcacttatcaattatggcaccacaacaaatcaagtccaattatttcaaaaacgattaaccttacaattgaacatgctacgcgactggttaaaacgagaaccagattcgatgccacacgattgggaaagccttaaatggataccaatccagccaatcaatcaattatatcgtcagcatatggcagcaaccattcaaacccataatgttttgcaaatcttaccatccttcgctgcaggtgaatggctatacattgaactcggtaaatatctaaagcatcaaaccagagtcgaccaagaacctttccggagcttcttaactcttggtaaccaagacttcttagggccaaccggtttcattcaacaattttttgaaatcattgatcaggaagctgaaaaagcgtcgattagagaacagcaacaagccaaagcaacctttctaaaaagttgcctgcttgaatggtatttctgggatgcctcatataagcaaattacttgggataactggcaatctgctgcattaactggccaaactggtccccttttgtaggcaactggctaacaagctagcaaattcaatagataaataaccaattgacaaaacagattctatcagttttcctcttgtcatcctagtcagtttcatgctatactgcttagcggtgccaaaccacggtgagttcgtaacgatcggcgcgagagcgttcagaaggtcgaagcggctcgccatttttttgtcgtcaaaatcggttatcgatttcaacctgtaatcggccaagtgctccccagcaccttttagacttgtaagtgctaaactaggaccgttaagaaaccagaaagggggatgcccaaatggatgaagtattacttctggcaattatttttgcagctgtcgtgctggccaacattttagcgcgtcacatcaccaaaataccgctgccgtttttcttaatttttctgggcattttattagcaggattaccagtttataacaactttaatcttgacccatcgacgtttgcactggccgtcattgcaccaatgctgttcaatgaagcccaaaacagctcgcgcttgtggattggccgctcaattactaatattttatcgctggcggttggtctagtcattgtcagtgtcttggttgttggttttggcctgcatctggtctatgcaatcatgccaatcagtttggcttttgcgttactggcaattgtcacaccaacggatgcttccgcagtcaattccatctttgagtcaaatccggttactgaagaacaagctggcattttgcaacatgaatcactatttaatgacgctgccggtattgtgatctttgatatgtcactaaccgcctttatttcgggcacgttttcgatggaagtggcaatcggaacatttttatgggaatttttaggtggcctattgtttggaagtctaattggggtgttgatcgtaagtgcccggttaattttaatccgatacaatgacgataccccactcatcatggttctcattcaactactgtcaccattcctggtttatctccttgctgagaagctggccctatcaggaatcttagccgttgttgccgctggactcgttcaagggtctgagcgtgagaagcttcggttaacctcgtcgcggatgcaattgattaccagcaatgtttgggaaattgtctcagggatgttatccgggatggtttttgttttactggggctttcgttacctgaagttattaccgcaatgcatcagtcacccaaccccaacttcggcatctacaaactaattggaattggccttctgatttattttgtcaaaggggttattcgtctagtttggagccgctacatgattaagcggcgtgttcaaaccaaccgtgagtggcgtgatagtctggtaatggcctttagtggcgccaatggaacgattacactctctttagcattttcaattccaacagtcgttaatggccaaccatttgaatttcgcggtccactaatcttcttagcagccgttgtgattctcattagtctcattatgccaactatttttgtgccattattgttaccaagtcaggatgcggcccaaccaagatatcgttgggttcgtcgtatgattcaagctgccatcactgatctggttaaggaaaaagagtatccagaagaagctcaaattgtgattgattctttgcaacagcaattggttttagacgccgctcccaatcttaaattgcgtcgtcaattaatgagcgagagccatcaagttgaaagagccgctattcaaaaaatgtatgacgagggtaaaattacaaaagatgaacaattttactatggtaagtttctccagctaaacaatttttcagctgacgaaaaaatttggaagaatattctcttacggattcgatttagtttacacattggaacgttatataaagatatgagccgggctcaagatgcttttctgaccgccccggtcgtcctggaagaggtctactggcgtgaacaattccagaaacacggcgaggatattttgccaattgagcaagttggttttgatgccgtcatggctttcttaaaaaccaaagatgccgataatggtgtcgagtctaacatggttaaacgattttatcggactcgtcatcgtcggattcacgggaaagatgttaatgcagatattgtttatcagatgtttatgcgagccttccatagcgaatatgaattaattcaagatgcattaagttccggcaaaattaattctagtctggcagaaaagctccagcaacgaatttcaattgatgaaatgacgtatctacaaaatgtcgaaatgtttagtgattaatttcggatcagttttaattgtcttcaatagtaccaatcaactctcgctttgaatcgaaaaacgggattggttagtgctatttttatttaatctcctagctttgccggcgatggcattcggacatcattttcaatattcaaaaatggtatactaaaagagaaatttcagattacttaatggactgatccacttgtaaaaaagaaaggtgagaaagatgcggcaaactgtcctgttggttgatgacgatcctgatattcttcaaatgttaagtcgctattttttattacgactgcctcagatgtcattactaacagctgattctggcaaagagacacttcaccaattaaccaaaaatcctgatttgattttactggatgttaatttaccagatatcgacggctttacgctcacaaatcaaattcgagccatcacaacagtcccgatcatctttttaacagctcgagtaaccgaccaagataaagttcaaggatttggtgctggtggtgatgattacattaccaaaccctttagccttgtcgaacttggtgcccgggtaaaagcccatcttcggcgagaaaatctgccagaaaaacgggcccaagtggcgatttttgataacattttaattgattacagtgctcatcaagttatcgtcaacgagcaacccttggatcttgaaaaaaagcagtatcaaattgttgccttattaagtttgaatgccggccaagtttttagccgcgaacaactatacgaaaaaatatggggctacgattcgcccggagatgatcgcgttatcaccgaacacattcgacggatccgtaactgttttaatcaatcagggattaattcgccgattataactgtctggggggttggctatcgatggaaagattaaagatgtggctaatcaatcaacccatcaaaaccgccttattacgattaattttgattggaacagtcatttcaggtgttttagttttaggctatctcgttctttggaatctactaatgaatctgttgttacgttttatatccaaatgggtcattacaggcgtttcactttattttatcggcgcaattggcggtagctttcttatcctatacatcgttatgaatttgacagcccgttttttttaccaaattaagatggccagaccgttaaagcaattaaattcaggtgtttctcgtatcaaagcccaaaatttggattttcatttacatcccacctcatcagatgaacttggtagtcttgttgaagcattcgaaacgatgcgtcaagccctcaaatctgcccttcaaactgcatggcaattggtcgatgaacaaaaacaagttaatgccgcattcgctcatgatttaagaaccccaatgactgttttacaaggcagtgttgaactcctcgagcttcaaggagatgatccccaactcattcaggaatctattcacgatatcaaacgacagctggatcgaatcaatgcttttattcaaattatgagtcatctctcagcagttcaaaatatgcaactagtgccatcgtcactaacacctgcaaaactggagggattgctcaaagatgagactaatcaactagcaactgagaaatcaatcgtttggcaagttgattctcgaaccccgacaactgatcaactcaaactgtcttctgaagcaattctggaaatctttgataaccagatgagcaatgccattcggtttgccaaaactaaaataactgtcattcttatcatctcccatgatcaagttgaaattcgagttgaaaatgatggtcaaccattaactcatacagaacagataaatgccaagctcccttatttttcaaatggtaagcacggcaaacatttaggagttggaatgtatatctgcgaaaaattatgtgaagcccaccatggtcactttacaattaataatcaaccagccggtaaaggcgtcgttacagccgcattaatcaaaccattagcttaaatcattacttcttgtgcaattcttgtcaaattcttgatatttatccattacgatctccttagaaagattaaggaggtctttttttatggaaagcattcagattcataatttaaccaaacgttatcacggtaaagcaactccggctctcaatcacatttcgctgaatattcaatcgggtatgtttggattacttgggaaaaacggtgctggtaaatccactttgataagaatcttaaccaccctcgacgagccaacatccggcacaatccaaatgggcgggattccgatcaaaaacaagcgacagattcgtagtcaaattggctatctcccccaaaattttggattctatcccagcatgacagtaatcgatgccatgacttatctcgctattttagcgaaggttccgacttggcaacgaaccactcgaattaataagttgcttgcagcggtgaatctgatcgataaatctcacgcaaaaatcaaatccctatccggcggcatgcgacaacgattgggaattgcgcaggcattagtcaatgatccccgtgttttgattgtcgacgaaccaacggcggggcttgatccagaagaacgaatccgatttagaaatctactaacggatttcgctaaaaatcgaattgttattttgtccactcacattgtttcagacattgaagcaaccactaatgctgttggcgttcttgaacaaggccggttactatttaccggcagcacagaacaactcattgaagccgctactgggcatactttcgagatcaatttaccattcaacgaattaaaccactttaaaacagctcatcgattaacagaacaaatttctcaagggtcaacggttaaaattagatttttatcggatcggcccatttcgacagcccatgttgtctcacccactctggaagaggcatatctgtttctgcaaatgcagcatgaggaggggtaatctaatgaaacttttttggttagaattcaaacgacttaccatgagtctgacgtttatcatttatacaatcattgttgtcggcttcatcatggtcaacgtcagcccgacaattaacaacagtttattaaaaagtccccaaccaaattctgccggctatggtgatatcacgtcaaccgattaccggacattgaaaaccaatgccttggatgaattatcatatgaacaccgtaccaattcatatgttacctacccactcggttttgccaaaacagtcaccttaaccaacaagaaccagcatcgggtagacatcctatttcagaaagcaaaattagcaaataatcgaaccgctttagcaaaagagcttcaacaagttgataacctgctgggtggtcagtcatcatacagtccaaaaaacatgcaaagctttggtttacgagagatgaccaaaaaagaggccctacatgactaccacttaattgtgacaaaggacaaacgatcaggatcatttgcccgggtattcgctgacattgctggagtgattatgggcatattacctacaattgttgtgatcgcttactgttattccgatcgccgaagcaaagcaattcccgttattcatgctaaggcaatgagcacattcaggtggttggtaactagatatttagccactttagcagcactcgttctaccagttattttagtgggtgggctattcaccattcggattgccctcctgtatcaacatgttcaaattaataattttgcccttttccaagccacgttcttctgggtactcccaaccttaatgatcagctgcgccattggttttctaagcgatgcgctttttgaaaactttttcggatttgtttttcaaaccggctggtggttgatcacaatgatcatcggtgcccgccaagtccaaggcaattatggctggctgttcattccaagatacaactctcttcataatgtcgcttactattacgatcatttagaccagttgattttaaatcgagctggttatgcgctgcttgccttggtactattagggatcacaaacgccattctgaatttaaagagaggaggaaaatggcatgcactcaaccttcaaagaattcatctatttggaaattcgcacaaatgaaatgaaaacaagtctgattgtaattgcctgcagtacatttatcccctttctattttcaatgattcccaattcgatgttccaagctgccctgcctggagaacttctaatgccattactcgccattttctgtttcggcaatctgcttttacctgaacaacgatccgatattgttgctgtgatcaatagtaaattaattcaattgccttggatatacatgatccgctttgcctggtatagttgcctgttatcgctaattaatggtttaattattatcgcttatcatttttcaccattcgaccttgaccttttgactctctggtttgacttcaccgtcaagtcccttctgattggcagtatcgtcatcctcggctacagcctttcccggtctttagcagtagcttatctcataccgaccgtttactttgcactctgtcttggctatcccaaacttggttggatggatctgctgacaattatgcacaatcaaaacactgacagtaattggttccagtgtgccgtcattcttctatgtctcatagttggctggttattattaaaaaaacgatcaaataattgattttccattaagaaatacatcagactcggaacataaagccttccaatgccactccagcaacggtagatcaaggaaaaatgttatacttgagacaatcaatgtgcattaaagggggtaatttcatgcaaaatcaaacaccgtcacgcatgcaacggcagcaatccgatcaaaagaaccaaaagtcaaaacatactaaactgattgctttgattattgtcttactagtcattttatttggtgcattatatatcggccatcaggttcacgagttgggggatgcgcaacggcgaaccaatacgattttagataaaccaatcaaaaatactgtagttaaagttgtggaaccaaaactccctgaagagattcgtccccaagttgttcaaatcatccaaaaagaaccgctttatcgcctacaacaagctgctgacaatccggctacttttcaatcaatcgctaataaatatcagattcctgaaaattacgtcgccccagctaaacaatactggtttagtgagcaaaatcaggctttacgatctgacatctatcatgcccagttaatgcaactcttatcagaactaaggcagctgaacgattcaacaggttcaacgcagtaaatttaaggagttctcaaaagtgaaaaagtatgcgttcctcacaatgatgattggtttcttgctagctggcattattttctgtcaatcgccacaattagctcaagcaaaaaccaattatcaaattgttaagcgttcctatacagctaacgttgcctatcaccccagaaatcccgaaaaaaacggttacgtttggcaaacgattgatcattcaaaagttggccataatattaaaaattaccccaacacaacgtggcaagtttcacgtcaatacgtgatcaaacataacggaaaaaacgctgtttactatcgtgttcagggaatttctcccaaaaataacagtgtcaaaggcggctatatctggcgggctatttaaaaaagggatataatccaaattacactaagattagtgacgtaactgtcaatttaatgaccactaatgaatatcaacaattcattcagaagtcacccacgcaacgattgacccgacaagtcttggcattgttcccgaatagcaaagtgacacaatcgatgagtcaatacgcaataggaaacagtctggccattggcgagaaaagttatcgacaaatctcatctatgccggacatgcaacgcttcttgaacacacccaacacgctgacgagtacccagcggttagcaaagattcgggagattctcaagaatcatggttactttggaaataaattaaatgatcaatacgaaattggcattgtgattcgcaattttaatttacaacatccctacgatacaaatgatcttttgcagggactggtgattgccaaaaaataatccaactcatgaaaataaacctcactggcaaatgatttcaaatgccagtgaggtttattttgatcaaatttattctgtctctcgactcttttcgtgatctgttactgaatggtcaaccaatttttgggggttctttttaggaaatagtttaaacatgactttactaaaaatattcgaaccatacgcaattacaaaaattcccattagtaatgataaaaatagttcaacgataaataacggccaattcgtaatcgcaacattcgaaatgattaacattgatgtcccccacgcaatcaaccatgaagggacaattgtaaatttcataatcgttccttgcaagaataaggccaaaaatgtcattaacccaaacatgattgcagaaggccataactgggaaattaaaggaatttgtagcaactgaaaagaaatcaacgcccaaataattcccatgataaagcttccgataattcgccataatttatcgtctgggcaaccaattccaaaaaaatatgacgcagatataaaagcagccgctcccatccacaactgaaatgaagacatgatcagactataaaacagggtgaacagcccgaccccaacagatgaaaaccaaagttctttactaacacgcttcattattaagtcactcccctatgtgactcattaattctatatcgtcttgtaaaggattgaacaaacttattgattttattatacctgatatttatctctctttcatcaattcgaatcaaaaaatgttctaattgtcaatattaacaaagaggacagttgccttccccctttgatagcaacattaagagcctcgttaaaatttactctaatctctttggcgattctaatttctttatcataaccgtactaattcatttatggtatactagtagtgcattttttaacttacaaaaatgcttttcaactagggaaagtttatcgattttcaattcttttttaaaagagattttgtaaacgcttaccgtattaacactacctgcttagcgataaattactaatctccacttaataaaaagtgcatttatcgccaacaattgaactaaatttaaaggggaagttttattatgtataacgtacttgtatcagatgagtatgaaattatcagaacaggtgtcacctacctcgttaatgaacaagatcaattcaaggtggttactcaaacctctagttgggccgacaccattcgacaagttgaacagaatgaagtgaatatcgttattaccggtttagacatgcccggagaaaacggcgttctaaaaataaaacgtcttcatgaggcgtttcctaatatttcaatctttattttgtcaaaacacgaggaacgagatttaattaatgattgcgttaaaaacggagctgattcttatatcctgaaaagttccccaaattgtgaactcattaacgctttaaatgttgtcgcaaaaggaaaaaaatatattgaccataacatcttactttcagaaagagatattgaacggataaacagtcatggtttaaccaccattaaattaggttataatattctctccaaacgagaaaaagaagttttcccactaattacgcttggatacggtaataaagaaatcgctaaaaaactttgtatttcaattaaaaccgttgaagcccataaagctaaaattatgcataagttatcattaaaaggccaagtagatttgattcactatgctgtcaaacaccacctagtaaagttttaacttcgaatgggtgcagaaattaatataaaccaacccgatattctaattacggaatattaggttggtttattttttgggggacgctaaccattttgattcgcagtttttttccttaatgccgcaaccttaacctcaatgacctcattattgttaattcgtgcaaacgccaatgcctcatccattaatcgatcaatcatttcatgagggcgatgctctttaattgcattttcggcagcaagaaatttaaaccttggtaagtaaaaagtaacgtggtcctcagaacacaatgccaatccagtattaatgagttggttgcttaatggataattttcattaatcgcaaagaattcgctggtaaagtaaattaatgttaatattcgtagatcataattattttccatgacatccttgtccattgaataaacatgttggatataacgacgaactttattgaagtagaactgggctgcttcataatcttgacgtcgggaatacaagatacccgatcccacaaacgccaactgagttaaaatggtttgatgtttctcatccaaatcattcagaattcgggaaaaatcaaaaagtgctttttccggatctcgattaatcaacgtatttaaaattcctcgtagatagtaatattgcattctaatgggaattgattcgaccttagaaatattaatctttgataaaccctttaaaacacgccgatagtcttcagtcatcagttgcccttcaatcatatcaagtgattttcttactttagaaagatcgtcttccccttgatagagcatgtcaacggtgattcccaatcgcccacataatttacttaagatcgatagtgaaggaacccgatcactgttttcaaacttgcttaacgttgcttgtgtgcatattccttcagacaatttaacctgtgataatttcagttccttacggcgattaataaaaacactaatatccattagaccaacccacctattcgtgtagtcctagtgccacttttgcgtaccgactcattctgccaatatcccatgctggttcccaaaccaacttaatgtcacacgctgtgatcccttcaactgcgataactgcttgacgaatactgtcagctaataaattacccacgggacaccccatcgttgttaatgtcattgaaagcgtacacttttggtccacaacactaacgtgatatatcaggcctaagttgacaatgtcaactcccaattctggatcaataacttcctcaagactgttaattacctgatcttctagagatgatgaaatttttgccatcttttctgtcacgctataaccccctattcttcataattttaaaacaccaaatattagccgattgatccttccatttcaaaactaattaatctgtttaactctactgcatattccattggcagctgcttagtgaatggttccacaaaccccataataatcatctcggttgccttcgcttcagaaattcctcggctcattaaataatacaattgttcctcagatatttttgaaacctttgcctcatgttccatagaaacatttgaattataaatttcattatatggaattgtatcggatgatgactgatcatccataataatcgtatcacactcaacatgggctttagatccatcagaatgtttaccaaaacgaattgtgccccggtaatcagtcgatccgcccgttttcgagattgattttgaaacaattgaacttgaagtgtttttagcattgtgaatcattctagccccagaatcttggtgaatgccattacttgccacggcaattgacaacatggttccctttgcaccctcaccattcaaatacacacttggatatttcatcgttacttttgagcctaaattaccatctacccattccatcgttgcattctctgaagcagccgcccgcttggtttctaaactatagacattatccgaccaattttggatagtcgtataacgacaataggcatcttttagaacattcacttcaacaacagcagcatgaagactatcagaagaataattaggtgcagtacatccctcaacataatcgaccttggcaccttcatcaacaatgattagcgttctttcaaattgtcctgaattttccgaattcagtcggaaatatgattgaattggtgttttggtttgtactcccttaggaacataaataaaagaaccccctgaccaaactgcggcatttaaggctgcaaacttgttatcagttggtagaacaagtttaccgaaccactttctaaaaagttccggatactcttttaatgccgtatctgtatccgtaaagatgattcctaatttttcaaaatcagatttcatattatgataaacaacttctgattcatattgagctgaggaaccggctaaatattttctctcggcttcaggaacaccaagtcgatcaaatgtctttttcaaattatcgggaacatctttccaatcccgatattttttatccgtcattttctggtaataatgcatatctttcaaattaagttgagacagatccggaccatattttggtaatgataatttctggtaaatcttgaatgcatttaaccggtaatccaacatccactgaggttcatgcttggccgcagaaatttcacgaacagtttcctcagtcagcccccttcccgttgaaaaagctggtttaatgtcgtcatggaaaccgaactcataatcatcatcttttttcacgatatcaggtactttttgcatatcttacgcccccttctcattaacatttttttcacctagtaatacacgttgcaacgcccaccaagctaatgttgcacatttaattcttgcaggaaaactcataatgctggacaaaatggcagcgtcttgcagttgatctaaatcagtttgagaatgcgatttgccaatcaccatatctgaaaaggtttttgccatatgcaacgcctgactttgagattttccaataactgcatccgtcatcatacttgctgaagactgactaatcgtgcacccatccccggtaaatccaatatcttcaatcaaaccagttttacttaatttaatttctaaattgatgacgtcgccacaagtcgggttcttaatggtaattttattggtcgtttgacttagatgatgcttgtggtgaggatgactcgaatgatctaaaataacttctcgatataatccattaagctttgacagccccataattaaagaactcctttgtatctttgattgccgacaataatttatcagcatctgtctgggtattatatagataaaaactggccctaaccatagcaacctgcccaagtgtgttcattaatggctgagcacaatggtgtcctgcacggacggctacaccgtccatatcaaacgcggttgcaacatcatgtggatggattccctgaatattaaaggcaatgacgcctgtatgtctgctgggatcatgtggcccaaataccgtaacaccgtcaattgctaccaattttggcaacacataatcaactaattgctgctcatgcaccgttacttgcgccatgccaatcgtatttagataatcaatcgcaattcccaaaccaattgcgccagcaatattttgggtaccagcttcaaatttccaaggcaattgagtccaagtactatcaaataaattaacaaaatcaatcatttcaccaccatactgatagggtggcatctcttctaataattgccgtttcccatagagaaccccgatgccggttggtgccatcattttatgtccggaaaatacatagaaatcagcatcaagatcttgaacatcaactttaatatggggaactgcttgggcaccatcaccaactaaaatcgccccatgttgatgggcaagttcaccaatttccttgagaggtgtgattgttcccattacgttactagcatgagtaattgcaacaatttttgtctgatctgttatttgacgggcagcatcatctaaatcaatttctccatttggggttaacccaatatactttagtgttgccttttttcgaagtgctaattgctgccagggaatcaaattactgtgatgctccgtgattgagatcacaatctcatcaccttcatgaacgttttcttctccatacgtacttgcaaccagatttagcccgtcagtagctccctttgtgaaaatgacttcagctgattcgtcggcattaataaatgtttgcactttttttcgagctgcttcgtattttaacgtagcacgttctgccaatgtgtgaacaccacgatgaacgtttgcattatcagatcgatagtaatcggtcagtgcgctaatcacctgatttggcttttgcgctgtggcagcattatcaaggtaagtcaacggttctccattgactgtctgctgcaaaattggaaagtctgctcgaaattgattaaatccctcagccattttttaagttcctttcaattatttcaattaactgttttctaacatttttcgatggaattgcagttaatactgcacctaagaatccccggataaccaaatgtgacgccgtttttttatcgatcccccgactcataagataatacatttgctgctgatcaacttgaccaacactggctgcatgacctgccaaaacatcattttcgtcaattaataaaatcggattggcatcaccatgtgttcctggtgacatcattaaaattcgattttcttgttcggcatttgcaccagatgcaccatggataatgtcgccaatcccattaaaaatcaattccgattgaccaagtaacactccccgctgcaaaatattcccaaccgaatgtttgccacgattcgtaattttggtattgatcccaactcgctgatccttcccagtaattgcaatgacctttgtgtcagtttttgatccttcacccactaaatccgtatcagtttgaccaatcgtgtttcccgcattcattagaccaattgtccaatcaacttctgcattatctctaacaaatgctcttcggttgaagctcacggttgttcgttgactaagctcatctagtgacgttaatttaacctcactatttttctcagcaacaatctcaaccattgtattagcaagacaccgatggtccccacgcgtacttaaatgttgagtaacagcaaatttgctactgggtcctgcaacaattaaaagatgtgaaaccagtgggacttgttttttactatcttgaataatttccatttcgactggttggtcaatcactacgttttcagggacatataaaaagatccctgcattcaaatgggccaaatgatagctagtcaattgattctcgtctgctttaatcacattcatgaaataagattttatcaatgctgaatgttgacgaaaagctgtaaaaatatcagttaaaataacaccctggctaatcaatttctccggaagatcgattttaagcgtttcatcagctaattggacgattttggtaacagtggtcgaggttttaacggttggagagctaagttgatgattcggataatttatcaatcgtggcgttaattgccatccacgataatcaaatcgttgaaattttggcaatgaagccgtttttgtattttcgagtgcaacaacttgttctttaattaaccaatctggttctttttgatctttagcaaacgaaattagtgcttcaatatctttactcttaatggcttgcatcttttcaccctccctttaattatcatccactagggcgacgttaattcccaaatcatcgcgtaatccagcataaccctctttttcaagagtcttggccaactgcgcatcaccggttttgacaattcgaccccccatcattacgtgaacaacatcaggggtaatatagttaagcagtcgttgatagtgagtaataatcaaagaaccaaagttggcaccacgcatcgaattaacgccttttgaaacaactttaagtgcatcaatatcaagtcccgaatcaatttcatccaacaaagcaaactttggcttgatcattagtaattgaagaatctcattgcgcttcttttcaccaccggaaaaaccttcatttaaataacgctcagtcatcgattcgttcatatccaataacgctaaattttcatcaagcaattttaaaaatgacataactgaaatttgatcatcgctgggtcgtcgtgcgttaattgctgccctcaaaaattcagcattggtaacaccttgaatttcggctggatattgcatggccaaaaacaaccctttacgcgcacgctcatcaacaggcatatgaataatgctctcaccatccagcaaaatatctccctgggtaacatgataagcaggctgccccataattgtctgcgataaagtagacttaccagttccattcggtcccataatggcatgaatttcaccagttgacattgttaaattaacgcccgtcaaaatttctttggactcttgattttcttcatcttcaacttcgacatgtaaatcttttatttcgagtgttgacataatttgacccccattagtcattttttattccataggaatattccttttgtaattatgtttaggattggtcggcatatccatgtgattatatacgcatgttatatttcgtctaaatatgcttctaattaactcccaatgagcttaactaagcacgctattattgtaatccggaatgatagtcaattaatattaggcattcccctaatatttcataaattggttgcatgttaaactattaacgaatattacgataaaaatattccaagtagaaaggtcttgattatatgcaattatctgttgaaaaagtcacccattctcgatttactgttcagtcattaaatcaattagatagccccacaaccagaagactccacagccttgggattcaatccggcagtcgaattgaagttgtttcagtctaccccttccatggcccggtagttatcaagatggaccaacaacggattgcgcttcggtatcctatttttaaatcactcataggaggagactcttaatgaccactgtggcattattcggaaatccaaacacaggcaaaacaacattatttaacgaattaacagataaatacgcctatgtcggaaattggacaggcgtcaccgtcgaaaaaaaaattggtaaactacgccattccaaaacgacagtcgtcgacctaccgggcatatattcactgaacccaatcacaaaagatgaaggtgttgccgttgaatacctactaaaccacaagccaagcctgattttaaatgtgaccaacgctagtcaactgaaacgaaatctgttactcacaattgagctattagaatcaggaataccggtcgtgattgctttaaatatgattgatgatttaaaaaaaacaggctctggttatcacttaacgactctgtcagatcgattacattgtcaacttacaacgaccaacgcccgaaataagaaaggaatcggtcaattacgcgaagaggttcttacaacgatttccggatcatcgcaatttcaaacactcaaactaaactactcaaatcaagttgaggaaggaatttttcaagcagttagtcaactcacgacaaaatttcaaatgactgccgatttttccagatggattaccattcagtttatgaataagaatgaacccatcaggcaatatgcggcgaagaataaactgaaaccactgattgatcaagaggaattctatgatcagcaaaaatttgaatcccaaatttttgcaacaagaatgacatttatcgaagaaacattaaggtcagcgagatttcaaacaaagttcaagtcatcaaaccaactcactaatcaaattgatcgcatcgttactcatccatttttaggattaccaatttttgccggaattttttatctgatgttcaaactatcctttgattggctggggacgccactatctgagacattaaatatattcttgagcggaccagtttcaaatttcgcgtcacattttctgatgactattggtgcaataccatttttaagatcactaattgttaatggcattattgcgggagttggtggcgttttaacattcattccacaaatttttgttttatttgcgtgtatctcaattttagaagattctggttatatggccagagcggcactggtcacggatcgaatcatgcaattaatcggcttaaatggtaaatcatttattcctttaattatcggttttggctgtaatgtcactggaattatggccgccagaacaattgagcaacctaaggagcgattagtgacaacactgatttcaccatttatgagttgttctgctagacttccaatctacagcttgtttgtttccgcttttttcaataaaaatcaagcacttattgtattatcactatatttcctgggaattattatcgcacttataatggcaaaaatttatcaaatgacgttcaagataaagggtgattctgattttattattgaattgcctgaatatcatttacctaaattggatatcattgcaaaaggaacatgggataaaggaaaaggatttatcagaaaagctggcacagttatttttgcaggaactgtcctaatttggctaatttctaatctcaactttcaaggtccaacccccatgattaatcatagttgggctgcataccttggaaaggcgctgctgccattattcattccgatcggtgtgacatcttgggaaattgtgagtgcattattgaccggtattgttgcaaaggaagttatcagttcaagtatgattgttttatttcatttatccgcctctactgatttaattgccacttttagctcgctgttaactcccctttctgcttatagtttgctagtcttcattttgctttatattccctgcttctccacgcttgcttcaattaagatcgaaaccggttccataaagtggtcattttattctgcaatttccagttttgccattgcttatacaattgcgtttctaatctatcaagttggttctttattcatgtgaaaggagattttcaaaatggttttaattgctaattttactattataattatcgttattttatttgcactttatcaggtgattagcttaattcgattatctaaacaggggcgctgcaaagcctgtcagtatgaatgcgaaaccaaacgagcgctgcaaaatcacaaaaacgtaaattcaaagtaaaaacagccaccggagtccctgcacttcggtggctgttctttgtgattaagaaaagagactaataagtttattctattctttgcctcaacgtactagtgattaatgagttaatctgactgattcaatatcaactttcgaaggatcacccttacgtccaggtttcatttcaattttaccagtcgaaattgcaccaaccgggcaaactaaattacagagttgacatccaacacacttactataatcaacagatggtcgacgagacttttcatcccaagtaatcgcttgatgagcaccatcaaagcaagaaatgaagcaacggccacagccaatacatttatcccaatcaatttttggataaactttgtaatcacgatcaagatcttccgctggaataatattcttgtttgccaagccgactaagtcttttaagtgatcaacgccttgttcttccatgtaatgcatcaaaccatttttcatatcttctacaatgcgataaccatactgcataaccgctgtagtcacttgtaatgttgttgatcctaacaaaatgaattcaacagcatcttcccaagtttcaatgccgccaattcctgaaatagctaactgttctaaaccagcagcagcgcgcaattgctgaatgaatcggagtgcaattggcttgactgcttttcctgaaaatccagaaattgacgatttaccattcacgataggcaagcaaacttttttatcgaggtcaacgttggcaattgatttaaccgtattaattgtcgcaatgccatcggcgccaccggccaggcttgccttgactgcaggtatcatatcagtaatatttggggtcattttagccatcatcggcaagtcggacccccgtttaacagcttcacagtacttttgaacaagatctggattggttccaacatctgatcccatctcatgggaagtcatttgtggacatgataagttcatttcaatcatatctgcaccggcttctgttaccaagcctgccaaatcttcccaatcctgagcattagttcccatgattgatgcaataacaattttttggggataatttttcttaagcttctttaagtcatccagattttcttgaagactatgttcagcaatttgttccatgtttttaaatccaacaaacggtgttccctcttttgttaattcgtcaaatcgaggtgatacttcgtcaacttcaaaatgtgctggaccgattgtcttaaaaacaaccccaccccaaccttcgtcaaatgctttagcacacatttcgtaacaattatcgactggtgatgaagacaggcagaatggattttcaaaatggacacccagaaaatcaattgataaatctttattaatcattactgctacctcctaatacgctgtcaatttcttcggcaacttcttttcctttgcggactgcccaaacaacggtcttatcaccatgggcaatatcaccagttacatatacctgtggatcctcagtgcgataaccaataaatggaacctcaccatgctcgatcgtaattcctaatctatctggattaacctgctggccaacggccataataattttatctgctttgatagttaactttgaatcaattttacgatgtttaaaagttacttcgttaccattaaccttgtcaggaatgtagccgtcaacaattgtaacaccggcattcctagtaccggctaactctttcttggaagccttaaattcatcaaactcctcgtaaacaacatccgtcacattcttgacggcaagtcgctttaaggtagttgaaacatccattgcaacatcgccaccaccaataacaacgatattatcaggtagggttaccttgcctttagtctgtttaacatgggccaaaaaatcaactgccgattctgtaaacttgttgttatcaagcataggtaacatttttgcttcactggcaccaattgctaaaataacagcttggtaatttgattttaaatcagccatcgtgatgtcctcaccaattgaggtatcaagatgaatgttggcccccatgtccgtgattcgtttaacttcataatcaacaatatcactcggaagtcgatattctggaattccatatgttagatagccaccgggcttagtatttttttcgaagatatctaccgaataccccttttcaagcaaagtaactgctgattgaagaccagcaggaccactaccgacaatcgcaatttttttaccattagatttacctttttttaaaatacgcatatcaactttttgctcaaagtcggtaacaaatctttgaatcccaccaatgtcgattggaaaatcaataccactacgagaacaggccaactcacaatatttttcagttggacaaactcgtgcacaaattgagcccaaggcattattttcacggattgtttcagcagcacccttaaaatttctaaatcggacacttctaataaattttgctggatcggtatgtgctggacaggcctttgaacatggggcgtcgtggcacagaaggcaacgagcagcttcttcagcgaccgtggtcattgtgtaacctgaattttcttttgtataatcgttagtcatagtcatgctcctcactttaaaaagataggttaaactcaaatttgctgtatggtatgtaatatcggtaaactgactagcagctagcataatagttgttcaacctttcacacactttacaatcaaaagattatcatagaaaaaataatctctcaaaattgcaatcgacaaatcattactttacctatgatattcatgaggatcatgtgcccaatgaatattaaatttgtaaatactgatatataaaagtgaatggtactatttattaatttatatattttcaatagaatattgcgtccagactgatatttgtgtcaaaatgctttgaaaatctcggtcgcttttataaaacttaacgaattatatttatttcgatatccttttggaatagtatattaggaatttatagagaaaatcatttattaaacccatattgaacaagaaaaagaactgaaacataaaatacatgtcccagttccattaatccgatctaatgacaatcagttttatttacttacaatcaccaacgatttaattgcttcacgcttagccattgcttgataagcgtcatcaatttgatcaagcccaaatcgtttcgtaaagacttttccaggatgaatatcaccgtctaaaaccgacttcaacaaaatgcttttatcgtaagtcgttactgaagctggtcctccggcaatactaatattgccataaaacgaatcggttaaatcgactttaggttcatgaggcaatccaacccggccaacaatcgcccccggtcgaccaatcttcatggccgtatcgtttgattgagccgaaccgacacactcaagaacggcatcgacaccggactggttagtgagttgttgcacccttttaacagcttcatcaccacgttcagcgacaatatcggttgcgccaaattcactggcaagcttctgtcggtcttcgtgacggctcattgcaataatccgctttgcaccacgcattcgagcagcaatgacaccacacaggccaactgcaccatcgccgacaatggccaccgtgtcacccgacttaacattggcaacccgagcagcatggtatccggttgccatgacatcagccaatgttagtaacgaattaagcatcccatcactataatcctcaggttgacctggaattttcactaacgcccattcaccatgctgaaaacggacatattcgccttgatcaccgacactaaaattatctgaatggctttgacagtcaccatcaaagccagctaaacacgcagcacaatgaccacaaccgtgggtaaatggtgcaatcacaaaatcgcctggtttaacggtggtaatcgcatcacccaccgagtcaacaatgccaatggcctcgtgaccactattcattgagttggcagctttatcttccaatccacgatatgcccataaatccgaaccgcagacacacgcccggacaacgcggagaataatatcgtcctcagcttgaatcgctggtttatcagtattctcaatttcaacttttcctggttttacaaataatgttgttttcattcttgatagctcccctttaattaattagtgacagtgttaggaagtgggaacaacagatatgccaattcattcactgaacccagtatctcctaacacattcagtttatctttacaaagtcaccctgtctaatactttcagcacatctactgtaataactgaaagttatcctcgctcaccagccaacaagtatgcggtttacctgattgactatttttcgtcctgacgtgccattaatgattcatagctgaattgctaatcatttccaaacgaatttgacaattaaattgatcaatcatatgctaatagaagcaattatttaacgcgctaacattttcaaggaaattgtttttaaaggagacgtcaaataatgaagaaagccgctaaattacttatccttactacgctcaccctgtcagcctttgcagtaacaccactatcagcaaatgctgcccaacaatcaagttcacggacaaacgcgctgggatctgtgaccctctttgtaaccaaacaccaaatttatcaaacaccaaaactggttcattctaataagagccattttattctctataacgctcacctctttgatcattcaaaaaaagtgacgtttacgcccattagttttacgaataatgttaccaagacgcataccacttacaaaataaccaaaaagattgacaccaaaaatgtccattggctttatgttcaaaaacacggttggattatggacgatgccactttaacctcaggtaaagcaactcacaaataagtaattgggatcacttggcctcaaaataatgccaaccgcatttgatccaagaaaggaataactatgattcgcagctacatagaattttggacgaaggcattcgtctttaccggcaaagccactcgcttacagtattttatcccatggataattaacacaggcatttttgaaacgtactgttttgtcacccatcaatggcgatctggattactgctccaacccctcaagtgtcacctcgggatcatcccagattctatctggcacagcattttgcttttgttattttttacattcattgtgtttgtaggaatcgcagactttacactaagagctcgtcgttttcatgatgttgggatcagcaattggctggtcttagtcagtcttattccaattcttggcccaatcatcgttttgcttgtaactgtggcactttcaagagcagatttacgttggccgattaatcaatcagaaatgtaatgaccacgggtgttgcatcatgtttttattaggataaatatgattataaccaatctaatatcagatccagttagaaactgacaaaaatcagcttttgattggatctttttcgttacactaggaacaaaacccaaaatcgtcattgttattatcggcgtaatcaggacaccaacatcaaaatttaatcattgtcatatcaccaatctgaaaacaatacctcgaagcgtcaaattttggctcagtcggtacatttgctacgatagatttacaaaaggaggcgatttgatgcaatcaggaaagattaagaatttcggaatcatggtcggattgattgtcggaatcgagggcttgggaattctttcatcattgcttgctggagacattaaggccgtttaccatgatttggcattaccgccattttcaccacctgacgttgtttttggcattatttggccaattttatatctgctaattgccatttcaggttatttaatttatcgatcggctcactcgcttcgaactccgaatctgattattttttattctcaactcctattaaatttcatctggagtattatcttcttcaacggtaacctctattggatcgggttgattattatcctaatgatggacctgctggttgggatttgtatggctcaattttactcagtaagcaaaaccgccggtattctacttattccttattttctatggctttgtttcgccacctacttaacccttggcgtggcacttttaaattaaaaatccgaaaaaattggctgtctcaaaaatttttcgaacatgaaaaatgccgccaaaattaaagtagtcactttaactttgacggtatttttattgcttcagttttttaaccgttattcctcaaaaatcttaccggctttaggtcctggatccaacgtccaaatcttttcaatggtaataatcccagcagctttaggaacaggaaactttccggtcgcccattctttggcttgctcataataaggaccatcagtatagagcttcgccggaccaccaaaacgaaatccctttaaagcttttgcgttggcagttgccacaattgccctgccattattattaatattggcttgggtctgaccacctgtcatttcattataaattaaatgttcatcatctaagactcgcattgaaattttaggaccaacatccggattaccttcgccatcaacagtggcaatgtacgataattcaccggcaatcatgtctttcattgcttgatttaatttagccataataaaactccccttttaaatttaaaacatgcctcgacaactcattatcgatgacacacttcacttaagtaaggtcattttagtgccagttgtcacttcaagcaatcatttgaactcggaagttaactcatcaaaaagattcggtgacatataaagatcgtagctgatcgacgtaaccaggttctaactgaagcccctcacgcaaatatgtctcaaattgaccatattcacgcttaactgtatcaaaaaaatgtgccaaataactacgatcaacaactaatgcttttgccatggcgtgctgctgtgccgcggtcattttgtctgccaattggttaatgagctgggcattcgctttttttcgtaattgattagtcagtaaataatcatcaaaaatcgttttttcactggcaccaagcatttttaaaataacggcagccgcaattccggtccgatccttgccagcaaaacaatggaaataagtcggcttggggtcctcaaccaattcttcaaaaaattggtggtaacccttttgtgccgaatcactcgttaccaactgagcgtatgttgccaacatgacttgactgatatcaccggcattgctgatcattccttgaatactgaccccactcttcttggcatcaaccaacacatcaattggttgataaatgacgccgggccaaattgtgtcaggaaactgtttggcttcatccaagctgcggaaatcgacaactctggcaatgtttaaatcatcttctaagaatgtgacctggtctgatgataaattatcaatttggccgccacggtacaacaagccatttttcattttaccgttagcaaccggataaccacccaatcctctaaaattggttatttcgacatccattattgattatccttcctttcaaataactgatattcagcaccatattttgccataaaatctgctaacagatccggatcctgcttaagaaccgtgacttctgtctgatcatcatcgtcaattaaattttccttcatcccatcagttaacggccaataagtcgcaacaaagtcaggtaaattaatatctgaaatatgctgggtcacataccaatcaataaactgcttcatttgttgcgtttgtttttcaaattcctgaagttccgcctcagattcttcaagctcttggtgtgcttgctcaatggcttcctgacgttcatccgcatcaatcccataccaggagatttcccacaataaccaggtaaatccctgccaaaattgatcaacatcgggaataatcacatccattgccatcaaattatgataggattcgagattgacaccaccaaatatctcatgagtttgacgatcagttaacgtcggatcccaattgttaccttgaaaatcttcatcctcatcaatttgattaacgagcaagtcaaattgacgcgaagttggcttcttttgctcaaggtttacggatactttcaacatttcactaagctgatgctggaagatttggcgaatttcatcaacgtcataatcttgtttagtcagactaaattcctgaactatttggtcaaaatggtcagcctctaatgccgacttaatcacttcagtcattttaaaatgcgtttgcggtagtgcatacaaatatgttgagccgtcaatcacaacagtatgctgattatcgttagtttcattttgatgagcaagcggtgaccaatcaatctcataactttcaaaagacccatctttatacgcaaggtcaatcgagacaatatcctgataggatttaaaccgatcaagaccatcggggccgccatatgtgtgaagttcaccaattgtagctaccgtatccttaaagattaaaaagaaaccaatcagcttaaatggatcgttttcccgatcaaagggatgttgcagaatcaccctggaaataaatttgggatttaaaacaatggattcggcgttttcaaaaaccaattcaactcttttaagtttctgtggcttctttgcattcccattttgattaatcgtttcaaaggcgtttaacgcgtcctcttgactatgacgcaatctggtcgactttttgtcgaaaaactgctgacttaatctttgactcaaaatatgatctgcgacaagttgagcaactgaatgattgcttttttccgaattagtcaaaacgatcccttctttctccgttggttcaatacacattaatcgaacagtggaacaatctaattttacatagtttaagaccatttaacaactattatcaagcggtttgacctgcgttgataacaagggtttctaattaagaatggacatgtattctgcttaatcggatttagttttcagtttaaatctgtgaaaacttatttggttaaaacaggacccggccgtataaggaccccggcaaacattccaagttcagaaatggctactttgctaaaacgtgcgcccagcaagcagaccccggccatataagctagtcaagtcggtattccaaattcaggaatgggctacctagtcgaaacgtgcgaaatgagactgatcccggccgtataaggaccccggcaaacattccaaattcaggaatatttgccggggtccttatactctgggatcaaagcgtctcatttcgcactctttaattctcatactcgaacttcaaatcccccaacgtattctcattagtcaggatcgactgcatgacatccactaatgacagtaccagaaccgcaccactgccttcgccaactgccaagcccaaattcagtaatggcttcaatcctaaataatcgagtgctttcgccgctcccttttctttagacaaatgggaagcaataaaatgttttgcaattcccggatacattgcctcggccaataacgctgctgcatctgaaataaaaccatctaaaaataatggaattcgattttccgctgctgccaacatcacaccaattttggcaccaatttcaaatccgccaaccttgcttaatacatcgattgggtcagccttgttcggttgtcgattggtcaaaacatctttaataatttgttttttgtgctcaaattgcttggttgaaatatctgatcctttatcaaccacaacatcaaccggtaatgataacattgtcgcaacaattgctgacgaagctgttgtatttccaaggccaacctcaccaatgagcagcatctgatttccctttgaaattgcgtcttgcgcgatatcataaccaacttgaatggatttaacggcatcttggcgactcattgcatccttcactaatatattatgagtgccgcgctggatttttcgatcaatcattttagggctatgagaatcgccaaatagaccaacatcaatcacttcaacattacaatgattacttttagcaacggcattcacacaagcatatccgtttgcaacattatctgctaaaacatttgatatttcttgggatgttgccgaaaccgcctcttgaacaacaccgtggtcagcaacaaacaccaaacaggtccgcttaacagtttggagatcgatacgaccttcaattgctgccagctgatcagcaagcgcttcaagctgacccagacctttaattggtttggacaaattatccaacttttcctgcatttgaaaacttgcagattgggaaattgtgcttaattttggttcggaaacactcatattaaagttaccttccttaataaaatagatgaaaagctcaaccggtttttaaacggttacaatcctcttcattataaagggtgacgtcacaattattttgtctatttaataaagctaacttgaaaaattaacgcttggacggctaaaaccacaataaggggtaatggcaactattgtgtccgccactccccttacatgtttttaaaaatgcaatttgatattcttttggactaagccattacaattagcgccatcaaatgacgcctaaaggagaaatactgattatccctaggcaaggtttccgctttcatcataaaatacggattgtctatgacatcaatgatggtccccggtcgctgattgataacaataattttttgaccgagaaagattgcttcatcaatgtcatgagtgatcgccagcacacaattttgcacgttacgccacattttaattagtgtatcatgcatatcattacgagtcgcattatccaacgcactgaatgattcatcaagcattaatagtggcggttcattaataaatgctctcgctaaagcaacccgttgctttaatcccccagaaagctcataaacaggtgtccgcctatattcggctaaacccgtttcaaacaacaatttcttgagccggtcctttgcgagttgtaaattcatttttctcatctttggcccaaataaaatattatcgtccacatttagccatccgaataatgccatatcttggaacaccatgccacgttgccaatttgcacctgtaatcggctgaccagtcatcgtaattttccccaccgttgggaaatcataaccagcaatcaggtttaacaatgtcgttttaccaattccagaggggccaacaatcacatttaaagaattttgatctaagttcaaattgatatttttcagtgataactcttggcttgttggatactgaaaatcaacattttggattgttaacaaactcatcgcgctaccaactttctattcatatatgtcgaatcaataaactgacaacaatttgaataacctggtcgactatttaatgtttgttgatcactcatgaactgacaagtccgataaaattgctttgtaaattcagtttcagaaaacttgccaattctatcagccgccaaccatctggctgacccaatctgacgttttgtttcatttggtgtgagcttcaaattttgagcagtactttgataaattttccgaggatcattctgatatcgagtatgaattagttttaaacaatctacaaaacactgtagcgcttgaggttgtgaattaataaaccgatcagtcgccaaggtcacattcgcagtcaagtggccatctttagccatcttttgactatcaattaactttttttgaccagccagatttgataaacttggttcccaagtatacgcaccatcaatatcaccacgattccaagcagccacaatttcttcagtttgcatatcaatcaaatcaactttaccgatcaaatggtgttttttaagcaacatcatcaaactgtagtgtgaggtagaagcaaatggggtggcgatctttttaccaacaaggtcttgccaatgatgaatttgacgatttttccgaacaactaattgttcattactaccaataacatcatttacccaaataagtttagcgggaatttgagctgccatcgcaacaaccgcattggtatctcccattgttgcaacatcaatactgtttgacattaatgctttattggcatcaacaccagaatcaaacgtgataaactcacaacgaaccccgcgtttatcaaactgttgatgtaatattcccatttgccgggcagccgttacatcgttaggtacccgaagaacgccaatccgaatgattttttcagtgctttgcttgggggattgccgatgatgattagcaattgaaaagcctgataagcaaaccagtaacagcagcagaatgaaaatttctaactttttaatctttttcatgcgtgtttcccccgccagtgaataaatcgattttcagttaatttaatcaaccaatccagcagcaatcccgtgatccccaaaacaataatcccaacaaacatcacatcactcttcagatagtgggaagcatcaataatcatccaaccaattccggcagaagcggcaatcatttctgctgaaacaattgttgtgtaagcaacgccggttgccgaccgaatgcctgtaaagatatcaggtaatgccgaaggaaaaataatgtgaaagaaaacttgccggcgactagcaccaagcgaacttgcactgcgaaccaattcttcatctattttgataactgcatcaaaacaggataaataaattggtggtaatgcagctagaaaaagtaatgttattttggagggttcaccaattcccaaccacagaatcagcaacgtgtaatatgctaagggtggaattgggcggatgaactgaatcagcgggtcaacaaccgcccgaattgttggtgcataaccgcttaacagcccaactggaattccaaccataattgccagtcctactgcaaccaataatctgccgagtgtgatcaggtaatgttggtacaagggaattccgttatatcccagtgaacacagattcagaaacgttttaaagacccgtgccggtgatggcagcattactggagaaataatgtgaaaggacgtcagcaatgcccacgccacaatgattatgacggttgtcgtaagactaatacttaatgattttaacttgggcattggtttcaattcagactcctccactctcccaaagatattgattaaagtaaatcaaatcgatagttggtcacaattggttttctgttgtcagtttgatcacgataatattcgttttcacaaacgcctaaaaacgaacctgagatatttgtaacattggtatatcccatgttaacaagtgcccgaacgacgttataactgcgttggccactcaagcagtgaatgtatacaggtcgatccgttggaatctcatccaaccgatttctaaattcactcatcggaatattaatggcatttttgatatggccttcttcatactcaaactgttcacgaacatcaataatcgttgccccagactcaactaattgacgaacttctgagacactaacctgctggtattcattattaagaagatttgttgcgactaaaccggccatattaacagcattctttgcagtactaaacattggttgatagcataactccaaattctctaagtcttccacatattgatgattcgtaatcatcgttgcaataacattgacctgcttgtcaacagaactttcaccaacggcttgtgcgcccaaaatttctcctgatggataagcaaaaactaatttaaaatataaaggtttggcgtttggcattaatgcaactttgtctttggggatgaccattactgaccggtaatcaatttcggcatcttggcaagcagcctcagttagaccagttgaagcaatattcatttcaaaaaccgggatacactgtgacccaatgacgccccgatttctaatttgacgaccgtacatatggtcaactgcttgacgggcttcaatttgagcgggaaatgccaaatttaattttgttggttggtgggtaatccgatgaaccacttcaattgcatcccccacggcataaatatgtggtaaattagtttggtatccttggtttacttgaatgccaccggttattcccactgcaacgccggcttgacgagctaggcctgtatccggttttacaccgattgccataataacggcaccacttggaatagatctaccagaagccaacataattttatccggtgcaatttgagttagtgtatcgtcggtaatcaaattaataccatgatcgatcattgttttttgaacaatctgagccatctcatcatcaatcgttcctaaaatatgagtcattccttcaaccaaagtgacatcgtagccaccctgctgcaaattttcagctgtttcgattccaataaagcccccaccaatgactgaaactgctttaattcgattatcatctaaataacttttaatttttttgatatcgacaacattacgcattgtaaaaacattctcattatgaattccgtcgatggcttccggcaagattgggttagcaccaggggataaaactaactcgtcgtagctttcctcactaatttcatttgtaattacatttttaacttggatttgtcgacgattagaatcaattccaatcacctcatgattgacgattgcattaatgttgtactgatttttaaactgcctaggatccatcaacacaatatcctcagcattggcaattgttcccgagagatgatatggcagagcacaatttgaaaatgaaacatttggccccttttcgtacatcacaatttcagcatgttcatcgagtcgccgtgctcttgctgcaactgaagcgccaccagctacgccaccaacaacaataatttttttactcatcatttgtccactccttaattagttcccactagtaacaaaaattgatttagtcgattccttataggttggcaataatgcaatctttccagcaaacagcttaattgcaactgctgccccaagaatcaaaaatcccataaacaaatatccatgaattgaaaagttggtaattgacgaatataacgcgccaatgttacaccctcgggccattcgagcacctagtcccataaacgcaccgcccaaagcataaccagcaaagtcgtgaattgtcattttgaatttccaactaaaccgaccagctaacaagaacgcaacgaatgcaccaaccacaatcccgatgtttcgaattgtcccaccatcgacccacagggaattttgcatcgccttggctgtctcgtcaaacgccggggatgtaaaattcataccaaatagttgcaagaatttttgatcaagactaacaaacggagttgtcacaccccaggcttttccggttgtaatgaggataaagattgcagcaatggcaatccccaccgatccagtaataaatgtccatcgctcgacaaagaatttatggtaagttcgccacgaaaacaatttaaagggctcactgtgatcatctttaattggtttctcaaaggcctgccaatccgacttgggattcacgtacaacccctgttgtttcttccgattctcatactgcttaacaaaaacgtagagaaccaacataatgaacaatgtgagagctaaagcgcccccataaccaatatattgtggtaaccatgcagttacaccaattttcccaatggctgtattatccaattcatagcctaaatattgacctggtgcagcaaacagaataaagaacggaaatgccatccaagcatgcccttcgccttcaccgaaatcagataaggttccagaagcacaaccaccggccataatcatccccattccgaataagaaagcaccgataataatcgaaatattgccaatccgaacgttctgtgttcccggaataaccgattgcgtattggcattagttatctcccaagcgggtagtgcacctttactagctgcaaaccactgaataccaacattgacaattgctgtaattgccaataaaacaataattgcaattgctaagctaccctcaccacgatagaaggttcgtttcaccccaccggcaaaaccaaatcttgaacgcgtcaggacatagccaatcatcaaaccagcaatcaaataaacaggtaagttaccatcgattaaatgtaaatattctccccagatcaccatggcaattaaaacaactaatccaatgatcggttgcgtcctgctcaaaccatattttgcaaatccatcttttatcatcatgcgcctcccaatatttgttaattagatcacaaataaagtgtaactgatcgatgactcgtcagtaaaatacttgttagttagtaattgcatagcctgtaaggtataatactaatgggagggctttcatatgaacaatcaatttccacttttgaattatctaagagcaattacaacggccggaagcatctcatcggccgcaaaacagttatacatttcacaaccttatttaagtcggtatattcatgaaaaggaagctgaacttggaattacactattaaatcgacaaactcgaccaataacgctgactgatgtcggtgcaaagtaccttcaggggattgaaaatcttgataatcaatataattctttggttaatgaagtttccgaaatggcctatgatcaaacgtccaatatccgggttggcatcaatcagtcactctccagccagttactacccgaactaattaccagttataatgacgaatttcccgcgagaaaaatatttgtcaaggaaggcccctcaaatgaacttgaggaactgcttttgagcagccaaattgatgttcagatccgaatgctgcccatatttcccaaccaaattgcgtatcgtcagatttgcgaagcgccggtttatttgatcgccaacaaaacctgtactctctacaatctacacaatgatcaaataatgaaaacgccttttccaattaaagcgattaaccattcagaatttgtttttttacactccggttcaggattcatgcgcctaatcgaaagttttatttccactaatcgacttcaattaaaacagcatttcgaggttaaatatttagaaacagcggcgaatttagcatatgctggaattggctgcacgtttgttccacaactctttttgaggaaagatttcaacccaaacaaatgtaacgtttttaagatttcagaaaaggatttatcgttaaaaattgcaattgcttacttacgacaaccagaaataaaagaaatcacccaagaatttatcaaagttgcaaccaatgaccgcatcaaacagttattattaaaataaggttgcttttatcatctttcaatgatgatgtaaaatagtaataattaatttaatttttattaatggagatgcaaaaaatgactattaaacatgccgcaataatcgtcatcatgagtgttggcttgggactagccacccaagtaccacaaaccgccaacgcaagttatgatacccggacaattccaactgtatttcgacaccgatggtacggtgagaatcatcagatttataatcaattcactgctaagcatggttactatcacgttgccaatgacacgatcagttccaaggtcaagcgagttaaagtatattctgcccaccatattcgcgtttggtcaacggatctcctttcagtaacattgattgttaaagggcatacactcgctgcatacactgccggccggtggacaaagtggcatcgatagcaatcgattgaaatatcgtccgataatcgttgtcgtttgataattggaccctgttcatggggtgaccaaacaagcggatcgtcaagtcaaaatggcttggcgatccgcttgttgtttcgatacttatcaaacatcagttattaactgataaacctattttgcgacatacactcccttcaaattaaacgataaaccagcactgttataaacgattcccttaatctttggatttcgcatttggggaatggtcgcttgatagattggtgcgacaccttggtctttcataatcacccttgaggctgcaagcatatcttgccaacgttgttgaggtcgattagcatcaaccgaagctgaccgtcgaactaatttatcgtactgtttattcgtccaaccaccctcgttaaaggtattgttcgattgcaaaatttgtaagaacgtatacggatcagaataatccgctccccagtttgaaacgaaaaagtcaaattgatgatgggtttgtcgctgaattaacgtcttcaatggaaccgaagaaatactgatttttaaattaggtagaatcttttccaattggccttggacataggccgcagaatgtttagccgccgttgtatcaccagacagaatttgcagactaagtgattttttacctaattgtttcaaagcctctttatattttgcccgagcctttgtcggattatattcaatcccggtgctcccctgcttggcttctttggtaaagtcctcgccggtcttgggattattggctaatccagatgtcacaaacccttgagcgggaactgacccatccgccaacacatttttggtgaatgactgacgatcaatacagtaagcaaatgcttgccgtaatgctttattcttaaaagacgggcgcgtgcgctgattaaattcaagatagaagattcgtgaatccttcagaacatgcatatctttgttattaagttcattcttaacttgtgtcccggacaaagtggcaacgtccacctggccactctgatataaattataagttgtcgatggatccttaatcacttgatcgttaatttgtttcagataaacgtgcttcttatcccaataagattgattagcaactagttgccacttatcgttagtcccagtccagcctttcatcttaaatggcccattataaacggtctttgatgcactcgtgccatatgcctgaccgtatttagtcacaactgattgattttgtggaaagaatattggaaaagccatcaatagcttgaaatacggaataggtcgctccaagttgactctcaattgatagtttccaagcgccttaacccccaacgaaccggctttggctttattagcctgaattttgttggcgttcttgatgccgtcaaatatgtaaccatattgggaggccgtcttggggttgattgtccgtttccaactatagacaaaatccttagcggttacgggatcaccattactccatttaacgccctttcgaagtgtaaatgtatatgtttttccatttgaagacacttgagtctttgtcgcaattgccgggattaatttatgattcttccctaaccggtatagtccctcatctgtattaccaaccattgtaatatcaattggctcggttatttttgaaggatccatggttgttaattctgttgtctcagaccagttcacagtttgctttgcggccatatttgcctttaaatgaccatcattttcactgccaccagacgatttttgaccacagccggcaagcaataacgcgctcacagcaacgcccccaacaataaatccgattttcttcataatttttcaccatgacccctcttattgtataaaaattaactaactttataaatactagaataaagataaggataggcggtgtcaatagctgttttaatttaatgaaataatggtgagaatattttttgactaatatcaacacatttaaagctatcaaaagtcaccaccaagtaaattgaaaaatggatcatcactaagcaaaaaaatagggccgacatcccaaagtacggatgcttgccctattacaaccttgttaaaatctaaatgagtcgttttatttttcgccgaatgccttagctgttcgaaccatgtttgaaacaaaaccgtattcattgtcataccatgttgcggtcttaacaatttgaaaatcaccatttgtggtaacttcggttaacgttgggtcatagactgccccgtgggtatcaccgataatatctgatgatacaatttcgtcatcgttccagccaaacgagtcattattttcagtgtaaggcttaatcgcagcattaatttgatccgctgtaacgcccttagtcttcaaaacagtcactaattcacaaattgaaccatcaatgacagccactcgctgtgcatgaccatttaaatgaccatccaattcaggaataaccaagccaattgctttagcagcaccagtggaatgaggaatcgtattagcagaagcggttcggttaggacgagctttcttccctttaggaccgtcaagaatcatttgtgaactcgtaaaggcatgaatggttgtcatcgtgcccacttcaacgccaaattccttgttcagataataggctaatggcgccaacgcattagtcgtacatgagccggccgaaacaatctggtcgtttgcgtccaaagtgtcatcattgacaccataaacaatcgtcttcattggacctgcgggtgctgaaattaagactcgtttaacaccggcatcaagatgggcttgagacttttctttcgaagtatagaaaccggtacattcaagaaccagctcaacaccatcgttttttacccatggaatttgggaagcatcacgttctgcatacacacgatatttatgaccatcaacaataattgaatcatctgtggcacttacatcgtatggtgaggtaccgtgagttgtgtcatatttaaaaagatatgccaacattgacggcgttgttaaatcattaatcgcaacaacttcaatattaggatcgccaacttctaaaattcgtcgaagaattaaacgaccaattcgaccgaagccattaattccaatttttaccatattaatgttcctccctagaatacaaatcagatatctacagaaacgattcaagttgaagcgtactttgaaggcgcctttcaaaacgcttcccaacttcatcgaaaacagtatatgcccaaaatgcattttatcaaagcaattagacttcaagaggcagctgcgtcaacatggaaaattgttaatgaattagccgtaatctcaataaaatagttctttcacacaaatccgactttcattgtccctttgaaccctttcactcacttagtcacccgaacagcgtcgatcatcattcgcgcaccagccaaaattgcatcgtggttaaaggtcattgccggaatgtgcaaaccaggcttcagcccacagccaagacccagcatcgtggaattttttgctactttgtcataagcataaaaatgaaaatcatccccacccggtgtcacaaccggctcaactaatcctgactgccccaaaacatttacaatagccgttttcatgtttgcaattgccttttcacttggaatggcagccggtgaaaagtcgttaccatcgatggtgatttggatgccgtctttttcaacccctttgaggattgcaaaaattttctcctgaaggactgccatcaattcgttggttcgagtacggtaatcaagtgcaaatgtcccgttatccggaacgatattagacgattcaccggcatgaaacatcgtcgcagttactgaatagggttcggcagtatccaatgaaacttgtcgaagttgttggttaatttcgctaaatgcatcaatcacattggcgcccaattgtggcttaccggcatgggcggttcgccctttgatggttacccataacgtcctagtggccgcatctaaaataattggttcggcttggtggtcggcgacttccgattctgggcaaacgtgcaatccatacaaataatctaatttaccaagcttgccacttttaatcactttttcggcaccagtcactgtttcttcggcaggctgaaaaattaattttaaagtcccggaaagttcctgcggattttcctgaaaataccttgcaaccgccaaaacaatcgtcatatgcgcatcatgcccgcaagaatgaaagacacctgtttttccttgatagtgttgcttcaaagcatcaatatcagcccgcataccgattaccggatgtccgcttcccaatgttgcaatcaaaccagtcatgtgatcaaaacgctcataggtaatccccatgttatcaagttccccagcaaggtattcagttgttttcacctcattaaaagcagtttcagcgttggcatgcaaataatcaaaatcccgtttcatttgtgattggtgcaatttaattttagtttctatcatgactgattcctccaaactatttagacactttgtaggcattctttaatgaaatgccagaagcagcagcgtatgaaacacctttcaactctggattatttaatcgcgccatttggccttgattaacagctaaaatagcctggtccttcatggcaattaattcagccttctgaaaatcttgatagcgttttttaacatttaacgaatcgacaccgttagcacgatcgtaataggtatcatactgcttattactataattgccggcattattagcattgccagtatttaacaattggaaaaactcattaagctccggatacgacgcaatccaattggtgaaacccaagtcgtagcctttcttactttgcatcttggtaatcgcctgaactttgggttcaacgttaatatgaatcgataaccccttcaagttcttttcagctgaagattgaataaactcagccgaatttcggaaagaatcaacatcgtagcaaacaaggttcaaagacagattttttagatgtagctgggataaacccttttgccagagttttttcgccaacttgggattataagcaactgcggtttgagacttggtgtcgctcgcaaagtctttaccatttgccggattttgggcaatctcttcaggcaccagtccggttggggcttttgaaccatttttcaaaacattattaactaagctttgacgattaatcgttaacgaaattgcacgacgaatattaagatttcttaacgctcggttccgaaagttataggcaatataatcggtttcaccatgtgagtagctaatatatcccttgttatttttctcatgggcggcttgttgccctgctaaagtgatgttatcaagtttaccagattgataaagtgacagcgcagtctgtggactcttaaccgttgaaaactgcactgtttttaatttaacggcttttttatcccaatagttcggattccgttttaaggtccagttactaacggagggtgaccaacccctcacaataaatggcccatcataaacggttttgtcagcggccgttccatatgccttgccatatttttgaacaaccttgggattctggggtaaaaatggcactgacgcacacaaatatttaaaatacggcgtcactcgtgcgagttcaacccgaaacgttgtcgcgtttattgctgttaccccgagcttagttggtgataattttcccttttcaatcgctgccgcattcttaatcggcaaatacatatatgaatcaggtgccttagttgctggggtcaccgttcgccgccaagcgtaaacaaaatcattagcggttaatggatcgccgttactccactttaaattttttctcaaatgaaaggtatagacagtcccgttttgtgttggcttaacaatcttagtggctaaaccaggttcgaccgttgtactgtttttcattcgatacaatccctcttgagaattattaaccgtttctaacgcaccaacatcggtaatcattgacgaatcaagtgattcaatatcagccggctccatcacacttgccttttgtgaagatgattgattttttgaagcattaccacaacccgttaatccaatcccactcattaagattaaccagccaacaatccatttcatttgcatgttaaattcccctcctatgacgataaaaaagccctcccaaagaaaatcatttctttgagagggcgacatttcgctgttccacctctgatttacaacagcctcacgacaattgcctcagtaagtttaataaacttaaaacattaacgatgttttatccggatcaatctaataagagcctgcctttcaattgatctgctattagctgtgtttcgactctgctcattctttcagcatttgaatgatctctgataattagaatctacttagactaatctcggcattttttaatttaaatataacttacaggcttatgtcgactttgtcaaggatattaaaaaagccttatttcgataatgcaatgtcaatcacgtctttgggatgataaaaatgatagttgggccgtaaaaagggtgcttcggaatttccccataaggcagctccgaaatcaacgttagctgctttagcagccacttcatcattaccggcatccccaacatacaatgactcctgcggttgaacacttaattgatctaacgcaaattggagtggtctgggatctggtttgggatatggcacttgatctgcagtgacgataatcgccattcgatttaaaaaaacattgggatcaagattggtaatatccgcatctagacgtgacgtcaccactcccacctgaattcgatgccttcgcaactgatccagcatgtcgataattccaggaaataatggttcacgatgattggcacgttttgtttctcgatcataggcggccagcaatcggcttttttgattgacgggaatctttaaagccgccatttcatcatcaatactcatcgaaaatgtttcacgtaaggctgcaactgtcgccgattgatgaaacgctggcaagatggcctgcattgtttgtcgataagctgcaaaactatcaaccaatgtcccatcaatgtcaaaaaggacgagctgataagccaccagtaattcccccctgctctaaaattttgctaactgctcatgtgataactgctcattcatatgtccactgacaaaaccgcccaagtccattgccacaaagtcatagccgtattgcttaagttgatgattaatctgttctcgttgattaatcaaggcctcgatatcggattgaggcacttcaattctggcaacatcaccatgattgcgaactcggacagttgaaaatccaaggttgcgcagatatttctccgaaagcatcactcggttaatcaatgcctcagttaatgtcgtgccgtacggaaatcgtgacgccacactacatgagggaactttagaccaattttccagatgggattgctgtgccaaatgacgaacatccgatttatagaattttgccatttcaagtggacttttagcacccgcttcatcacgggcccgcaacccgggtcgatagtcgttcaagtcatccatgatcatgccatcaatcacaaaccgataccccaactggtctttaatttgagttaattgattataaaataactttttcgcataataccaactatcgggcgtattatgcgcaacgtgttcctcgcttaaataatcaatttcaattgtccgaatcgttgcccccagttggtctgccaaatgaatggctttttcgaactcatcatcgctaaacaaaattgagttggcaatcactgccagcacattatccttacccaatgttttaatcgccgtatccagaactacagtactgtcgataccaccagaaaaagcaaccactaccttgcccatttttcttaattcattttcaagttgaacgcgcttgctgtcaatttttgtcataaccattataatctgcttcccttcatttacttgtttggagacgataactaatctgtttacaaatcagtttgactaattttggtatcaattagtgcctgcagccttgtttgaatataatcaaaagttttcccactttgcatggcaaaatgggcaacatcgtcgtattcaggggtcgctttaaccatgccattaaattgggcaatttttaaatgaacattgccataatcggttggtaaaacaatttccttacgctgcataatggtgcgtttgacaatctgataacggactccctttgtcgccgtattctttaaaatcaactgggtaaacttcgtgacttgattagctgatgcaattaccgttaacagttggccgggtcgaccttttttcatttgaatcggcgtcaagaagacatccagtgcgccggcttcaaacagtcgctttgcggcgtaccctaaactctcgccggtttgattatccagatttgctttaaggacagccacttgatcttgggtagtcgctatggtgcgcctactcgccgatcgatcaagaatcatggccctcagcgcattaaatccacccgtatcccgtttaccaaatccgtagccaactttttcaaccgcttcagtttcactaattgtgccaaacgaatccaccagaaccttaataatccccattccggtcggcgtaatcaattcggtatggacatcggttcgttgcttaatcggaatacttgttccaacccgcatttgcatcacagcgggaaccgggaccggcatctgtccgtgagcaacgttaataaaaccactgccgtcactaattgttgaacatttaatatgatcaacatgtaacaagtcaagcgcaatacaacttcctacgatgtcaacaattgaatctaaagccccgacttcatggaaatgaacctcgcttaacgggacttggtgaacttgcgactcagccttgccaatctcagtaaaaatgccacttgcttggcgcttaatcttttcagacaagtcactatttttgataatggttaaaatctctgttagatgtcgggcaccaccatggtgatgatcgtggtgatgttcgacgaaaccggtatccttgctgccatggtcaaggacaacatcaaagtcggtgccatatatggcattcttaggtttcttttgcgcggataatgaataacccgttaggtgaagtttctgtaattcagccttaaggtcttcaatcttgacccccaagtctaaaaggacgccaatcatcatatcaccactaattccggaaaaagcatctaaatataacgttcgcattgactgaccatctcctcaataaattcgaccataatcactgattgcataacccgttaattatttcgattgatcacacttgcgcaatatgctgcgccaaatccattgtcaatattgacaacactgacaccttccgcacaactatttaacatggtcagtaaagcactgacaccatgaaaattactgccataaccaatactcgtgggtaatgcaatcaccggttggctaaccaaaccaccaacaacacttgccaaggcgccatccattccggccgcgacgataatgacgttggcctggcgaatcacatctaatttcgcaaataagcgttgaatcccggcaaccccaacgtcaaaaacccgttcaacccggttaccaaatacttctgctgtcacggcagcttcttcagccactggaatatcagatgtccctgctgtgacaatcgcaatcgaacctcgagtgatcggcttgggcatttgaccgacaaccagacatttggcctcctcaaaataatgaactgcggggatggctttaataatctttgccgccttgctttttccaattcgcgtacacaacacacacggttcttgttccttaagaacattgatgatgccaacaatttgattggcacttttacctgatccaaaaatagtctcaggataaccggttcgttgggttcgacctaaatcaacatccgcgaaaccaatattttgcccctgattttgaccaagttgtttggttgcttctttcactgataaagtgccatccgcaaccgcttccaaaatcttcgtaacatcagactttttcatcacttacccccgaagccaactcaggaaccgtcatcgaaccggcaggtaggacaatcaccgatgcatttgaccctttttgtttaatggcatcactgaacgctaatcggagatcatgataaggtttgaaatgaacatttttcatttgttcatcactcaggtcagtaaccgcccaagttgaggcccaggtatcaatttgagccattttggcagctttatgaaatcccagcttccaactatgcttaattttatttaaaacctgttccggttctttttctgaactcagcagatcataaaatggcttgggaccaatcccggtccgacatttagcaaccaaaatttcaataccgcccttattcaatgctaatttgccgttatcaagcgccttttgtgattggtaaaggtcgacatccattgggtatggtgctactgaaatcacaatatcggctttttgcggaatcttaaccccgtaaacttccttagcgttatcaattccggcgtaaaatgatttgcttaaatcccctgctgtaacagcgtaaatatcatgatgactgtcgagcaccatttcaattgcaaaaatatcgattttatttaggacttgcatcgcatccatcatatcttcatgaaccggatttccctttaattttaatgcccgagccgaatcttgcagtgccaggtaatggttttccgagatcgtttcatacgacgcaactcccggtaaaaatgacttgcgcccacccgtatagccagcgaaataatggggctcaatcgaactaattgggacaactttgtgggcatcagcgacaattttattgatatacattttggtgccgttcgatgagtcaccgagatacgccattggatcgtggcggctgtcatggcagtgcagccggtgtttggcaactaaatcttcataaatatcatcgccaaaaatgaagcgatactcactgtcagtcggctcccgatggacgccggttgccacaataaagaaaatgttcttatctttaatctttggataaatatgttttaaaactttggctgttggtgttgggcgagtcccatcatttacaatgaaaacgacctgttcatccgtgtccatgaattgatcaaaactttcattatcaaagggatgattcaatgctgaatcaatcgcatcatccccattaacagctttgaccttatttggattaaaaaccccaactaattgattatcagcaacatcgatgtggaaactatcactttgaccataaggaactgttactttcaatttgaagatctcctctcaagtaagtagacggtgccagcaaaataaaatgcttaatctcattttacacaatattatgagtactgttcacagtattttccttaattcctaagaaaatggttaatattaacaaatcagctgatcccccaagacttaagtgctgctgtttaaaggtttgattaagcgccagcagtttttggtaaccatcaatcgtttgactaccgcctaggtcaaaataccgttgaacctgccttcgaacctggtttaaaatattgggatctccggaacgtttaataagattggaatcatcggcaaattgaacaatttttagcagagtatccaacaatcgttgattaatcgatccgcttcgttcttttaaaaatggataggcatgttcaaaaacagttggaaagccggcagcagcttcaccccgaataccaagaaaaccatatttgatgaattgtctctccccggccgttaaatgatgtgaactcgttaaaccacttcgattaaaatcatgatcaattaaattagtcaacattttctgaatcaatttagaaagagcgctcagtctcgatccgccctgtttgagttgataagctgttgctgttaataaaatccccagtgaaaagatcgcccccttatgggtattgaccccattagtcgccttaaacatcactctttcagcctcaattcctgctggacgaatcgcatcaaataacttggttaaatcaacgtcgttgaactgaagagctgccgccacgcattgctcaaaataaggccgtaagcttagtgcgctatcaataaacatgaacacgttcatatcgggatgagtgccattatcaatcgggtcaaccaatcccggcttcggatttaccgacacttcataaagcattgattcgagagccatcgaaacaagatgttgttgacaaacaactgtcaatttatttggcattggcgtcattcacctcattattagttgaaaattctttgtcaaattgctgttgaataaacgtctgaagtgttgtaatcgaatgccgtcgagatctggcacagacctttgcaggccgcccacaaataaaacagcgtcgggctggaaaattaaaatcagagcgggaaatggcaattggattgccattaccaaaaacatccacgtcaaacaaacggccaattcgatcgtgatcctcaaaatcgacagcccattttttaaccatcgtcgggtcgccgttaacaatcagaaatgcctcattaccagttgatttttgccacttggcaactagttcgactgtcgtaaagtgacgttgtaattcagttacgagccgggtaaatccccgatcaaataatctaagtagcgctgaattatttttaatcggtcccggaacatttaacttaatcgccaaaatcacttgatctggataatcggatagtaattttcgctggaaggcggcccgttcgtccttagaatttaagattgcggcaatgtcttgcttttctccggttgtaaatactgaattcataaagttcctcctcgtgttcaacaaaagtaacctgaattgttctatgtattaaaaagggccgggattattttcccaactccttttgtttgatgccagttatggataattagtctttaacttcatgaatggcatcaataattgaaccatcccgatattcaacaagtgcaacggttcgatcagtgaattccaatggctttggtttaccaactttggcttcagccatcttttgcaattcttcaatggtgtaaaccggaactccaggtaaattggcaaatgcctcttggagatcttttcgtcgtggattaatcgcaatcccgtattcggttaccaaaacatcgactgaatcacctggcgttacattagtcgttacctttggcacaaccgttgcgattcgaccacgaaccaaaggtgccgaaataatggtcagtttggcagttgcagcatcttgatgaccaccaacagcgccacgaatgaccccatcggatccggtcataacgttgacattgaaaccagtatcaatctccagtgcacttaaaatcacaacatccaattgatcaaccatcgcacctttattatctggatccgcataccaggatgcgtcgatttcctgttgattggggttggtgtgcattgactcagcggcacccttatcaaagtcttgaacatccataacccgggaaacgagtccctcatcaagaagatcagtggttggcttggtaatgccacccaaagcaaacgaagccttaattttattatcaatcatggcctgacgcagataccgggtaaccgctaaggccgcaccacctgaaccagtctggaatgaaaagccgtctttaaagtatggcgaattaacaatcacgtcattaactgttgaagcgatctttaattcttttggatctttcgtaaatcgagttgcaccagaaccaatcttgtcaggatccccaactttgtcgactttcacaacatagtcaacctgggtctgtttaattgaagctggcgtattgggataaggcatgatgttgtcagtcaagaggacaacccgatcagcatattgggcatccattaacgcatatccgagtgatccaaagacagcgtcaccctgcatcccgttggcatttcctaacttgtcagcattcggaacacctaagaaggcaacgtcgattttaatatcaccatgctcaatcgcccgagcccggttaccatgggaccggaaaataaccgggttctttaagccgccgtgtgaaacaaagtcacctaatgagccacgcattcccgaacttgtaatattcgtaatggtgccctttttaatggcttcaatcaccatatcattcatcacaccagtcaacgaggaaggtgccaacgtgaggtccttaatgcccaagtcaatgataattcgcatgactttattgaatacaaaatcaccatttcggaaatgatgatgaaatgaaattgtcatcccatccttaaccgtttttttaacgacatcttcaatcgaatcaacgaccttatcattaccggtggtaacatgaacctttggcgctacccgctgaatgtctggatggccgatatcagttgtatcaaaacctttatagtttaattttttcatcaaatcatctggtaactcacggtttacactatttttcaatgtaatttccctcctcatcaagtaagttggatgccttggccagcttcatgactcgttgcgcccgcataacaactggtcgatcgaccatctgaccgttcattgaaataacaccggaaccctttcgacgagcttcttcaattgcgttaatcacatttttggcgttttcaatttctttttcagttggttcataaactttgttaaccatagcaatttgtcgtgggttaactaatgacttaccatcaaaaccaagttggtgaatgtaacgcgtttcacgataaaagccttccggatcgtccatatttgtaaagacggtatcaaaggcagcaatcccagcagctctggcagcgtgaaggaccatgttgcgtgcaaattcaagctcggcaccatctggataacgatgcgtcttcatatctgtcgtgtaatcttcagcagaaagggcaatcccaatcattcgatcagaagcagcggcaatttctggcgcattcaaaacacccttggcactttcaattgcggccatcaagtgagttgatccttcttctcgcccgaattgtttttcggcagcaaggacatctttttcaagatcctcgatcatcccggcatcctcagtcttgggcaggcgaatgacgtcaacaccagccttcaccattgccttcacgtcattagcatagtatggcgtgtcagaaccgttaacccgaacaaccagctcagcattgccatagtcctgtgtctgcaaggcttcatagaccaaatctctggcagcatccttttctgccattgaaacggcatcttccaagtcaaacatgattgaatcagcgccataaatcccggcatccttaaccattgccgggttattacctggcacaaacatcattgttcttcttaaacgttcaccattatcagccatttttacaatacctcccatgctggttgatcagcggtctttaatgcccgttgtgcaaccgcaattgtccgagctttaatgacacagtcaagggcacctttatccacggctttcacctttgcattgtcaatgtcaaacttcttcaaggtttcagtaatgactgattcaatttgatccccaaactgtttttttacatccgattccaaatcaatttgaatcccgtcattaccctttgagagcatgatttggatatctgatgattctaaagtacctgcaacagcagtttgcttaatttccatcaatattcattcctttcttaattcgcgactggagtattcccaaataatccttaataaattgataagttgaagttggcaacgaatccttgactttagtaacatcaccttcttgaatggcccttctaacattagtcgcagtgatatattggccagactcatttttatttcgctgaatttctttaacattaacttttggcggtaattcctttaataacgtttgattatagatgttggttgttttagaaagcggctcggttccgacataacgcgtcccgatgtgaagagccggcgcaatttgatctcgaaaaatccgcgcatccatcatcgtttgatacgtgacgttattcacattgcttggcaggaagtaagatggaaaggtcgcataactcaccatgtaggccccaccatcaacgaccatcacattttgtaagtcggaaagcccctccttcactagtttaactctttcttgagtggtgaacagagaagcatctgtactgacaacaaaaacataaacccaatcactttctttagccgccgattcaactaaaaatcgatgaccattcgtaaacggattggcattcatgacaattccagcaattttttgacgatccggctgatcaatcttagggagctcagctaaataatctgttagattcggactgcccgtttcgaggaatgctgccagctcagtgtgagctaattccgtgaagcctaaatgttgaaagctttcagaatatttcaatttggtaaaaaccagaatatgaaagacctgatcctggtaaagctggctggtaagcgcattaataatcgcattaaatcgactcccttgcgtgacacccttattgcagacgccaatgtatttcaagacatttccagaagctgatccggtaccaaccagctgatcaccatcatacataccgagggtaaaatcaatcgcgtcaacttctttatcgctgaagtcggcaatccccagcgacttcatgaacgtcatccattcagcacgttttttcttatcatgtaagtttagtcgaataatcgattcatacatccaacaaccaacctcccattaaactaattcggggttctgttcctgctcactggcatacttaatcaaagcggcactgaccgtatcgacaacgcctttatcaaagacacctggaattattttttcagcagttggtttagtgatcatccctgccagtgcattcgcaacaaccgtctgcaattcataaccaacatgattaatgccggccgcaagaagtcctctaaacaatcctggaaagacgaggatgttattaacttggttaggatactgacttgagccagtggcaataattttggcaccagcttttttagcatcttcgggatcaatctccggatctggattggcaagtgcaaagataattggcgaatcagccatcttattaacatccgcagtcgtcatcaagttggcatcagataacccaatgaaggcatcctgattggcgatcacatcggtcaattgcttgtcttttagatcagctgtcacatttagtttagcggccatgtcagtttgataagcattgtagcgattatcatgagcagtgacaacgccaaacttatcgactaaggttaaattcttaatgccggcttcaaataacaacttggcagtggctaaaccagaagccccaacaccattaataacaactttcaatgaatttaatgatttcccagctactttggcggcgttaatcaaacctgccaaaacaacgattgccgttccttcttgatcatcatggtaaacagggatattaagttcatctgaaagcttttgctcaatttcaaaacaccgtggtgccgcaatgtcttccaagtgaattccggcaaacgaaccggaaatatttttcacggttgctacaaaatcgtcaacaggaacttgggcaaccgacaatggaattgcattgattccagctaaatctttgtacaaaagcgctttgccttcaataaccggaagaccacccgcggggccaatgttgccaagacctaaaacggcagtcccatctgtgattaaagcaaccaatttaccgctcatggtataccggttcttcaactcaggatggttggcaattaactttgaaagaattgcaacgccaggtgtgtaagcttttcccaaatctttgcgatcagaaacggatagttcggattgaatatccaaaacacccgtatgcagttcgtgaagtcttaaaatatcttctctttcattcatatattttttctccctttaattcaccaaattgactgatgattcatttcaattgaaactacactcatagtttactgcatctttttatatttttcaaattacatgggatatttttatatttgtaaaagagtaggtcgcattagttgaataatttaaagcgtactttcatttttaaaaagctgtgctataatatattcaatgattttaagatgcctcatacctggtgagctaacccgacttaaggcaacgtaacccttcccgcaatatcgtcacggataatcgagagtgggacgaaaggcggttaacttccagagcgtaatcggattatccgaatattccgggcttgaatgtttggataattcggttacgcggcaggaagttgccttttggcgcacgttttttcttggtaataatcgtgattacacaaatggggctgggatcctggcaaagtcgagagatatccgttactcccacacataataatggaggaaacaacccatgaacgatgttaaacatcaagaatttctggcaaatattgctcaagatttttatatttcaaaaatgaccgtaactgaactatcccaaaaatacgatcttagccgctacctgattaataaatcactggatgaagctttatcatccggattagttaagataagtgtggcaacaccaattacccgaaatctcgaattggaaatgcgattcaagaaagaatttggtatccgagacgccttcattatcaaagattccgacacgcctaatgacaacaatgaaaatattatcgaatatgccgctgaagaaattcagaatctaattcgtaaaagccgagtggtggggctcacatggggtgatactgttttaagcaccattgctcattttcaaacccagttcaaggatgatgttgtctttacacaatttgttggcgataacatgaaatacaattcattatctggtgccacccccattgtggaaaaagcggcaacaaagtttggtgccccatatctaaccatgcctggaccactttatatcatgaataatgatgcccgaattgccttgcaaaaggaacctgcgctattcccggcatttaataccgcatctcgaatggatcttttatttaccggaatcggaaccttatcatccgtcgataccattccggtttggaaacaacatcagactgagatctttaaaggtgttgaccttgagcaagttgccgggatgctctatggccgaccatatgatattaatggcaacattcttaacatgaccgatgacaaaacatttggtatttcggtggacaatattatgaccaccacccatcgaatcggaattgttaaaagtaagttcaaagcgcgagcactattaggtgctcttcgtggccaattgcttacagaggtcgtcacaaatgaagccgttgccaaccgagtgctgctcgaagaaaacgagaatcctgtcatcgcccagtaatcattgttggttattaaatcatgctgcagattcttagccgcgtaggctgtaaacattaccgagctggcgggagatgattctgttttaagaatttcaaagtcaactttaaaaaatcgactggttgttcagccatgaccaagtgaccggcattggcaactatcttggccgatgcccgtttggcaattttggcagtggttgccgcaaaattcggatcaaaataaggtgactgttcacctgctacaatcaataaaggtcggttcagttctaaaatgatatcccgccaatcctgaaatgcatgatccactaataatggatagttaatttccgggttgtagggatatttttttgcagcagctttcatatccgcaaacacatcatcgttaattttatgaacagctgccttgccaaacggaaacttgagataatccggaaagctcgaccactccagagacttgaatccgaattgccaagtctcatcactaatcattttagggctttgatcaatgtcaataatggccaaaaaacggtcatcgccaaacaatgagatgtaggcaaacagagttgcggcccccattgaattgccaattccgattactttgtcgatagctagtgaatcaagcagctctttaatatcgatagcatgacgactcatccggcggcccctaatggtatgctcagaggctccctggtttctggcatcaacattaatgactcgaaaatgatgactcaatagtggtgaaataattggttcaaatacttctttatagccaccaatcccagacaaaagaagaatggcgggaccttcaccttgatcattgtaatcaagtgcgacatggtcactagttgtaaatttcataagttcccttcttacatttttattttcaacgcaaggctaaaccagccaattcttgcaacaacaaaaggcgatcaaaacaaaattttacttttgtctcaatcccctttcgtctcgataatgttgttttatttaattttaccgatcataaaatgcttattgtcaagctgttaccagatgccgataaccttcatccaaaggccaccaattccaatccaaacaaccaggtaaaagagacctaaaatggcattcatcttccaccaatcagcttgtttgacatatccggaaccaaagagaacggttgctggaccattagcaaaatgagtcgttgaaccaaagattgcacccgtgaatcctaaaataatggcagaaagtaatgctggtgcaccagctgaaatagcaactcccagcaaagctgaatacattgctgaaacgtgtgccgttccactagcaaatagatagtgagaatagaagtagacaagaaccaaaactagtagcacccaaatccagctaacaccatttaatgcacttccgattgactttgataaccaagggacaacgcccaatgcgtttaattcattagccatgaaaatcaagattgaaaaccagagaattgtattccaagcaccagtttcgtgaagaatatcattcattgttagaacaccggtaagcaagagcaatccgacagctaagaaagcaactgttgcggcatccagaccgatgaagctggataaaatccataataccaatgctaaaacgaagacgccggccatgactttttcaggattagaggttttacccattttttccaattctgagtcagcccactctttagcgtttggggtctccttaatttctggtggatacattttataaatcaaccagggaacaatagctaaacaaataattccgggaactaaaccagctaagaaccaagtcatccaaggaatattgacatgtaacgtcttggcaagtgttgcggcaaccaggttgggtgccatggcagtcataaacattcctgacgtaataatgtcaccatggaactctgaaaatacaaggtatgcccccatcttccgtcggctctcatcatctggtaatgatttatatgtgtgcgccaacgaatcgatgatgggaaaaacaatcccaccggaacgagccgtattacttggtgtcgccggtgcggtaaccaaatcaacaccaattagcgaataagctaatccaagcgtccgtttaccaaataaccgaataaagactaatgccactcgtcgaccaaaaccggttttgatgaaacctcgtgacaagaagtaagccattccgatcatccagacggtactatttccaaatccggcagtagcagtatcaatatcaacgatccccaacaatacggttaccgtcattcccaaaagtgccgtggcaccaattgggagtggctgggtaatacagccaatgatcgtcgcaacaaaaatcgctaacatatgccagccggcaactggaattccaaccggtttaaatggcgttaacagccaaatagccaagccgatgataaccggccaaataaattttgaatactttactttacttaaatgctgcatttcgcatatctccctcagtaatgaggcagaggcaaagcgctaacttcactccaaccttgttttatttgttctgtaaaaacttgtacgattgttgcccagcctgacggccaaagacaactgtttcagcaattgaattaccaccaattcggttgttgccgtgaagaccaccagcaacttcgccaccggcaaataaacctgggatcactttaccgtcatccgttaagacttgggcatcatgattaatcttgacgccacccatcgtataatgaacggcaggtgcaatatgaatcgcaaagaatgggccattttcaatatcccggtccattccagttgcccggccaaactcaggatccttttgatcagaaactgctttgttccatgtcttaacagttgctgccaaattctctggatccacattaatatttttggccaaatcagcaatatcattgccgtgaacaaccagaccaatatgatcataaaattcgattgctttcacatgcgcacgaataccagtatccaagataagataggcactcttttcaggtaactggttaatggcatttgtcacatttttacgggtatccaattcattgacgaaacgttttccttcgccgttaaccagaatggcgccttcaccacgagttgcttcaccaattaagaaggcatgatcggtatcttgttggacagttggatgaacttgaatctgatccatatcgactaagccggccccggcagcttcggcaagtttgatgccatccccggttgcacctggttgattagtcgtattgtagtcaaccaaatcaggacgatattttttaatgatgtctttgctggcaccaaagccaccggttgccaagataactgccccagcatcaatcgtcttttgacttttatctggtaacgttaccttaacaccgctaattacatcagtatttttttccaattcatccacgtgaacgtcatcaaaaactgggatttcagccttctcaatcaattttaacaattcagtcacaagaaaattgccaataggtgccatactagccggtcgatgagttcgtttaatcttcatcccaccggtaattgtcagatcatccaaatgaatgccgtgttcagccaaccagtcaattgccagcgccccgtgactggtaaagtaatggagcatatcagtgttgttgagaccacctccacccttataagtgtcttcataaaagtcttcgtagctgtcaacaatatgatgctttaattgaacatcggtttcagcagcgttcatccctgaagatgcacgggttgaattgccgcctaagcgatccatcttttcgaaaataactggtttgacccccagttcatgtgcttgtaaagcagcaaccaaaccggtggcgccggaaccaacaatcaccaaatcgtactgatcttttagttgttcaattggagttggtgtaaatacatattttgcggccatatattgaatctccttttatttacgcggacttaatcatttacttaaataccgaaattaaatgatgattatttatcaatgttggtcatctttaatggatcgacccattcatcaaattgttctgccgtgaccttacctgacttaacagcagcatcctttaactttgtccctgctttgtcagcagcttgagcaattttggcactgtcatgatatccaatgtgtggtgataaagccgtaaccgtcattaacgagttgtcagtcaattcctgcatccgttttgcattgacagttaaaccatgaatcatcttatcggcaaagcccatcatcgttccacgaagtaaatcagcggattccaagaaagcgtcgattaagaccggtttgtaaacgttcatttcaaagttaccttgtgaggccgccaagtcaacaacgacatcgttacccattactcgaacggctgccatcgtaatagcttcggcctgagtcgggttaactttaccgggcataatggaagaaccgggctcgttagctggaatatttaattcatcatatccggcacgaggaccacttgctaagaagcgaacatcgttggcaatctttaatagatcggctgctaatgtcttcatggcaccatgaacaacatttaacccggaatgagcagctaatccatcgaatttgttagtatcggcagtaaatttcaagccataaaccttgctcattctttcggcaatatcatcagcaaagtgaggggcagcatttaacccggttccaacagcggttccgcccattgctaattcaagtaacgtcccatccaagctctttaaataaccgaggtcatgttcgatcatgctgacccagccactgacttcttgaccaaatgtgagtggcgttgcatcttggagatgggttcgaccaattttgactgttcgccaatacttatcctgttttaccttcagctcatcaattaaatgttgagctgccttttcaagatcctgaaccgcttcactagcggtaatattcattgcagttggaaaaatatcgtttgaactttgaccatggttaacgtcatcatttggcaagatttcaatactgtcatcaatctgggctgccttatgggcaacaacttcattaacgttcatgtttgtttgagtaccagagcccgtttgataaactttcaatggaaaatctttacgtaagtcttcatctgataagcttaaaagtgaatcaatagatttgacaatcaactcgctcttttcagaacttagtgcgccctcttcggcattcgcctgtgcagccgcttttttaatctgtaatagcgccttaatgatttgaagcggcataaattgaccagttgggaaattattccgacttctttctgtttgaggaccccataaagcactggctgggattttaactggacctaaagtatcttcttctgtacgataatctgacatcataaaagcctccatttttgtgatattgttaacaaatatgagtaaataaaaaccaaattttccatatttggttttattgtaaccgtttttaaggaaactgtgtaggccttaaacttacttggtagccaccacaatttctgccatctgaccagctgaatgacgcatcttggctaattcatcactagataatggcacttcaatgactttggcaatcccttgggcattaataacagccggattaccaatgtaaatatcatgcaaaccatactcaccggttagtggcgcgctaattggcattacgaggttttcgttattcaaaactgctttactaattctcatcaagctcatcgcaactccgtagaaggttgcccctttttggcgaataatctgaccaccctttgcgcggacatctttttcaatatttgctagttccttggaagtgatctcacgattgtacgcaacatccttaagtggttgcccttcaattgttgcttcatcgtatgccgcaaacgatgtatcaccatgttcgcccataacatccgcgtttacatcttgtaaactcacgttaaacttgttagctaaggcaacacccaaacgggcagtatccaatgaagttcccgttcctaaaacccgattcttggaaaagccggaaatccgttgggtaatggtggtcaaaatatcaaccggattggccgatactaagaaaatgccatcaaatccgctgttaacaatcggtttaacaattgactctaaaatctttgtattcttggaaaccaaatctaaccggctctcacctggtttacgtgggacaccggcagtgatgacaaccaagtcagcatccttggcatcttcataagaccctgtccggataccagctggattagtcaatggtaagacatcttccaagtcgaggacatcaccttgggaatgatctttttggatatcaacaatgacaatttcatcagcgacattagcttgtaacatcgagaaagcatatgaggaaccaactgcaccgtcaccaacaagaacgacttttttagatttattaatattgttaaacataattagtacctctccatttagattccaaaacagcaccagaattctactataacaaggcttataaattccgtcttgtgaaactagatacattatagcgtattcttttaacttttgcaaaataaatgtgatgttttaataaatttgaagtaatgttcgtgaatatatcgttttcatcgttattttttacatttatttaaatctttatgagtgaccaataaaccgttttttgaatggatgtgatcttaatcacgattatttttaaccatccctttctaaaacatccgttatttactgcagatatcacgatcaattccacttcaagtataaatttcatgaatccgatttcaaataaaaagcccttctcaattaatttactttgattgttaatcgagaagggactattcatcatatttaattagtttaaattaagattttttgagcaccgctatgtttttcaaagaaggttttcgcataagggcaaacgggatcaattttcagattgaaaatttgagccagcaaaatcaatttaacaacaatctccgctgcaattcccaagcctcgaaaatccggatcaacagtcacttcagtaatcgtcaagatacgattattgattgaaaaaatgccgttaccaacggtttgctgctgactgttaagaacaattaattgagtcggtgttggccgataagagaccagttgggactgtgaggatcgtttatccgtcgctggagcagacaatatatgctgaactaaactggtgataacttgattaagaaagcgccccgacgaatcattattcaacaacccgtttttagcaaagagtgcgttagctctactgagatacacttcagccggttgaataattgtcatgccaactgctaaagcgacttgcttcaaatgctggctggcaccaaagccaccaatactacccggcgaatttgaaataatcatcgcgggtttgccattccatgaattatctccggccggccgtgatccaacatcaattgcgttttttaaaacaccgggaattgagcggttatattcaggcgtcacaaacaataaagcgtcagcatcagtaatttttgacttaaatgctgtccattccgacacgccttgatcttcaagatcttcattaaataaaggcaatgtcccaatctcaataaattctgggataatttcatttggcaacattaatgctaagttttgagcaaccttcttcgaataagcctcttttcgaaggctgccgacaataattccaacctttttcaagatgaatccccctttggattaaataaaccgttcgtcaaatcataaataaaaggcgcataaataactcgtatcgttaatcatttgtttgcaagtctacttttaattgtcttacttgcttatttgaaattttttattgcatcgcatacttgagaagtaactcccggccatgtaagtctctcaatcaaatattcaaaaccagaatattcgatgtggactggctacctagataaaacgtgtgatagaaagcaactcccggccatataactctctcaatcaaatattcaaacccagaatattcgatgtggactggctacctagataaaacgtgtgaaaagagggctgatcccggccatgtaagccgcgtcatcaaatattcaaaaccagaatattcgatgacgcggcttacattctgggatcaaaacgccctttttcacactctctactcatggtcatacatcccaattcccaacggtgttacaaactgcggaaaacttggcttatgcaccggcattcctaatgttttgctaaacgttggaataaaatccttaaaattaatcgcaccacccacaactactaccggctgttcaattgtcttactggttgcggtcttagtaattgtggccatcttttcaacaaccggtcgaataatcggaaaaatattctgctcttttttaggatctcgtttcaataattcggcctcatcagatttaatatgttggttaccagcaagaactaaggtcatatgaaagccgcctgtcggctcatccacaacctcggtaagcttaccatttttaaaaacactaatccccgttgtcccgccaccaatatcaacaaccgttcctgttttaagacgcaaaaactgtgcagccgccgttggctcatcaacaacatttcggcaaacaaattcagctgcctcaatcacgtttgaaacgatcttggcactactttcgccagtgcctggtggaattgccccacaagccgttgtcaactcaattcccaatactttttcagccttttgtttaagtcgcttaagaatttgaactgattccatgtaattaacgacaatgccatcccgaacagcatgatcatattcaaacgcaccatataacggttgattatcatgatctaaaaccgttaaaacgattgaagacgttcccagatcaatgccaacccgaagtgattcattcttatgcaattttcgaatagcatgatcgctgttaaccactttagcaaacttttgcagttgttcattggctgcctttaaatttgtgaatcgttttgtttttgtttgcatacaaatccctcgttttttattacttttgcagattacattgttaattttaacacgtttgtaaacgttatcacagagtcggtaattaaatatgagctcgaaattttcgaatctgttaaatcaaaagtcaactaattgattaatgacacaaaaatggtaatcatcccattcttcaattaatccaattctaacgccattcgcttaccatagaagcaattgagaccacatcgtttcttaatatttacctagaagctgacattcgtaaaacgttcacatttgcttagatgtaatgttttatcacattaaaatgcatatttattctttaaagcaactaaaataagtataatttttttgttgactttgattattttattgctagaatggctttaaccaacatgttaggttttatcacattagtcacaaagaatgttaggaggcatttttatggcaaactcgcttaaacgcggcatgggtttttggggcctcatctcaatgggagttggcggcgtcatcggcagcagttggatttacactaatagccaattctttaaacaatatggtgcaggtggtgaaatctttggcttatcgctcgcatccgtcttagcagttctaatttcactatcatttgcagaactgtcaaccattttcccggagtcaggcggcgaagttgtatatggttatgctgcttttggaaaaaaaggcgcgcttttcgcgggttgggcactcttgggatcatatatcagtattttggccttttatgtgaccgcctccagtttcttaatttcaacaatttttcctgaaatcgcaactggcccttactatacttttgccggggttaaagtctatttaatcgagttagccattggcatcgcatttacggtatcagtttttgtaattaactattttggggctaagttaactggaaacgtccaaattgtcctcatggcattactgatctttttaggggttgtcattattgtggtcgggatggcaaagggtcgcccttccaatttcttacctgctttcacagacaaacaaccggttttttcgtcgatctttaggtttagtctgccggcaatgacgtttttaacgggatgggaatcagttgcgattctggcagaagaaacgaatattccaaagcgaaaaatcggaattgttgtcatcctttccattgttatatccgcattcttttatatcttagtcttactgtcatcagcatggattttcccttgggaaaaaacggccaccatgcaaatgggcaccatcgatgctttcaaagcggccggttatccggtactaagtatttttgcttacctcgtatcgtttttagggttagtaaccgcgtttttaacgctttttaccgctgcaccgagacttatcttctctttagcccgtggaaacattctgcccaaagcctttgctaaagttcatcctaaatatggaacaccaacaaatgcattatggctagtgttggcactcgttcttggcttgggttggattggtaaaggagctctagtctattttcttgacatgggtggattttcaatcgctttagcgtggtcatttgacgctttttgcttgctgaagatccgacttaaatatcctgatatcaatggtggctttagaaacaagcaccttattctacccatgattggtggtatttttgcgttaagtattgccatcttcacaatcattccgggaactccagtttccctggtttggccgtatgaatatgttattttaggaatttggtgtgttcttggtttgggtagttgctttatcaagggacatgaactatcagtttccgaagatttattaggaaacagcattgaaaatatgatgattgacaaaaaccatataacacgcaaaggagagtcttaacatggatcgtactattatagaaagtccaattccaatttcatctgttgcatgggactggggcttatcgcatgaaccgcaaattcaggaatcaaatgagccacttgttgcgtctaatttttatccagaacgcattatcaacagtcccgaatatttcaatcagggaattgatggcacactaatgtcaatttacgttcgccagtcagtctacgataagctaatcaatgcggccacactcttgccagaaggctataaatttgttttattcgatgtctggcgctcaaacgaagctcagcagtcattatttgatattttaaagaataaattatcaaagcaatacccggatctttcacagcctgcattattaaagcgtgttttaacaacggttgcgccaccttcggatgatatcataaataaaccttctccccataatacaggtggtgctgtggatctggcgattattgatcaaaccggtcacccactcaaattcggaacccctttcgatgatcacacagaagttgcccggacatcttactttgaggaaaagctttctcaggataatcaattaacgtctgctgaggaaatgattcttcaaaatcgtcgtttgctttacaatattatgactgaagttggttttaccaactatactgatgaatggtggcattatgattatggtaaccaaaattgggcttggaaatccggtgcaccatatgccatttacggttcaattagaccaacattcacctggcaagatccattaatatcataaatttcctaattaaaaattcccatcgacagcaaaacccataaagcctcttcattggcattatgggttttgttaggtttgttcaactatccattcaatcaaaatataacaattttttcataatacctaacgattaagaggctaaccaatctaaaatttatgcattaagcttgtccggcccagtccgcaggatacgtcgtataaataaatcgagcttcatcaggagcagaaaattgaatttggctccctttgggaataagaatcatttgaccagcattagcagtggcggtcccatttttcccaataacacttaaactccccgaaatcacataatcgatttcatcatagtttaatttccagtcaaaagtggtgtgcttcattaccatgagaccacaacctaatcgtggactttcttcaagggtaaagaagtccttggtatagacttgatcactaggatttcccgtatccatcctattttcttcggtaacgtgccaattaggcgtgtcaacggtaatcaaaccatccggtgttgcattcccattaacattcaaattttccgccagaactcttctaacaatttcctcaattttttctcgatcaatgttcattcagttccaccttacctttttcgtcgccttttttgactttgtcttctttgccaagaacccgatttgccataaacattgcaaccgcaattgctgtaattcctgcgactaatttggcaacaatcattggaaaaatcatattcttagcgacaccagcagtaaagcctaaatgatctccaaacacaaatgctgctgaaacggagaaagcaacgttaatgattttcccacgatcatccatatccttcatcatttcaaacatcggaatattgttagccaatgtagcaaccagcccagccgcagcggtttcgttcattcccaatgcttttcccagatgaatcaacggcttattaaagaccttggtaataacatatacgagcgtaaaggccccggctaacgtcattgcaatgctaccaacaacctgcacaccttctcgaactgaaccaattcccggaaccagcgtcacacccaccattgattgaatcgcaccaagggctaatccaaatgtaccaataattacaattgcttggccgaacacggaaaaacctttaatcattgcttctggtttaaaccacatccccaatgcaattaatagggcaaacaaaataattggaaccagatttttcaagacatcaatcaccggcattcccatcaccaatccaccgacaaaacagccaattggaatggtaatcatccctgacaacacacctgttgctaaaaagcgatgatcttttttatcaataattcccaaggctactggaattgaaaacacaattgttggccccatcatcgaccccaaaataacacccgcaaataaaccagcttgagtattttgggccatctgagttgccaattggaagccgcccatatcgattgcgatcaaactagttgcaaacattgacggatccgcacctaacagttgaaacacaggtacaacaactggggataggaccttcgccaaaatcggcgccaaaatgatgatcccaaccattgacattgccaatgatcccattgccataattccttcttcaaatttttcgcctagaccaaaatgattaccaaacattcgatcaagcgcacccaatgccataaaaaataccataatgtacataataatttcattaattcccatagcaaaattgcctcctttcttcactacctttagtcgattcttatgcagccttgctttcttcaaataaaacggccaagacaatccaacgccccagccgttaccttaaattcgatatcgttattcgtcagcgccatcctctaaactttttgacatatgtggcaaaattgcatccacttcactatgaggccttggaataacgtgaactgaaattaattcgccaacggtctcagctgccgaagcaccggcatctgttgctgctttaaccgccccaacatcgccccgcaccatcaccgttaccaaaccagctccgatttttcgttgaccaattaaagttacgttggcggcttttaccatcgcatctgcggcctcaattgatcctacaagtccctttgtttcaatcattcctaatgcatttgtatttgacataacagtttcctcctattattaaattacttgattttagccattacttggcgaacaattgcttcaactagttgcttttgatcatggactgcaaccacttcgtcagcttgttggctctcttctccacgaatgtcgtgaagttctctgacaccgaccgctacccgtttaatattgataagattcatcggattaacattgtctgaagtcgcactcccaccaatcgcaccacatcctaaagtcagtgacgggtccaaattagttgaggccccaatgccccctaaagcaccaggtgtgttaaccaggattctagaagcgggtaccaacaatgcatatttacgaataattgcttcatcttccgagtgtaaaatggctgtatgaccagcaccctcgttcattaataatttattcgttaacgcggcggcagcttcacagtttttaacctcgaaataggctaaaattggcgttagcttttctcttgaatatggatcctgtgggccaacattctccggcgtgtcgcgggcaatcaacacacgggttccctcgggcacatcgatctgagccagatcagcgagttgtttaaccgattttccaacaatttgaggattcatcgtcccgtctgcgcgtaaaataaactttgataatttagcaatttgaccttcacttaagaaataaccaccctggttttttaactcttgttgaaccgccaacttattggcatcctcagcaataatcgattgttccgatgcacagattgtcccattatcaaaggtttcagaatccataatccgcttaacggccaggtagacatcggcacttttttcaatgtaagctgatccgtttcccggtccaacgcctaatgccggcgttcccgaagaatatgccgcgtgaaccatcgcaccgccgccagttgccaagattagctttgtttcggaatgacgcattaattcatcggtgccttccaaagttggcgcggtaatcccagcaattaacccggccggggctcccgccttataagccgcttcaccaacgactttaatggcctccaaagtgcaattcttagcgttggggtggggtgaaaagacaattgcatttccggatttaacagaaatcagagccttgtaaaaaacagatgatgttggattggtagatgggatcaacccagcaatgacaccaacaggaaccgcaatgttgacaatcttattttcaggatcctttgataaaaccccaattgttttcatacttttatatcgatcattgaccgtcttggaaccaaacacattttttaaaactttatcctgccaaattccaaatccggtttcttcttgtgccatttttgctaatcgttcgcttgcagcaaccgccgcatcagcaatcgcctggcaaatttgatcaactttttcttgagaaaatttgctaaaaatttgctgagctcgggttgcttgatgtagtaaagttctaacctcttgaatcgaagctaaatcagcatctgttaaattcacgtgtcatctctccttcgcacatttatcatcattaaaataaattaacattactcagctttcggagtatcagcaatttcctcaactgctcttgcaaaggcatcacaagccgctttacaagctgattggctacctgttaataaaccgccaccgaagttggtttccgaaggtggatcgtacaaaatgcccatttggacatccgcagctttcatcgcagcatctaatgcatagattgactccaatggcggcgcaatgagataggcaaccgctcctccttgggggacgccaatcacttttgacagataactacctgttcgagaaatggtgtgggcaaaatagacaatactatcatcgtcattggcactaataaaatgtgcctcctcttcaatcactcgaatacaagtatctaaaccactacgaacttcatcagggctcgggccgccaatgataccgatcacttcaccagccagctttgtagatgcatttcctgccccggcatacatacttttgccatagacaacttcaacatctgcggtcttagtcgcttcatccagtgccacataggtgacatcatcacaatcagaagtaattagtccaagacttttaatatgatttggcaattccaatgacttcgccagagctggatcaatattgggaatcagtctggtactcaagacatttgatttcatccgatcatttttcaatttacaagtcctcctttcttcaaaccatgcgttattagttgccggcgttttctgcagcttttaaatcaattcctgactttttaaggcgaatcatcttatcaagcaactcagcaatataggccccagcttcaacagcgggtaagccaccatcatgaatatttgagacaaccgttcgatttgcttctggcatcccaactgttggtttataagcaatataggcactcattgacttagcggtcaccaacccaggccgttcacccaccagcatacaaacaacatcagcattcgtaatctcaccgatttggtcttcagcaccaaccctggcatacttaacgaaaatcacatctttcgtttcaaaacttaacccgtaaactttcaatccctgctgaattgccggaataatatcttttacgtttgcttcaatggccgctgaacttaacccatcaccaacaatcatttgaatctttggactcggtgtgacactttgcttgattttttcggccatttcatccgaaaattttcgaccgtgatccggtctagttagatattcgtctttggactgacaagttgtttgagtttccaagaaccccatttcttttggcaactgtggatcaacgtcgctaaaaacagcatcttgagcagctgcatgatctgccctaaatcgaaggaccgaggcggttttataacggcaccctgcccgccacattcctaatcgggctggtgtaaatgatttaatttttaaatagccttcccgatcatgagggtgcggaactagaaattgttttcttaggtcgatttttgtaatgtcatccaacacatcgccagagatatcttgttgcgtcgcttctttaggtgctgactcagtggtttggggtccaacattatttttatcagcttccttagtagaagtcatatcagttaaaattgtttcaatcattgatttaatatcttgttcgttcattttttatcaccttccccttagtttaggaaaatcgaagcgtcgccggctcgttccgttaactgaccattgtggctaatgtccatcttttccatccaatcctcaaattctttaatgggatgatagccaaatatttcacgaatggttgcagtttcttggaaacctgttgattcgtaatttaacatcacatcatcagcatgtggcacacccataatgtagttacatccagcagcaccaagtaacacagccaggttttctgcatcattttgatcagctttcatatggttggtataacaaacatcacagcccattgaaattccctgaagtttacccataaaatgatcttccaaaccagctctaataacctgcttagagttatacaaatactccggtccaataaaacctaccaccgtgttgacgatgtaggggtcaaactttttggcaaatccatagcaacgtgattccatcgttagttcatcggcaccaaagttggcttcagccgacaattccgaaccttcaccagtctcaaaatacatgacatttggtccggctgcttgaccttcatgaagggtgagatcgtatgcttcactaatcatgtctgcattaattccaaatgcggtatttcccttttcagaaccggcaatcgattggaaacataggccaaccggtgcaccacgtttaatggcttccatttgggtggtgacatgggccagaactgaacactgagttggtacatcccactgcgcccggaaatcctcaaacttgttgagaatcttgacgacgctgtcaactgaatcatcgttgggattcaagccaatcacggcgtctccaattcccatactgagcccttccataatgccggccatgataccgtcaatgtcatctgtcggatgattagtctgtaatctggaagagaatgtgcctggacggccaatcgttgtatttgctgtcttttcaacaatgattttttttgcggctatgaccaagtccatgtttgtcatcaatttagtaattgcggcagccatttctgatgtaattccttgacgaatccgtttaatatcataatcggtggttgtgtctgataatacccactcacggagatccgaaacagtccaatttttgatttcgttataaattcgcttattaacgccatcaataatgattcgggtaacctcatcatcttcataagggacaactggattattgtagatatcttccagagtaagattgctcaatacaacttttgccgcaactcgttcagtggcatcttctgccgcgacgcctgctagttcgtccccagatttcacttcattggcttttgccaaaacttctttcacagatccaaaacgatataacttatcaaataactttgtttgcaaaatcattctgctgcctcctccataatttcaaaatcctttttatccaaaaacaagtgttttaacaatcactggtaatacttcgccaccagccaccggttcaccaatatcgatatagtcgccgttttccactttgacactatcgatacaaacaaatgggtactttgccggcagtcttgcaaagatactgtgccccaaggctttcgccatatcttcatgaaccataatgatcagtggctcatgcttggtgattaaaacagttgcgcctttgacgattcctgccgcatagcgttggatatccgcaaaactggggctatgcttcccaactaaagccaaagcgacattgtttaactcgttttgaacacgataccagttaattttctcggaaattttagccgctaagtcatccacatcaagtgactcgtcactttttgcaatttttaaaataggtaaatttcttaacggtaagatcccttctgtgtaggcaattgtgctgccggttacatcagtcgtgtgggaaccggctccaactaccgtcgcccgaattgtctcaatggaaggataaacatctttttctttaaaaattaacgaatggcggactgcgttgcccagcagtaagccaatatcaccatatctaaattcatcatccggcaacgtttcatttagacagtcagcaacaccgccagaaaatgtgacaccgtcaatttgattttctggatttaaaccatgatttgtaatgaataaatcaaagtagggacttttttgacctaacccgatactattttccaatatttgggtcaagcagttaattaccggttgaagttgctgatcagtaacttgagcttcctcataaagttcatttagatgaagtcgatcaattagttctttgacctttggtgcaatgtacgaaattcgatgagactgaggatcaattttaattaatcgaccgccgacatcaaaacacgctgtatcaatcacatcttcatcactgaaaaggcccaagttactggtgccaccaccgatatccatattgacaatgttttttcgattttctttagccacaatattggttccagcgccttttgctgcaatgatgctttcaagatccggaccggcagttgctacgacaaagtcaccagcgtagccacttagcgcctgagtcacaatctccgaattttcttttcgagccgtttccccagtaatgatgacggcccccatctgaatatcacctttattaacaccggccttttgatactgctccgagacaaaagttttaattgcatcggcatcaatttcggtctgcgtttttaagggtgtaaaaataatattacttttaaagatcacttctttttttgaaatattaattctgggaactgaaaatgctgaagcaaaatttttaattgtgagtctagatagaatcaactgagttgtcgatgttcccaaatcaattccaacgcttaagatttgattgtcgttcatacaccaccccttctttcaaaaaaatgggactcaagatcaaacccgtttgcttccacatttaaaacaacttgtgaaagaaaatgatttgatcttgagccccattgctccacacaacatcaatgttgcgtttgttgatcaaacgagaaacttgtcacggttcctcgacttgatgatttaatttttaaacgccctaatagtttatcagacacataactacgtataatcattaatcccaaactgccagaccgagtttgatcaaggtcaaagccaacaccattatcttgaacccgaatggtgataatgccattttcagcctgtccaataattgaaacctgactatctttttgaatgccatttggaaaagcatgagaaacaacattttgcagtaattcattgataataattgaaattgtaacaatttgatcattatcaaccacaattgtcgaatcaatatccaatttaattttcagcttcgttgctgaatcattgagttgaacaaaatgagatatcaacaattggatggctgctttcaaattcgtttcatcatctaattgtttggacatcagttcgtaagttgatgcaattgccattattcggctaacgctttcatttaaagctttcttggcttctggattctgaatacgccgctgttgaattcgcagcaatgaaataaccgattgtaaattattcttgacccgatgattgatctcgcgaatagcaactgacttggaaataatttcagcttctttccgcttcacatcggtcttatcttggatcaggataactaactgtcgattttgcttattccaaaacttccttgatctaaaaaagtaatttaaataattaaagttgctgacaagtggctgttcatcatcctgaacctgctttattttactggaaacctcagcgaaattcgatccatctaaagacaaattatcataagtaagtccaaagatattgccgatatagccaaccttttgatataactcaattgcagtacgattagctaaaaccagatgtcctgattggtcaaacccaagtacggcatctgccaactgatttgtaacggctttatcgagtcgaccaaacaactggatcgttgctgagacgtcattgtaccgtgattctaagtcgcgtccctggaaattatcgagaacatcttgagaaacatctgattccactattgtcaccccaatcgttcgattattgaaagcaattggataaatccgttggcgaattaaccgatgttcctgcgtctccgccagcaaatccacagactttagcttcgtttcaaatgtatgaaaaacgccaggttcattttctctcaaagcatccttaccaacaacttgctgacgatatagagatcgcccattctgaggcagtttatgataaacaaccacagcctgtccattaaactgatttttaacatcaataaagacatcgtagtcttcgtagtcgtcgacctgttcaatgcgttttgcttcgaatatcaactgcctgatttcatcttcatctaaatttgtgtactgcttgcacaattctaccagtcgtttcattaagcatcagtcacaatcagtttagcaatatcagtcattgatcgccgcttcgacatgcttaaatctctaagcattttataagctgccccttccgaaagatgattttcatccatcaacacacctttagcccgatcaactacttttcgctcttccaacttggtatacaatttttgtactttttcatttaattcctgataacgcttaccataagcaagtccgacttgtatcgtagtgagcaaagatctctctgaaagcggtttcactaaatacccgactgcaccaattctgctggcagttcttgtatcttcttcatcgctgtaagcagataaatatatgatggaatttgctaaattatcttcaaggatcttcttaccagcttttaaaccatctaataatggcattctgatatccattatgaccagatcaggcttttgctcctgacaaagctcaattgcttcaaatccatcgctgccctcaccggcaacctcgtagcctgcctgttcaacgatatcgcgaatatccattcttgtgatcggttcatcatctacaattacaattcgttcattcatggtcaaacactcccctagcaccatgctaattcatttaaggtatcttccgttaaatcacccaaaaataatgacaataatctgttaggcagtcgttccccgaattgtaacaaccacctaattcttcaccaattagtaatttaacatatacgaagtaattataatacgtttaaatgaatggcgtcaatcaggaaaagcatagattcaaaattttgatcacatcttcacaatttggcttccgaggattagtcgcagttgttccatctttcaatgcagctcccgcaatttctgcttgagtcttatcaaacagtgcttcactaattccatattccttaaagcttgcaggcattttgagctgccttcttaactgaatgatagtgttaatcaaacttttaactgccatcttaggattaatcgcttgaatcccaatcaatctcgccaagttagcatatttcaaagcggccaaatttggtttaccagtaataccatcatccatttctgcgttgtaagcaataatgtgaggcatcaaaatggtattcaaacgtccatgaggaatatgatattgtgcccctgctgcatgggcaatcccatgattaagtcctaaattaaccatgttaaatgccattccggcaatgcatgaagcatcatgcattttttgacgggcaaccatgtctgctccatccttactaaccttcggcaaatacttgaaaaccatttgaaatcctttttcagcaagtgcatctgaaaaatcattcgcgttaaccgaaacatatgcttcaagacaatgagttaaaacatccatgccggtatcaacagtaatattctgtggtgcagattcaactaactttgcatccaacaatgccaccttaggaagaatttcatctgttactaatgggtacttaactcccttttcgctgtttgtaataacagcaaagttagtcacctcagaaccagtaccacttgtcgttggaatagcaattaaatcaagatcttttttatcttttccaaattttttagcaaaatatttcatcgctttggtcgcatcaattgcagacccgccacccactgatataagtaatgttggctcaaattcttccaaagctttgatccccaatacaatttttgtgattggcgggtcaggctgaatatcagaaaaaattttaatctcattttggctttccaaatgatcagtaatcttggtaatggcacccgattcaaccatgaatggatctgtaaccaaaaaaattttttgaccatttaattgatcaagcccatcaagtgcttggtcaccggtccaaatttgagtcttaaactgtattttctccaaacataagacctcctttgtagttaatcttaataaataaaaaaatgaagctttaaagggactcaaaaaagagttccttcaaagcttcattgcttttatgtacgccattgtacaaattagtatttttctatttatgtaataaatatagcgcttacatttgtgaatgtcaatacttttcaaataaaaaaagccgcatctttttgcggcttcatcagtaaacgccattgtttacacacttgtaccccattgtacaagcgaagaatgaatacaaaaacaccctatccataccacgagacagaatgcggttcagacattttactaaaaagatctgactaatagcttaaaaagctaatcacagtggcgggaccgcatcggactttcaccgatttccgtttagtaaatgtttttttattcaattcaacacttttacaatatcatactcatttgtagatgtctattgctagctgtctatcaatatggggtaaagcaaaaatgattattatcgacttgaagtttggataataaccatttttatatagatgctttatttatattttatacaaagaaacgatatttccgatttcgtaactgaacaaagacagcaattacaacccctaacagagttaccgccacatcaatccaaaatacttgcagaacgctagccgcagttgaactgataatgaaacttgaaacaaacggtccaacaaaataagtaagtgcagcggcaaagctataatagcctgtaaccttccctttcttttgtgggaaatattgagtcaaaacagacaatccaagctgccaaacaccaccagcggcaaagaatccaacaacagcactggtaattcttgccaacatcacactaggaaaagcaaccattaagattaaaaatactaatgaaattaatggataaagaataactaaataaattggtttaactttggtaaccaacaccgttgtgacaaatacagaaattaacgaaaagattgcataccatgacatcaatgatttagctgcaacatcgtttaagccaagaaccgatgtcccaaagtttggaatgtattgcgtataaacataaaaggtaaacgaaatcgtaaaaccaagcgcaattaagccaattccatcaactttcatacttggtttacgtgcagactgttgttcagagctttctttagcaactgctgcttctttagccttttcctctgctgattctggaaccgtcccctgtggtgcaaaacggctcatgacaatcaatactaaatcgatcaagacaacgactgctaagattcccaaggtaattgaggcatttggaatagccgcgacaagaaatggcaatccaaactgagcaagtgacatcgctgctttaaccaacgaactcatgctggcagattttgcaggaaaagcctccgataatgcgggataagccgctgcatcatcaaacgaatttgcaaatcccagaaatagtgagaagatagctgccatcatcatcgagtgactaaacattaaccctgctaagaagacaaaattcgcaatcattccgacaattaaaaccggcttacgtccaaaacgatctgaaaagtctcctgcaaaaaggatagtcagcagtcgaccaattcccatcatcgaaataacggttgaaattccatgtagatcagtccgccacattacttgaaaatttgaactatattgagaaatcaggatttgagccatactcaaaatggcataattgatataaattgcagtcgccaatgacgcatgacggcgacgtggtaagctggtttcttcggcttccacttataaaacctcccctaaaatgtgtcataatcatttgtaaaattcgaggattaaagttgattcctaaaatactcaaagtttatctgaaaaacaattcaattattcggaaactttatcttcgctaaaaagaaggttacgaatatagtcaacgggcatatcttcaccagtccaaagcttaaatgcttcggcaccttgttctaacatcataccaagaccgttgaaaacatgatcaacgccagcttcttgggcaacagtcattaatttggttgttcgtggtgcatagactgtatcgtaaacaatcatgtctttatggaaccacgatggatcactgactaaggttttatcttccaatggcttcatgccaaccccggtcgcatcacaataaatttttgagtcagctaattcgcgtttgaacacgtcccgatcagccaaatcataaagggttgctttacaatcagtgttttcattgatgatatcaacgttgcgtttagcattttcccaagtatgatcttgaatgttaaacaatgacatttctttaacgccatcagttgctgcttgaattgcaaccgctgttccagcaccaccagcacccgaaatggtcattttctcaccagtgatatccaaattctcatcttcaagtgacttcataaatcctgtcccatcagtcgtgtatcccgttaagacaccgttgtcatttacaattgtattaactgctccaaccattttggcaactggatctaatttatcaagcaatggaataactttttgcttgtttggcatcgaaatatttgagccacgcattcctaatgatcgaatcgcttgaatagcattaggcaattctttattaccaacctcaaatgctaagtatgcataattaagccctaatttaacaaacgaagtattgtgcattgttggtgacattgaatggcgaattgggtatgccattaatccgattaaaattgtgtgtccatcgatccggtctgcaacgttctgattgtcagccatagttgaaaacttcctttcaaatcttctgtatttgttcaacttttcataatctattatagagatgaaaacggttaaaaaacataaactaacgtacctttattaatagatgctctctatgaatatggtttaacaacatcatatttcgtaataaatagttagaccttttgtcaaaaggagttcctaattatagttgtatgtaaacgctaactgttgttttgatgtaaaggattacttttttctctatttaattcgaaatatttcacttacaaaaattgtccttgacaaacaaatcaatccgattaacttgtttgtgatttttcaaacaccaagaaaagatttatcacttttattgcttgcaacatttatttaataaattgattattaattccatatctatgaaaattctccgaaatccattaagctcaactacccaactcgtagtataatcaacctcaatagcatcattgataaccatttgaaaggaagattacatatgaagattcaagaaggatacatgccatttcacggatacaaaacatactatcgaattgttggtgagccaagtaaagacaaagccccactcttacttattcacggtggccccggatcttcgcacaactattttgaattaatcgatgactacgcaaacactggtcgtcagctcattatgtatgaccaagttggctgtggtaaatcatccattccagatgacgaatcggtttatgtcaaagaaacttgggcagaagaactcatcgcattacgaaagtatcttcacctagatgaaatccatatgcttggtcaatcctggggcggtatgctggaaatgtactacttaaccagctttgatcctcaggggattaagagtgtcatgattgatggttcccctgcctcaattaaattatggatccaagaacaacaccggttgattaaatatctgagttatgaagatcgtcaggccattgccgaagctgagaaaacgggtgatttcaccggtcccaaatatttagctgctaacgatcgctatatggaacgttattgctgggatgatccggatgaaaattcgccagaacctttaagacgacctactaatggaaaaaaagccagtctaatcgctgaagggcccaacgaatttaccgaaaacgggacaattagtgattttgacgtcaccgatcagcttaagaatgtccacgttcctgttttggtcaccagcgggactgatgacctgtgtacccctttaattgccaaatcagtctatgatcatattccaggtgctaaatggcacttgtttgccaatagtcgacacttggcactgttggatcagcacgacgaatttattaatgtgttagataactggctaagccaaaatgactagttgaacaaaaaacgatcattaatgtctttgaggtatacctcactttcaatagacattagtgatcgtttttcttattatcaattattttttaattagctttatgaaacactgaccgatttctcctcaacctctgaagctgcaatgtacttcataaagttgtcaaaacactgcttcaagaaatcttcactgcctgcatcaaccaaattgtcattttcatcaaactggttggcagcctgtggcaacataaattcgtttcctggcataatacttgcatctactccaggagcatctaaaatctggcgtaagttcatctgagctcgaacggttccctgaatccccaatgacgtcccgacaatcataactggtttatccttaaatggatgttcagcacatgataaccattcaatcgtgctcttcagcgcagcaggaatcgcatggtcgtactccggaaccgcaatgacaacgccgtctgattcttcaattgtatttgcaagttccttgacagctaatggttcatcattcatcagatcttcattaaacaacggaatgtctttgatttcatgaatttcaaaatcagcttctgaaccaaacaaattcttcattgcgtttaacaagcgacggttatatgacttcgaagcattagtgccaacaatggcggtaatcttcttatcatcagacccttcaaccttatgctgattagcgttttgcgtagccgaggcaccagcaacgtatccggatgagatcccccatgtattcatcatacttggcatcgaatcgtgaccattggcaccgccaacaacctcaccagcaccaaagtaattggcaacgggttggttttgcttatcaatcagttcaagattcttaggatcagcggaatacccacccaaggttgtcgcaaatcgggcacattgttcaatcaaatagtaagtgtgaccttcatattcgtgcaaatattgtttatcacggccgaattcggggtctttaccatccttggcaaagttttgataattatcaacggttctttcgagattggtaacattgatcccagcttttttagcaacatcgtctaatgatcctttaacaaatacgggccggttatcttgatcctcaaagaactttttgatttcattttccgtgaaatcatgtaaaacaagcagttgatagacttctttccaagtccgttcatccatcaacaagtatgcaattttatcagattggttaagaatggcatccctaaaggttgtataaacatccgattcattaacaattcgtttcccatctgagttaacgtaaatggatcccatatcggttgcctttttagacgcatacgtggttaatttagcaattcccggttcaacttgaaccccatgtggatagactttgtaccaatccaggttgtgagtctttaaattcagatcttcattaaagacataggcatccccggtcgacgtcattggcccgtagtaatcaatccccttgctttcaggaccacgcatctgtttattggcaccatagccaccagcggctagaacgagtgaagctgccttgatcttaaccgtttcattatcagcctcagcagttaatccattaactcgccccttgctatcaaaggttaatccttcaactcgggtgccaagaaggattttgccacccttggcctcaaacgctttagaaactttttgaatgaattcataagaactggctgttggtaattcaatttgacgttcaactgaatgttccggagtttgggtttgcgctttctgatagtccaagccggcaaattcactgataaaatcaatggcaggaccaatattgtgagccattaaatgagttaattgcggcaaattagtgtgcttgcattcaactgcaacatcgttagcaagtcgttctggtgaatcctgctgatcaatttgtttgccaaaaattcgttcagcaacttttgagccggttccggtcacgttggaaccatttaaaatagtagcgccacccaaatacccattcttttcaactaacactactttctggccgagggaaagggcacgacaagcggcaaccaagccagcttcgccaccaccaattaccgcaacgtccgtcctgatgcgagtcgtctggtgtttcgcgtttttcttagctactggtgtaagctgaacattttcgtttttaactgctttcttggcagaatctaaaattgcttgggtcatcactgtcgcaccactgactgcatcgacatcaaatgactgctgagaaataatattttgttttaatttatcaatcacttggttgaaaattccagaggtttcagaatgtttcaagatctttaaatcctcaaccttattgtcatcaacgtcaacttcataattaataatgccattatggcccattgcctgacctttaatttgcttttctgtctgactcatatccatacactccttctctctgcttttccaacccatttgttgtgattaattcattattttgattaacaaaaattgcttcgacatttggcagctgatcaactaattgtttgccccgctgactaccgcggaaaaaacaaactgttgacaaggcctcagccaattcagaattatccgtaatgattgtgacttgaaccacatcacttttttctgggtatcccgtttgagggtttaaaatatgatgatagatgtgattaccaattttgaaatatcgttctcgaattcctgaagtcacaaacgtttttgcagttgtatgaacgacagccaatgaccgaccatcttcatatcgtgggtcacgaatcccaatcccccataacccacttgctgctagcggattttgaccaagaacttgaacgttgccgcccaaattgataatgccactcgtaacaccatgattcgccaatcgatgaataatttgatcggcaaagtatccttttgcaattgcgcccaaatccagctgcattccttttttggttaaataaacggttcgttgcttctgatttaatcgcacttcatctagatgaatcaatttcaaatcgtgatcaatttcatcctgacttggaatttgatgaccgccaaagccgattttccaagttttcaccaagggaccaatcaaaacattaaagctgtctgaatattccttggaatatgctacggaatctttgacaagttcaaaacattccttagagacctttaccggctgtttgccagcattttgattaatctttgccaagattgaatcaggacgatttgcggaaaatacctgatccatttgttggagataatcgtaaacatcaaagacagccgaatcattcttttcaaatagtgttaacgagataattgtccccatcattggaaattgtgagatatactttttatgtttagttgcgtttgacatcaacgatcatctcctagtcaccacgatctatcattaaccaagttttaaatcattcaaatcatgacgcaaatcatctaatgaaatttgtccaggggccgaaacagctccaaccgcaccaaatgttaagcatgagccaaagacttcaccagaaattcttgaaacctttcccaaatctcccatcgacatcgtgataatcggttgtgccagtgacgaacttgcccgattagtcgcatttaaaagcgttaaaacatcggccgcgctttgcggcataacggccattttcgctatgtcagccccaagctcggtcatgctggtcaaacgactgacaatatcatcttcacttggcgttttatcaaaatcgtgattactcataattacagcaatattatttgcatgagctttgtcaactgtagccttcacctgatcttcatcgtgaaaacgttcaacatctaaagcgtctgtatagtcaccattgatcacatcggcacagattttaaaatatgcccgatcatcaagtgacaattcgccaccctcaccttttgttctaaatgtggtaagaagtgcaaggtccccgagaacttgacggagttggttaccagtgtcggtaagctgatccgggttagtgactccctcaaagaaatcaattcgccattcgacaacgtccggttgcttttcagcaattgtttttgcttgatctataatgtcactttgggttttaccagtaatcggaaccgcaattttgggtcgtccactaccaagtgtgagttttcttaagttaacagttttacttgtcacgataacgttcccctttcaacttttgatgctaaaatctgttttttataaacgcttacattaactaacttgttactcaattcacttgaaatcttatcatcatcacgtatcataataaataataatagtttgattaattaatagataatgtctattagttaggaaggaacccatttatgaatttacgacatttaattttctttcgcgaattagcccacacacaacacatggccagggccgccgaaaatctcggtatttcgcagccttccttaagttatgcaattaaaaagcttgaatcagaattaggcgttccactcttcgaaccagaaggccgcaacattcgattaacgccgctgggcaaagtttatttaaagtacattaatgaaagtttagacatgttgagtgatggtaataccctcattaaagaattaattaatccgaatgagggccacgtcaatctcggcttcacctataccttgggtcagcgattagttcctgaattactcacggaatttaaaaagaatccagataatgaaaaaatttcattcacgttgggtcaaagttactcggctcatctcctgcaggacttgaatactgaaaaatacgacattgtcttaagctctcacgtggataagttaggcgatcaggatgcagatcgactttttaaattttatccaattgtccaacaggaaattaaacttgcagtcccagctggccatcccctcgccaagaaggaacacgtggtattagcagatctcggcaagtatccaatgattattttttcacaaaatagtggcttaagacctctgatagataaaatcttggcacaagaagatgttaagcccaagattacgtatcaaatcgaagaagatcatactattgccggctttgtaaaatatggaatgggaatcgcattaatccccaaccttccacaactggacacgaaaaaggtagttctaagaacaattgagaataatgccttaaaacatgaattattcttggcaattaagcgggatcattttctaaccccgtcagtgcaaagatttgagcgttttgttcgggagtactgtcaaaaacattttgcggagaagggagtgtttatttagaaagagtgcgaaatgagacccttatacggccgggatcagtctcatttcgcacgtttcagctatgtagcaataatgcagaaatattcctggtcttggaatgtttagttaagtcaagttatacggccgggatctgctggttctctcacgtttcggctatataacaataacgcagaaatattctcgaacttagaatatgcagttgtctggcttatataaccaaagcccactcatgaacgtccattttgattaagtagtcaccccatagtcacttaactaatcacaatcacatccgttgctaccgttcctttaccttaatgcggacaaaaagtctggccacaaaacgattcctttaattgttaaaaagttaaaacaaatcaacaaatgaatttgaaactattttgtaaacggttacacttgacatatgaaacattttcgtgtttaatagctgttatgattgttaattattgaacaatagcccttactggcaaacatgctactcaattcaaatcatatcaatgcaagggtgataattatgtcgcgagctgaacgaataaaaacaacggcttgtttatattttaactacttgattcatggaatggccatcgtgattttggcacagaatatggctgttcttggcaggcaatggcacgttggcgatgctggtgtttctatggttatttcgtcactggggattggtcgccttttggttctatatgtttctggaacattatctgatcgattgggtcgcaaattatttattagaattgggattgccacctatgccgtcttttttgtgggaattattctttccgaatcaatgatggctgcctatttctttgggattctagccggcatggccaattcatttctcgattctggcacttatccggctttaatggaactgtatccacgcagccaagcctcagccaatattatgattaaagcattcgcatcagttggtgaactaattttaccaatttttgtagctgttttagagcattttaatatctggtatggctggacttttgtgttctgtgcagcagcactggcaattaactttcttgcaatgcgcagcagggtcttccccaagttatcaggtaatccacggccacgcaaagaaaagattaacccgtctgctcaggcctcatccaagactaaattaacctcgcgtcaacttttgctgggagttatcctaacaatctttggctatgtgtcaatgtcaacattctacttggttagtcaatggttaactaagtatggcagtattgttggtaacttaaacatggtcaacgcccgattactggttagtgtttatagtgttggatccattatcggtgttatcacaaccgcaattctcgttaatcggtttattaaaccaatttggttcatgatttttgatactgtgctatcatttatcgctttactgtggattacactatttccaactgaaatcgtgatgctgattgcttcctttgtcattggctgcaccgctgccggtggtgtgatgcaaattggtttaacaattatgggcgacctttttccaagcgccaagggaagaattactgggatttactatactgccagtggcttggcgtcatttacgattcccgtctttactgctattatttcaaaaaccagtattcataacatcatgtggtttgatgtcggcattgccgctattgggattctatgcagtatttctgtcttattaattgaaagaacggatcggcttaaatttcccagtcatgtaacagaatcgatcaaagtaacgactaagaccgtttctgattatcagacagaagcaaaataacaaattcaaatttccagcaccaattgcataaaaaagcatttagattaaagccaagaatgttactttcccttggattaatccaaatgcttttttattgggcagcaattgatagcggtacatctttttttagtggatatattttatcgctgatttcaataacaccaccatctcgagttgcagtaaccgtcaattgattatcaactttatcaatcataacttcaccatttttgattggcaggacacaatgaagctgatcaaagttgtctaaatgaggagttactttaaacgtttcatagcctggctttgtcggtactaatccaataaaatgacgaccaatcagatatattggactcgctccccatgcatggcaaagacttttcccgtacggatcgccatacatttcataaatctgagcaccggtttggctaggatcatattcctcccagaaagtgaccgcgcctttgcgcaacatgccaccccagtaatccaaaattgtttgatagacggctcgatattctcccatctggcataatgcatcttgttcaaaaaacttaaaatatggtgttgtaatttgagtgatttgatcgttaagcaatacgttttttagaatcagacgtttctttcgatcattaactaaatcaaagataatcgccaaaatgttagcatgccgagtgatatggtgcttcccagattcgtaactgtcaataaacgcaccctgatcttcgtcccaaaaataatgctctagatgctgctgcaatacagtaaacttattctgatactgatcaatcgatttgcctaatgcttggccacaggtaataattgcccgataagtttgcagtaaaaatagctgttcagccgcaacagtcccctgcttgtccatttttgaccagtcgacaaagatccagtcattccggcgcccataaataaaacctttgtcatttgtctgcttaattaaataatctaccattttttgcatcttaggataaataacttctaagaatttaaggtctgccgtcatttcatagtgattgaggatcccaattgcccacaacattgaataatcaacaattgtgttaatatgttgcttaatatcatcttgaccacgtaaggctaataacgttcgcttatcaatctcttcatcaaaaaatgaatattgattcatcagatttgcctgcaaagcatcacctgcccaaatccaacgatcccgtttgatgccatcaataaagaagacgtcactgcacaaattaagcgtttcaacggaaacattccaaatttgattaatcaactgattatcagtttcaaatttcgaattgtttttctttggaatatattcatgaaccgccgttacctcaacatcgttcaaagaaacatctggaacaaatacatatctaaatgcccgttttcgaattgaggagtgtctatctacattttcctgcttgtagtaacaatttttgacatccaacgcttcagtttcggattcgccatagcataacgttattgacttcgctattcttgtttgaatatgaagcgacccgtttacggctctaccaaaatcaaagagaacgccgttattcttggtaacctttttttggtgctgcaccaggattgtttgatacttaatcatatttggatcctgatctggtcgcgtaaataatggatcatagccagccggcagccggtccacaaaattgctggcctgccaaccgtcgtttgagcaaatcacatctccctgaatataaatagctggtagacccgttgggtttccaataaagatcgtaacaatgttcctgcctggttggcacgttgttctctgattaagtgggtacttcgaaccattaatatccacgtagccttttccccgggcaaacacttggaattcagtttgccgattcaaagtatatgtccgcgtgaacttaacgttacgattacaatcgtcaatataccagtaggctggccagtccatgctgcgttcctcacgctgaaaattttgcagcatcccctgatgaatggaaaaatcaccaggataccaaagccaatagacgtctgccaatttaaatgcctcctttaatttattactgtttctagacaacttatcttgacgacagatttgccgaatcgctttgcaaatctgaactggtcattttgaaacgtttaattaattggacaataataatcgcacttgcgccaaaaatgactgtacatcccactaatacccaaagcaacagtttaggcgaataccccatcaaggttggcgttgctaacgaaaagattgcggtcattactctcactatcccatatgaaaagccggtcatcgtcgctctggcttctactggatagaaagtttgactccaaattttatacaatgcttccccacagagaatcgtactaccagagtagagaatgtaggaaacaacgaatacttgccagaattcactgaaggtacctgcaattacaaatgccacaaaagcaaccgcgatcccgacatacattgccgggtaacgatatttcgagtcagaaattttgaggtagacaacatttaccaacaaacagaagacgtttgcaactaaagcaatcactgtggaaaccagttgactctgcttatcgacggttactaaaaaataattaacaaaggatccccaagtattagcaggtatattccagaacaagtaaaagatggttaatagaatgagtggcagcacaaatactcgatttttcaacaaatctgccagcttcatctttcccttatcgacttggctttcactcacttcttgttcaaccgcctcagccaatccatattcaatatttcggaaccccttcgaaaataccctgacacaccagttaaggaacgctacaatcccaatccagccgaacagaacggttgcacttgtcatcccctgactggccgtaatcatcccaataaactgcgataatagaattccaattgtccaaaaaatttgagtagacgcgattgcccttccgtaagcccctttatccattcgttctgaaataacagccaaagaagttggtaaatctgcgccagaagccaatccggcaatcacaacaccgaccataagaaaaggaacactatttgaaaaagcaatgatgaatgacccaagtgctacaaagaaaatatcaacattgaatacagtcacccggccaaacttatcggacagccaaccaccgacaaaagaaccggcagcaactgataacgtcaacatcgtactcaacaatccaataagccaactattaagactcagtgaccttgcccaaatgggaagcgcaacccctagacttaccaataacgcagcatctaaatacgaagcaattccagcaacaataattaataaaacattgtccctgcctaatttcacctttgtatttggcatcattacatccccttaatgagatacttttggatcagataaacaggtgtacagctccatgcgtgacaataactatttaaaattggactaccatatggagaataatctggtttttctggttcgaaggcttcccagtacgtatcagcaccaagcttaatcatcgtcccccaataatcttttaataaatctattgcctgatcgtggaggccagtctggaataacgcttccgtaacgtgatgatacatataaggtgttgcaatcccgcgaattggaaacaagtcatcacaagttctttgcatgatttgttgattcatgttcgagtccataacttttgccaacaccatccagacttgactagcaatattgatttcatgattatttcctgaaataaataattcacgtgatggatcataaagagccgtttttgaatactggatcattttttctaaaacgacacgatatttgtcaagatcctcgtcacttttttgttgcgctaaatcaataaattggcgaaggacataaatgagaactgcttgaccagcagtttctttgtcaaaatcattggaccagtcgataaagacagggtagtcatcatcaagcactaatttcccggaccgatccactctttccagtgataaatccatttgctgtttagcaatcggatatagatcatctaacacagtttggtccatctgaaatgtttccaaatcagctaaaattgagataaagaacaaactataatcgaataaaaaggtatcatcgggaacgtaattcggtgtcgtaaagacatttgccggaactctgccatctgaggccgtcattgcgccaaacaaatataaacaacgtttaactaaatcccgatcccgaaaagttgcataattagccagtgcttgaagtcgtaagtcaccaatccacaatcgacgatcacgcttcgggccatcttcgaacacattttgcatgcaatccgctaatgttttaaccccgacttggtaaattttttctaatccaggatcatttaactgcggggttgttacttgacttagatctgcagacgtttctgtatcaacaagtggatgatcaaaaaccgcctgccacttgggagaagtgtcaagaaccgtaatctcaacatacctaaaactataacgacgaggcaataccaacctggttggtaattcgtcaatatggatatactcttcctgaatccaggatttactcaaccaaccatcataatcagaactcttgtgagcaagttccgcgggcatttcagcaaatttaaacttgcaaaacagcggggcatccatcggtgaaccggcggaactaatatcaactgaaaatttacctacttgatgatctccaaaatccaagattattttctgatcacgagttagctgatgtgaagctagattttgaatatcatcaacttgcttaataccgacgccttctaaaaatgaagcatcattattgagtgccacgagtgactttgccccaattttttgttgatacaattgaggcttaaacatatctgctttgtcaatcaatcgttgatcatgtttaaaagcgacattgttattaatttgaaatgtaaacgccatctgctagtcccccttaactggttgaccgatccgaatatcacgaacatgatgttttctttgaagataaatcattacgattccggcaataaaactgatgaatacaatgcctgcgaatccaaacatcgtattcttaatcgcagagggaacaaccaaggctggtgtcacaatggcgaataagccacagcaaacacgtgaaaacccgttgataaatccttgaactgaagcccgaatctcaactgggaatgattcttgggtccaaaccttgtacattgcttcaccggcaatattattaccaatgttataagcaccaattgtcatcacaatcggccacaatgaatgactacttaatgcaagacctaacattgccagaaactggacagtaatccccacaaagaaaaatttatttcgatacttacctgccgctacagatgcaaacgcaatggttgcaaataaggaaataacattcagcacgattccggccccggtggcaaagctttgagtagcgtgggcttgaaccaacgtaaacgtttggaactgaccaaacgtattggctaacaagttccagcaaacataaaagattaaaatactaaagaagaagcccatatattttttcttattaacaccgaggaaaacgtttttaatggaaactttttcagttaagtgagcttcacgttcatgggcaattcgtctttgttccccttcttgatgaaatgttttaaacttcgacgaaaatgttcgccaaatccaagtaataattgcaaaaatcgctaaaattgaaaaaactaaccgggctcctgttgccccagccatttttgaaacaataaatgcacaaacatatgacatgaagacaccaatttgccagaaaatttgggttgaagaaactaaactggctgatgtctcctcatctggagaatcatgcgaaacaacagttagactaattggtaaatctgcgcctgaagcaaatcctgttacgatgactccagcgagtaacatgccatagctcccagcaaaaacacagacaagtgccccaatcgcataaatcaaatttaaccagttaaaagaacggatcaagccaactgattttgtgatctgacctgccaataaggatcccgcggcaatagcgaatgtcaaagctcctgagataaaacccacctgagtgtttgttaaacccaaccccgtttgccaaacagtaattgttgcggataatcctacaataatcccggaccctagaattgatccgattcctgctgcgactgcgagtggcctgtatcgacgaaccattgattcatttacagtatgatctttcataataatcgttcctcctttaatttctgttataattgtaagcggttactggtgccgcgacaatatcgctgtcacactgaaatgattgcaaaatcacagattagtacgatgcagttaattccagttgtcaaggaggagactaatgacctcacacactctcgatactcaactattcaagttaaacaaaattgaaaagctccaaaaacattttggtgggaacgttaactatatggatttggactatatcaatgatccgattcccaaaatgcccggaaaagactttttcaaaactagtgatatcgcaatcactaaaaataatcgattctcatatgttcctgcacacactcatactttcattgagcttaactacatgtattcaggatcgtgtacccaatatatcaatgacgaaaaaatcattctacatcaacatgacttattgattatggataaagacattgttcaaagaattgattacacaagtgacaatgatattctggtcaatattttgattaaagatgattccacacttggtgatttggcaaattatatcaacgaatcggcaaatattgtgacccagtttctctataacgcatcgcggactaacgccattcataacaatttcatctggtttaatctcaccaataatgaattggcgattaacctcatcgaaagtttaatcatgaaaggtttagaaaaaaacgatagtcaaggccaatctcttcagctcattttctctgctttggtcattgaactttccaagtcaatcaaacaagaaaaaattaatttcgcagatccatcaactgatgatcttttaccgattttgaaatatttagataatcatttttcgacaatttcactcaacaaaattagtcaaaagtttggttacaataccaattatctgggcaataaaataaaaaaggtcactggaaagacatttaaagaattggttgagcgacgtaagttatcggctgcccagaatttaatgatcaaaactcactgtaatgtcagtgaaatttgtgaggtgattggttataaaaacaactcttctttatttcgcctttttaaaaagtaccttgatacaaccccttctgaatataaaaaacgagttagtccaaagaaaccggtaaatcaagaatttaatcagcgactaccttgatttatctaagcaaggtctcatagtcaaacaagcatgtgccagttatcttttttgttggcgtaacgatctcctaatccatcataagaatagtgcacctcataacaaaatcacctttacacggctacgtttatgaggtactctattattaaaatttaattattttataactttttgctgtttttggattggtttcttccgttttaacaaaatatattacatatagtgggtgaaaaaatgagtaaaaagaaaatattggcttataacatcttagactatgaaaaggagtttatcccgcaatggcaggctgaacatccagaagtccaagtagattttaaccaagtggaattacacgatgacaccgttgagcttgccaagggctatgacggtattgactatcgccaacgcagcaaactctccgatagtccggaactatacaaaaagctgcatgagtatggcattcagcaactcgctttgcgttcagcgggcgttgattcatgcaatttaaaatgggcaaaagaaaatggcctaaccattactaacgtgccatcgtactccccagaagctgtcgctgaaatgaccttaacccatgcaatgaatctgttgcgccatattccacaatttcagtcacgaattcgaaaaaatgattatatcgttactgggttgcgctcgaaagaaattccccaattaacggtagggattattggtgttggtcgaatcggcagtaccgttgcccggatttttcatgacttgggcgcaacggttcttggtaatgatctcaaggaaaatgatgacctgcgagatattctaacctacaccactaaggaagaaatttatcaaaaagccgatttgatcaccatgcacgtttacatgagtgaagataattaccacatggttggcaagccccagtttgatcaaatgaagccaacgacgttatttatcaattgttcacggggaccggttgtcgatacagacgcgcttattaatgcgctcgaggataaacaacttgcaggtgccggtttggatgtcattgaaaacgaaactcaaatttttaaccaaacatttgagggtcaaccagatattccgctgaaagcttacacaaagctaaaatcatttgataatgtctttttaaccccacatgttgccttctacacagatattgccgttgaaaatatggtgaaacaatcgttagatgatactttagcgttaattaccggtaaacacacggatcatgaaattgcacttggataatcgtcattttgatgtttcaaaaatgcggtaataaaaaaactaggcagggaaactgttctagtttttttattaccgcatttcattgcattgatttcaaattttgcctttttactgaaaagtccatttttttgacatcccaatttggccctcttagtattgaaaacgaatacaaaaacaatgaataagggggagcttcataatggcaaatcgattaaaagataaggttgcgatcatcacaggtggcgtttctggaattggtttgggtattgctgagtgttacattcgtgaaggcgccaaagttgtcctgacagctagaaaaagtattgataagggcaaagaagcagttgatcgtttcggtgctgacaaagcattattcgttcaacaagatgtttctcaagaatcagattgggaaaaggtaattaaagcagcccaggataaattcggaaaaattgatatcgttgttaataatgctggtgtcccacctgttaatgttccgatcgaccaattaaaaattgaggactggaatcgaatcattgccgtcaatctcaccggaacctttttaggcattaaacatggcatgttagctatgaaacaaaccggtggtggctcaatcattaatatttcatcgatcgaggcttttgttggagttccgaccggcagtccgtataacgcaagtaagggtggtgtgcgtgcaatgactaaggccgcagcattggatgccacgactggtgattatcatatccgcgttaactcggttcacccgggctttattgatacgcccatcctgcctagagaatcagttaagcaactcgcatcaatcaccccgatgaaacatattggaaaaccaaaagacattggtgaactttgcatttaccttggttcagaagaatcagaatttgcaaccggatcagaatttgtagttgatggtggtttcattgcccaataattgaagctgtaatttatgaagagaaagtaactgcgtgtacaaaataagttatatcaattaaaaacgcgttcgaaacaaattcccacttgtctcgaacgcgttttgacattaacttaaatactttttatttatatttacaattaatcatattgtcgtaaaaattccgacaaccgcttcaagccttcccgcaaagtcttttccggcgcacagtatcccaaacgaacatggcctgggacatcgaatcgattaccgggaactaataacacacccttttcttttaacagtcgaatacaaaattgctcaatatcttcaggaaccgttagtttgggaaacgatgtcgacaccgcctggggcatcaccacgcttgctcgtggctctgaatcaatccaatcctgataaattttgagattatttaaaactaatttccggttacgggcaagtactttgtcacggtttcttaagatataaactgccagcaaatcgttaaatactccacagcaaatcatcgtgtaatcgcgatacttacgaaataaatcagccagttcatgatttgtcgctgtccaaccaatccggatgcccggcaccgaatatgttttggacaaagaattggtagcaatcccccggtcatataagtccgcaattgacgtaaaggcttccggatgatccaagggtaaatatacctcgtcaaccaggacatacgccccaacttgtttggcaatcttgacgacctgcctcaaaaaatcggtgcttaaaactgttcccgtgggattatttgcattgttcaagcaaattaatttggtattcggccgaatcaattttttcaattcggcaaggtccgggtaccactggtcttcttcgtgaatatgccaataatcaacctctgcccccagtgatttagggatatcatataattgttggtaagatggatactcggaaatcacatggtcacctggttctaccagtgcatataatgccaaatgattggcaccggttgccccatttgtttgtaaaatattgtctggttcaacatgctgatataacttggcaacctcgtgtttaaattccggtgatccttcaatccaaccataattcatcttctgctggtcaagcaatttgtagaaggaagctcccccctgctcatccaagtttaagagttcattcatagtcattgacgcaatcgtgctttgtgagatatcataagtggctttcttttcccaaacatttaaccaagtttcaaccccaaattcagcaattttcatttactaatacctcccatttatcattagtatacagaatattcatctacttcgcttaaaagcggtcaaccaacgaaaagagcgacccactattttcttgaatcgagataaataattttgtgaatgactttatagacccatcacaattgcgatataataacaattagtactttccaattaataagggttgcttgctcacatataaaaacggtttagtcattaccgaacagcatatggaagcaactggccacctgttctggaattttttatcattataaattatgaatcgaaaacaatgatgtttaaaaaaagttaagctaataagagcttcaatcctcagttattaagtccttttcctggctatcattccaggacacacaatcaattcactaaaactcatcaacaatcactgttttttaactgccggattaaccactagttaaattctaaaatcttggaggtaacccaatgatcactcaacaagaaatatatgccatttataaattaaacggtcaaaacgacacttaccaattaccactcatgaaatggaacctcatgtttcacgaaaaaccagacgatttatatcagaatgtcattgacaaagggttaatgaccattgaagagcaaaacaaccacagtttacaatctcagacggttactaagctaaaagagttgctaaaagcgcaatctctttcaacctcaggaaaaaaagatgagttaatccagcgaattttgcagaatttccaacctgaggaactcgcagattatcagccaaccaaagtttatgaactcactccaaatggtaaagagaccattgaccaggagaattacgtgccgctggtgggtgatcactttgagcacggggttattgattttgacgtggttgaagaggctggctactctaaacacgttgtcaataaagtggaatatttaaatgggttggttcgatatgcctataatcgagccgcctatttgaaagattattttcagatggataaggcactcattacccaagtaaaacttgataaagctttcaaaaaaacacctggcgaacagctacaaacgattcttggtgaaatgtatctcaaattatccggcctgcctgacctattagaacacgaagattttcacaaggttcttaacgcgattgatctggtaagcgatcccgtctttgccaaaatccctaaagcaacaattgatgacatcactcgattgcaaaaagaagttggctggactgatgaacaagtcgttgccgaatttgaaaacgcggcgggacaaattcaactgccggaccagttgttctcaatggctgagatgtcaatgatcttgcgttattcattacccgacaatttagatgccattaaaaaaatgtatgcagataaacaaaaagaatataaggctgtcagcacgactagtcctaatcaaaaataatgaatcataccactatcattttataatcaataaaagcatccccaaacaaagattttgcttggggatgcttttattgtcttcctaagattactccggccaaacttgattagccacatcaacgactaattttattttacgccattggtcttgtgctgttagtcgattcccctcttcggtcgaagcaaacccacactgtggcgaaagacaaagatcatcaagtgagacaaattgttcagcctttctaatccgttgtttcaataaggcttcactttccaattcagatttcttagtagtcaccaagcctaaaacaatccgctggtgccgaccgttatccgcaatttttttcagtggttcaaatccgccagagcgttcgtcatcatattccagaaaataaccatcaatgtgcagttgggccaagtaatcggcaaccggatcataagcaccggcaccagcccaatgtgagtcataattaccacggcaaacgtgcatgctaagggttaaatctgctggcttattatctgcaatcgcgttgattgccttgacggcagcttcgcaaagtggttttaaatcaggattaatggtttccttagaaaaacttgcccacattccccatgatgtatcgtcaatttgaagataccgacaacccaagtcgtaaaaatgttggactgttttttgatacgcgtcaatgacatcattcaagaaatcatcaaaattagtgtaatgctcatcgtaaatctctgcttccttgttggggaagaataccgatggactgggaatcgtttgcttagcagtcacaccatcaggcacaatttgatttaaataactaaaatcggcaaagaatggatgatcagggttataagaaattttgtcaataatcttgataccaccctttcgcgtttcttcaccattaaagagatatcccttttccggggtgaaaaaatgagcgccattcaggccatcaaagaaatccagatgccaccagctacgacgaaattcaccagccgtcacatcctttaagccaacttcaatctcctttttcaccaattgactaatctgttcgtcttcaaccttggttaagacctcccgactaattttatgagcctcaaagtcagcgcgggcttgctttagctttgccggccttaaaaaactccccacgatatcatagcgatttggaaacttaattttagttgcagttgtcatttagatcactcctatttgaatttttggcaataaaaaaacgcccttgaattaacttcaaggacgaacagtctcgcggtaccacctctcattttattcgattcacaccgaataactctgcaagtatcattgtcgacaaaatgacctgatactcgaccgcagtaatgggcggatcccaatgctatcttacagacggctcgatagcatattgctcgaagaccattttcgtaaccgacgcagacttgctcccaccatacacaagctctcttgacattgtccaagttattacttatcttttcattgcgtatttcattttttattgccttgaattttaaataaaaattcgattgctgtcaagtcctcctcaacactccaataggttgcttatttagtgtaagcgcttataatttagcaataagcacatcattttattttcttaggaggaattcatttggacgattcacgttggaatcacacattgtatcaaacacaggcaatcaattcagaaggtcttgaaggtcatgcttatgttccggatggcattaaagtgaagaccagcagtccgctaaacgaccacgcagggaccaaccccgaacaattactgggaatgtctcttagtacttgtctggatgcaactctagaggccattgaacacgaacgaaagttaccacatatctctgctgtccgggtcaaagttgccttcatcggcgcccgtgcaaactatgaatttttagttcatgcgcaaattaagattgatggcgtcgattcacaaaccgctaaagccatgacaaaggaagcggaggaacgctgctgtgtttccaaattattgaaaaacagcggcaattatacagttgaaaccgtgactcattttgatgactgagtagccattttgtgacacgataagtgccaactcgatttgagagcttgagtaatcaaatgtgttgttaactaatttaatatcagtagcaaagtggcacaccctgcgatccttttttgaaggacagcagggtgtgctttgcctagatttgaaattttcacggctacaaaccgccatgctaaaataattaataagcacattatgagtttttcattagagattattttatttttcaaaaggatgctttttctcgcctaaaagctggtttatcgatctttgcgttgcgtgggatgccctctcagccttgattttcatatcgaaaaaagtttttaaaatatcaaaaagttgttgtttttcagcgaaatgggtagtaatatctaccggaacgatgtaatatttataacaattacttaattaagtgaatgttttattcagaattgttcgtattttttgatattttacaaattcaggcattcatttttaaattatttaaattttgatttatctccattaaaaattaatggcaaataatcaacttttaatcaaccaggaggctttctttatggacagaaaaatcccaaacattatgggcacgcaacatccggataatgcaggagtacccttttttaaacaacatcagaatccatttgtttcagcatatcgtgaaattgatgaagcttacgcaaacttttcaacccttgacgctgacgagtatatgtgggattgggaaggcaaacatgccgatgcctccgttattgatcgtttatattctgaacactatgaatactttaagaaacatccactaggtcgtgataaattcctaacgttccgttttcctaatatttgggaagaaaaaggttacagcctgatgcaggcgatgactacgatccttgcagccgaagatttcgcagctgatttgggattgaaccgaccactgtttgaagcaattttaccaatgacccaatccgctgaccaattaatcagcatggaagacaaatttgccagcttagctcactataaggggaaagaatttaataccggccacagtgattccgataatttgcgaatgattcccttatttgaaggtttcgaatctcaactcaatgcgccggaaattcttcaaaagtttgtggatatgtatcatgatcattttggccgtgatttaggctatcttcgagtattcttggcaggttcagattccgccctttcaaacggcttcttaaatagcattattggtaataaattggccctcacccatcttgctgaatttgaagacaaatccgggattccaatttacccaattgccgggatgggcagtaccgttttccgtggtggtctgtcaccactcatgcttgaccgatatttggaagaattccctggattaaagaccgcaacaattcaatcagcgttccgttatgattatccactggatgttgttgaacccgcaattattaaacttcgtgagggtcttcaaaagagcaaatttgaattcattccccatgatgatcaggatactttactagagattgctgaaaaagcagctaaagaatatcacgtcacattggatccacttatcaacgatttacaacacatttttgacgtctttcctaaacggcgtgatcgtcaccaacacgtcggaattatcggttactcacgggatgtcgatggctacaagatgccacgggcaattacctttaccggttcactttactcagtcggaattccaccagagttcattggagttggccgtgtcttgaccaaattgaatgataaagaaatgcaagtcttgagaaaatattatccaaatatcaagcaggactttgaacacgtttcccacttctttagtgaaaaggcgctaactgccttaaaggctcaaaatcctgcctggagtggtgttgaagaagatatccaagccattgaaaaggaatttgacatcaaggctggtcctcaaacacctgaagaagaaaagcatgctgacttggcatctgatttagttaaaatttcagataacgataccaagacggccattattcaacgtcaaggagaattaagaagattcctcggttaattttccgtttcttgaagcattgacattagctgttaccgttttaattggatttttcatagtctttcctttaaaaaagcattttcgccagttacgtcgaaaatgcttttttgcatggatttatatgagtgccaaaaaaagtttaggaatccctaagtttatcttttgttaaaccttattttggtgtaaaatgaaataagagaaggtgaggaaatgcaaagtcaaccgacacaaagtccaaagcttcaaaataacaccaacaaacaaatgcaagatgcccaaattgccaagcaacaaaccgcaaaagcatatgcatttgcttcgttaatttacatgtgttatatggcctgactcttctcgagagaatcatcctccttttacattattattgatcgtattgtgactatatatccatgctgatagttagaatacagtcaacaatcgttcaattatctccttgttttcagaaaaagacgcagctaatttggaaattttcaagttagttgcgttttttctgtaatcagcacaagcgactcgtcacatcgattaaccgactaataatgagccgatgcttgctctcccctctttatattaatgatcaatcacaagcctacttccaaaaatttttcattatttttacacaattgattgaccattaacttttatagaattaccctataggcgaagtggtaacactttgggtttaattttaggaggcgtattttatatatggcaaatgctacacaaagcaaggaagctataaatgagagagaaaccgattattcctcaaaacactacttcgatttaatgactaagtattggagagctgccaactatatttctgttggtcagttgtacctgcaggacaatccgttactgaagcgtccactcacaaaagcagacgttaagtttcacccgattggtcattggggcacaattgctggtcaaaactttatttacacacatttaaaccgggtaattaagaagtatggtctggacatgttttacattgaaggttcaggtcatggtggtcaagtgatggtttcaaattcataccttgacggtagttacacagatgtttatccaaacattacccaagatgaaaacggattacaacgcttattcaaacgcttctccttcccaggtggtgttgcatcacacgctgacgcaaagacacctggttcaatccacgaaggtggcgaattaggttattcattatcacacggtgttggtgcgatttttgataatccagacgttattgcggccgtcgaaatcggtgatggtgaagctgaaactggacccttggcaacatcatggttctcaaacgtcttcattaatccggttaacgatggtgccgcattaccaattttaaacctcaacggatttaagattgccaaccccactatcttgtcacgtaaatctgatgaagaattaactaaatacttcgaagggatgggctgggaaccaacatttgttgaaggtgacgatgccgaaaagcttaaccctgtaatggccaaggcgatggattcagccattgaaaaaattcacgcgattcaaaagaaagcccgtgaaggatcagctgatgatgctaagcgccctgtttggccaatgattattttacgtgcaccaaagggctggaccggtcccaagacatgggatggcaagccaattgaaggttcattccgtgcccatcaaattccaattcctgttgactcagagcacatggaacatgctgatgctttggctgaatggttaaagtcatacaagcctgaagaattatttgatgagaatggcactttgaaaccagaaatcagggccactgttcctgacggtgacgctcgaatggctgctaatccaattaccaatggtggcaaagatcaaaaacaacttgatctgcctgattggcgtaattacgcgttggacaactccaagcgtggttctggtgaagaacgtcaagacatggtcgaattaggcaaattctttagagatgtgattaaagcaaatccaaagagtttccgtttgtttggccctgacgaaactgcttcgaaccagttgcaggaagcctttgctgttaccaaccgtcaatggatggaacccatccacaatccttatgaccaatggatgaaggctgatggtcgaattattgattctcaactttctgagcaccaagatgagggttggcttgaaggatacaccttgactggccgtcacggggtcttcactagttatgaagcctttttgcgagttgttgattcaatgttgacgcaatacttcaagtggattcgtgaagccaacgaacaaccatggcgtaagaaatacccatcattgaacttaatctcatcatcaacatcattccaacaagatcataatggttactcacaccaagatcctggtatcttaactcacttggccgagaaaaaaccacaatatattcgtgagttcttgcccgctgatgctaatagcttacttgccgtcatgcacaaggctttgaatatgaaacaaaccttgaatgtcacaattgcttccaagcacccacggccacagttctattcagttgaggaagctgagcaattagtcgatcaaggcttgaaggtcattgactgggcaagcaccactaagcctggtgaagaaccggacgttgtcatcgcagccgccggaacggagccaaaccttgaaagtttagccgcaattgatatcttgcatcaacaattccctgacttgaagattcgcttcattaacgttgttgatttgctcaggttgcattcaccacaatttgacccacgtggtcttagtgatgaagaatttgacaattacttcaccaaggacaaaccggttatctttgcattccatggttatgaagatttgattgaaagcttattcttcaaccgtcacaaccataacttacatgttcatggctatcgtgaagatggcgatattacgacgccatttgatatgcgggttcttaaccacttggatcgattccatttggctaaagaagttgctaaggacgtttatggtgataaatcttctgaattcacgtcacatatggatgacaagcttcaaaaacaccacgattatattcgtaagaatggtgccgatttacctgaaatccgtaactgggagtggaaagatttaaagtaacttattactaattcatcttctctgatctaacaatagaactactaggggctgggacaaaagtaattttgtcccagccctatttttgtaatcacgattattaccaagcaaaaacgtgagacaaaaggcaacttcctgccgcacaaccgaattatcccactattctacccggagcatattcggataatccagttgtactctggaagttaaccgccttttgtctcactctggtttcatgttgtcacaattattgttgagcgtgacccttcatatttatgaataacccaaacctaaatcaacagctcacttaaccggcatgttatacttttatgaaacggatttaatcgccacgtcttattttagacaattctaattaatcaatttgaggtgccaatatgctacgcgcaatcaacgtttccaggaaaatgaccgattaccatgaactaaaacaactttatttacgtgccttcccaaaggccgagcgaattccgctcccctttcttcgatatagagctaagaaagcagatattaacttctacgcttattacgatgatgattcatttgttggcctaacctacctaatttcctataagggagtaacgtacattctatttttggctgttaacgatcggatccgttcaaaaggttatggttcccaaatcttaaaatcaatttctgaaaattaccctcatgatacccttattttaattatggaagaagtcgttaaaagtgcccccaattaccagcaacgtttaaaacgacaatcattttattttaaaaatggcttccgggatagtgggcacacatcgattgaatatggtgtcaaatatcaaatgttagtcaaaggggagaatatcactgcacaacaataccgcgatttgttcaaatattttgttgggcctgtggtataccgcttttttaacccagaggtgagttaattttttaaagcacttttaatttatagttggtataatgaatttagtaaaataattaccaatcattggaggggcaactatgaaagttattaacgttgaattaacggttaaaccgggtatgcaaaaagactatgaagcatttatcgacaagttagttgaaggatcacgtgcagaaactggaaatgtcagttataatcatttcaaaaaattaggaactgataatgaatatgaaattattgaacattggcaagatgctgatgcggtagaattccacaatcaaacaccccattttcaaacgttcttatctggtgttggccagtatttaactaaagacccggtcatcattcggatggactatcaagaataacttggacttgtgattggatatcacaactgagttattaatttaaagagagtgggacgaaaggcggttacgctctggaagttgccttttggcgtacgtttccactcggtaataatcgtgattacacaaagcggggctgggataaaagtaattttgtcccagccccttttttatgaataatagaattaattaagtcacaagttttaacaaacaagcgtcttggtagacttttagggtgccacaaaagcccaagccataattaagtacctgcttgtttccttattgcgaattggtgatgttatttggctaaaacgtgcaaaagagaagcagatcccggccatataagtacttgcctgtttctttattgcgaattgttgatgttatttggctaaaacgtgcgaaagaaccgcagcttccggccatataagccccataactcaatattcaaaccaagaatattgagttatggggcttatattctggaagctaaccgcggcttttcgcactctaatttatttttctcttcggattcaaaattcccatcggatcaaacaaatttttgatttgatgttgcaagacgtcgaccgtatcacccaactcctcatttgtccattggttctttgacatgccaaccgcatgttcacctgaaattgtgccacccaattccaatgtctttctaaacattctgcgagttgcttcaattacccgatcaggcgccgttggttgatcattccacaataaacttggatgaagattaccatcaccagcatgtccagctgtataaatatcgacattcaagtcctcgccaaccttagcaatgtacttcaccatttccgataatttcgacaatggaactgccatatcttccataatgtaatacttggcatttgagaagacggctggcagcatatcctgacgtagctttattaaacctttagctttttctggattgtcagttatcttgacgtgccaagcaccctgctcatcaagaatccttttgacagtgtttaacttcaagtcactggcactgtcaatgctaaagataagtagtgaagacgtgtcactttgagaatagctggtatgttcataattatccagtgccttaactgtcttgccatccaacgcttccaacattgacggatagagaccagagttccgaatggctttaacgccctccgccagttttgccatatcgtcaaagaatgcaatcccagtaattgtttttccaagtggaattgggaataacttaaccgtaacctcggtaatgatccctaatgttccttcagaaccaactaataactgagccaagtcataaccatatgcttgcttatatgttcgacccccaagcttaatttcctgaccatttgttaacatcactttcaaacccaaaacagagtctttagtcgcaccatatcgaaccccactcagaccaccggcattagttgaaacgttaccaccaattgcagacatcggcttggatgcaggatcaggcgcgtaaaacatcccttgtttccgggctgcttgatccaggtcttggttaataacgcccggttcgaccaccgccaaagaatcatctttatcaatttttttaatatgattaagcttagccactgataaaatgatgccatcattaatcccatccgcaccaattactgtactggtgtccgcagtttgtgggacaaccggcaaatgaaacttttgagcggtcctcaacacaccacgaatatcatctttgtctcctacagcgacataagctaaaattttaccctcaatcgagttttccgcgttaccattagctgtgtgcttgactgacgtttcatcatcaacatgaatttcagcatgcggtgcgttttgtttcaaaaaattaattatttcatcatttgtataatccgaaaaaattgccatttcttgacactcctaattttaataaattttattttagatcgttgctaataatcatgtgcatggcattaacaatctagttgtaaaatttattaggcgtttagtcaacgatttagacgtttggatttttctgtattactccgtgacttcgctctagggatgattttataaatggttactaataataagcactttttatcgtgcctaattagtagctaccgtcggtttaattatattgggtggttttttagattactcatttctcccctaaaaaatgtcgagaatgtgaagggataattctcataactgatttaatattacaatttggaatggcctttttatttagcaaaaaacgtgtgaaatgagagctgattccggtcatgtaagacacctaaacctgaaatttcaaaaccggaatataccccattggcctttttacctagtcgaaacgtgcgacagacagcaacttccggccatataagcccccgcaaacaatattcccaaaccaggaatattgtttgcgggggcttatattctggaagctaaccgctgtctgtcgcactctggttttaaccgctttcattttccaagctaatttctacccttcgcctataataatttgctatactagaagtggtagtaaacagaaccaaaaagttataatcaataggtaaggagtgttgaacaatggcagaaatgacaagtgtttcaaaactagctaaattaccaaagatgaatacaccggtgattacattgaatctaaatttaaagaaattaaattatgacaccgatgaacaaacccgagtcaaaaccgttttgaagaaaattcaaaatgaaattggcaatggcatcgattcatttatcaatgaagtaaatgatttgattcgtcagcaattaccttatgaagggatcaccttaattagcgataaatcgggtaaacaggtttactacctaattcggaccagcgttgaggaagccgattatcatatcgatgattttgttgattatctgttactcttaagcgaggcgccaaacgctgattacacgttacttgaattaaatcgtgacaacagtaaggtttatcaattaaagaacaagcgggttagccctctcgccgttgaacattacccggcaactgttcaggacgcgctcgggacagaaattcgcggtggtgaattaaactttagtgcccgcggtggcaacgctcaatatcatggtcataacgaaaccagccaggaaaagcaaatcgaccaagaaagatactatcgggttattagtgatcttctaaaggacgacaaagaccttggtaaccatgacttcattttgatggggcttacaaagaacgtcaacctcttcaagaaattaagcaaggggctcaagatttcagatgtcatgattgaccaatcagttcaaaacttatctgcaaccgcaattgctgaactcgttaacaataaggttgaagaatataataaagcccattctaatgacgcggttatgaataaattcaaagatcagttatatactgatccaaccaatatccagaatctattaaattcacgtcagattcgtcaactgtttgttgcttcacgtgatgaaatcaaccaatctgatccagaaatgtatgctcagattaaccaactcattaaacaagcattagctcaagatgccgatgtcactgttgtttcggaacaatccgaaatgccattggttagtggtgtcagctaatcgttattctttattaaagaagggagctaggacatgaaaattgtcctaaccccttctttttgcgtctcaataacaaatatctatatcgttgtcttactcaatttttcttgaatctcttcagcaatttcttttagccgtggcatatcctggacttgagaaatcttgtaaccaacaaaatacggtgatgttgcaaatcgcggcacaattttgcaataaaattgcccgtcaatctcgtaaaaaaacaggttgtatgatgataaacgaccacccatataatcatgcaataagtatttcacgatcacatgaaccgcatcggccagcgcatcaatttgagtgacatcattaattgcaatattaatttcaacaaatccaataatcggatccgttgagagtgtaatcgatcgttgaccatcatctgaaactgggactccagtgaaattcttgatgccaacgttctggtaaacatcgtagttatccaacccaacgatttgaaaatgagggtgtcgcagactcccaccagatagtggaccaaagttcttatacataatcacacttgtatatttattagagacaatcatttcgtgccaacatttaaatgcaaactcaaagacctttcgattggtataaactggataaatggaaggtcccccattatggttgctggactcaataacaactgtttgagtggtctcttctaaagttcgaaatttattcattaaccaaattcgatcatgatcccgtgccagaatgtgagtgaggtgctcaacatcacaaaacggacaatacccatttggatgatggatattttcgggctttccttgagctgcctgataattaaatctaagtggttgatttggcatgtcattcacctttccaataatgttttcttaattataatgcttgttttatttggcgtccattaggataaatttttagcttgtaaaatacaacagttgcattcaccatttttcagcgttatattaattagcatacttacgaaaagtaagcatctcgaaaataaaatctaggagtgacttttaacatggcaaaaataacagctggccacgcactggccaaagtgcttgtaagctggaacatcgatcatatttatggtattactgctgattccatcaataacaccgttgacggtttgtatcaagaacgtgatcatatcaaatatattcaggttcgtcatgaggaagttggctctcttgcggcaaccgccgatgctaaattaaccggcaaagtcggcattagttttggttctgccggtccaggtgcgacccacttgtttaatggcttgtatgacgcaaaaatggatcatgcccccgttgttgcaattgttggccaatcggcaacgccaattatgaacacctactttttccaggaaatggatcaggatccaatgttttcagatttaactgattttcataaacaggtgactaatcctgaccaaataccatatgtcatggatgaagccattcgttatgcctatcgaacaaagggcccagctatcgtgattattcctgacaatttatcaggtgaaacaattgaatttgagccctacaagacagccaaggttcttaaaccagcaactcacgctactgttgatcaaacagctgtcgatgctgtttacgaggccattaaagcagctaaacatcctgttttatgggctgggttaggtttgaaagatgcccgtgacgaagtggtagcattttcagaaaaattcagcgttcccgttttaacgactgctccggcaaccggcattatgccaactgaccatcccaatttcatgggatcccgaggtcgtttaggaaccaaaccagcttttgaagtcactcaagccgctgatttgattattttggccggtaccaattacccatttagtcgtttcttaccccaaggaatcaaattcatccaaatcaataataacattgaagatttaggtaagcagcatgacattgatttgacggtgttagcagatgccaagccgttcttcgcgcaacttaatcagactgagcccgaaatcaccccaaccccatttctcaaggccgctcgccaagacaagcaaaattgggatgcctggttaaacaaagtcgccgatgatgagcaaaatgggctcgcccccgaagcggttattcgggcaattaaggaaaacagtgatgacgatgctgtctttggcttagatgtaggtaataatttgatgtggtcaattcgtcaactgccatttaaccgcgaccaaaaactaagtatgtccgcttggtttggtacaatgggctacgcattaccagccagcattgcgggtaaattaagctatccccaccgacaagtcttcagtatttctggtgacggtggcttctcaatggtgatgcaggatttgttaactcaagttcaatacaacttgccaattattaacgttgttcttgaaaacaaggcctttggctacatccaacacgaaaaaattactgcccatcaagaaccatacggcattcactttattggtgctgattgggccggcttcgcagatagcatgggagcaattggcatcaaagttgatgacaaggcatcacttgcagctgcctttaagaaagttcacgatttacaagctgctggtaacaccaagccaattttaattgatgccaaggtcaaaaatcaggatccggttgatacaagttttatgccaattgatcctgaacagttcgatcaagcaacgattgagacctacacaaaacaatccaatctatctgatcagccagcattttctgaacttttgaaaaacgaagaataacaaatttaatgataggaagattgccggggtaaaagtcattttgcccggcttcttttttaccatcacagttttgtacacgtcaaattgcaactagtcaacaagttggcgggtcctgccagtccaattattcattcaactaagttcatcgaccatcctgccaagccgtttgtttgataacgtgattgagaacccttacaattttagtggatcgatcattaaaatatttcaaaaataggagtgagttatcatgaaagcctttggatacgatcataatggtgctgcagacgtttttgaagaatatgacgtgccgacaccagaaatttccgacgatcaaatattaattaaaacggaagcctttaacctcaataacttcgagaaatcaatgcgggctggtgagtaccggacaacgaccaagcaaacaattcccggccgtgatgttgccggaaccgttgcaaaactaggcgccaatgtaggcgactttaaaattggtgaccgggttgttgcgcacggtcatggttcctatgccgaatacgcttacgcggcggctgccagaacggttaaaattcccgatggtgtttctttcgttgaagcagctggaattgtgacgccaggaattaccgcgtataaagccgtttattactttggtgaagtcaaatccggccaaaccgtcgttgttaagggcgcctctggtggtgttggttcgctggcggcacaactggctttgaatttaggcgctcatgttatcggtattggtgccagcagaaatgaaacctacgtcaagtcactgggtgtcaaggaatacattgcctataacaaacaagatcccgctttagtccttgctaatcgggctgacgtggtcatcaattccgctttaaatggcgctggcagtgatagtgatgcccggattgttaaagataatgggattattaccagtgttggtggcgatgagccgctttccaacaagccatttaagttcaaaccgattgcccccactaaggccgtttcggacgcagaagcgttaagtaccatactcaaactaatggctgagaaaaaactaacaatcaaaatcggctatcaattaccatttacaattgatggcgtcattcaaggacaccagttattaggtaaaccacacgatggccgcattattgttaccaaagagactgcttagttaagtcatcccaaccttgatgaggcacacaactgccaataatagtttggattgcggcaccctttttaaatcggatccagttaaaaccgatgtcggtttttgctggatctttttttagagctaaaagacgaaaataatgttggatttattccccaatgttttaaaagttaaataataatcactttggtacctactttctctcattcaggatggatgttacattttgttaactgtaatcacacgattattattaacatttaccgtaacgacaaccctattttggttattatagatgtagaaattctttcctcgccgctccaccaaatcagcattgacaactacatgataaattaagcgttcaatttgaacttttgtaaaattcatggccaatttcttattaattctctggtaaaccagttctgtatagcaaagcttatttgcgattatctgcttattagtcatgattatcctcttttttcactttgattagttattttattcttaattagccgatagccaatatgatactacaaccagattgtgtcatcacgctcaactaactcattaattggaatcgaagttctaattgcaaatgagagtgggacgaaaggcggttacgcggcaggaagttgccttttggcgcacgtttccagtcggtaataatcgtgattatacaaaatgggactgggacgaaattacttttgtcccagccccattctgctattgtgatcagagtcatcatcaatgattaatcgtaaatgatttctccaccacgttgccagcctgatcaactgccttgaaaataaaatgattctggccacgttttaaattttccgtttgattaatttgataatcaggatatgggtttaacggcttatcaggatcatgaacattaaatccagcattgttctgttgcgcaaagacgttattaccattcaaataaaccttaaccccacaaacattatcattactggtaccggtgaacgtgacttgatctccggaaactgtttgattaacattcaacgttggcgcaaccacatcgagataaatttccagaatcccccgctgcttttccatttgatagttaccattcttggtcttaactttcgtctcaagattatacccaaccccacgctgttctgtcggattaaacggcacgttcaccttgaattgaccggtcttggaaagatgaacgtgattgccagcagcgttttcatttggtgaggctaacaccgttaatttttgttggctcggatgagaaactttaccactaattgttaactggcgtgttttttcgttataaattttcacactattctttgcattcaaataagtttggaaattgtcattcaatcgtgcaaatttaatccctttacttggtgtttgttggtacgtcagttgcgaccgtttatgcccatgaggcgttggtgccccatagcttaacctaagttgtttgactgccttggtgtttgaatttaacttgggtgcgcgttttttaagttggttaaaattatcagaatttggatattgaccaaaagaaatcattttctttggagatcttagaaatgcgccaaattgcttaccgggaacttgagcccatccttgaaggacgatgtaccctgccttatcgaattttaatttaaaggcggcaattccttttgcccggtttaaacggcctttaacgacttggccactttgcgtatcttctgcaaatgccatcatgcctggaacgttttttggaatccgtgccagaacggtaaaggtccgattcttcatatcaataaatgaataatcactggtcccgtatagataccatttcaattgtggaacccggttcttagcttgcgtttgcttatgtgactttgcctttgctgcagaagccttgaccacttttacaatggtccgattaccagcaatatcagtcaacataaaggtcgccgaatgcttgttgagcttattcttaacagcttgacttaatcgcttagtgaacgcaccctgatgcgtcgcctttttggtcagtgacaccccatattggctaccggcaacttttaaaacaccacgagaaatcggaacaaaacctgcgccatgatcactaaatttaccactaagcgttccctttttaaccgagtacttcactgctttaactgttggtgcctgatcgtcaactcgaaccggataagtcgttgtttggaccttagcagcaccgtcgttatagttggtcgttattaattgataatgatattgaccattgggagcaacctgagttcgaccggttttggtattggtataggtgccatcccattcaaatgcattaggatctcgacgcatactgtacgacgtagacaaatccaagttgttcgtattatcgccaattgatcgatccgtattcgtctcttgatcaatggttcgaaccacagtgccctgctcattaacaatttgagcagttacgtttgccagtccctgtttagcaaaaacaaacggtttgacagcatcttgccgatggtcaccatttggcgaaaaggcgacccttgccggatgaatcttagacgcaatttttgcccaactcgttttgttggcttgattattaacgtaagcacttaatgaatcacgatcactaattccgagtggtgtattgaattcgtcgattaaataaccgcctctaaaggcagaattcgactgaaacgctggtgaatcaatcacctgttctttggttaaatcaccttcataaccaagatatgggacagaaagtgactggctcttatcatcggcgacaaaacgtaaatagccttcaataaccggatttttctgggactggttgttaagattaagtgttaggttaattgattttgtttgctggggatcaacagtgaatgttgactgatcagcagttaacgtcgccccagataacgaaacatcatgaacctgaccttcttttttggaatcacgggtttcggttaacgggccaatcgcattatcaaatgtataggcaattggttgattaccatgattagcaatctgaacggtaaacgacttatgattatcaacttgccccagtgatatcgatccgatattggttgtcggatcaactgcggtcacctgtaaattgccagccgccgaaacgttaattccaccactgccctgacgccgtggtgaaatataacccgacttatattgaacatctttcatcggcgttgcactgttcatcagcatgtttttagtctccatgactaattggctgcccgttaaattaggctgtgtctgctttaacttctccataattaaggcagccgcacctgaaatgtacggtgttgcggctgaggttcccccctgcgtcgcgtatccgttgtctctccaagtcgaagtcgaggcaatcccgggtgcagaaatatccggtttcaatacataagttggggttggcccccacgaggaatatcctgtcatatctgtatcagatcccttggaattgttttctgcgcctgctgtcatagcattagcggcaattcccggatcagcgatgatcccactattggcagccgcatacccagttgtaatatcaccggtagtggcagtgggatttttcgtgtagatactggcaccatgaccattattaccgcccgcaatcgaaacaaagaccccatgatccaccgcatactgaacggcagcctgctcctcatcaaaaggcgattgattcggaaaaccactgcctagtgaaatactaatcacattggcaccaagatcaaccgcgtcatgaatcgccctggcaacatcattatgactttcatcatcaatcatatccgaaactcttagatccaatagttgggcttcgggggccacccccacaacgtattttgacgattttttggtaacacgaccatttgccgcaacgatccccgcacaatgctgaccgtggaaagacgaaatattatctggttcagttgcttgattactgttggttgcgtagttataggcaaacggaattttgctgttgacgtaacggccgtatcccttttgagcaattaatttctgggcatcggacttagaaatggctgccgtattgggatcagataatcgcaaatctttatgtggttgaatcccggtatcaataattgcaacaaccatccctttaccacggtatccttcctgccatagtggggtgatatttcctttactaattgcctcttggttcatatttcccttggcgtaaacaactgttggagccaagttactgaataatatattgctaaatccaagtgacaaacccgcacataaaggaatcaccacacttgctcccatcaagatgatccgattaatctttttcttaaataatttacccaataatctcatgataattcccccaaccgacactattctagctcaagtataatgattgcagaaagacattgcatttgattagatcttttttacgactaaccacctaggcattaagtttaactgtctaaataattttaagcgctttcagaacttgtcttttatgatatgctagatatattgaatcactcataatttgtgattaactgaaaggggaaaagatatgctaagaaacaagctgttaccattatcattactagcaaccataacgttatttggcacagcaacattaaattcaacaccagcacaggcggctaataacgctggtatccgaccaggttcactgacttatcacaaaacggatcaattcgcgacaattggaaccaattacaagtcattcaaattgtataaccacgtcccaaacagcaagtataagcagattaaaacggtttcttggaaaaaagctaaaatgagtagctatggtgttgtgaataatgctgtccacatcgatatgttcgccagccaaggattgcaatataattggtatcgcatctctaaagccaatgttttacgtaatcgaacgcctaataatcagcagaaaaaagttcaaaaatactgggtatacgggcaggccttggtatttcccaaaacaacgcaagcagtcttttctaaatagcatcattgcaatagtgtcgctaccaaagaattgggatgattcatttgtcttggctctttttatttggcagcatagttgtatcaatggactgataaatcttaggcaaattgcccagaattcctcttatctttccttcacgtggacaaaatatgcgagagaaaagcaggctccggccatataagcccccctaacttaatattccagaaccaggaatagctactgtcgtcatttttacttggctaaaacgtgcgagagaaaagcagaccccggccatataagccccctaacctaatattccagaatcaggaatatttgttaacggcccttttacctagacaaaacgtgcaagagaaaagcaggctccggccatataagtaggtcaagcccacattccaaattcgggaatagttgtcgacatcctttttacctagacaaaacgtgcgagagaaaagcagaccccggccatataagccccctaacttgatattccaaaatcaggaatatcaagttagggggcttatattctggggtctaaccgctttttctcgcactctccacccatgcctccgccaccgcattccagttgccggtttgatccaagattttttgatatttcctgggcatttgactatatccaatttgggttagcggatccgcgtatcggcgaacgaacaaatccgcttctcttgcatcctcgttttgacgataggcaagtaacgacttcgttaattccggttgcactttaatttttgaatcatcaacatcataaaatttcagccgtcccttaactggaaatggttgaactaattctttaaccgtcaccgaccaagcatacgggccatcaggattaggcttctcgacattaccaattttaatcaccgccaaagcaaaaccgtttggtaatcctaaaccgaaatccactggtgacggggttccagcacttaccattaaaaatgttgagacattccccggctgccaagtccgaaactcttctgtcttgtcaccggtaataatatcccaagcatagggttctttaattgataaagctttcaacgttattcgctccttttactttttatgtcgcattttcccctgaatcatgtccgcaattgccatcccaatcagaatagctgcagccactctcatcatcaccggtagtagataaatcggatgacgagccactgataaataaagggtacttcccaatcctaataaaagaccaatccatattttgactgttgtttttccaaaaatgacacgttccccccttcctaaatactgttgtttctttctaaatattcttatcagatagttgctttaaaaattagcctttgaaaatcatcatttcgttgtatgctataagagagatgaaatttgaaaggaatgattgattttgcaaacagcccgaaatttatccagctgtactgccgttttagtcggcaaaaaagccaccgttgacggttcgacactgattgccagaaatgaagatgccggcagtgggattaaccccaaacgcttcgtagtcgtcacacctgaagaccagcccaacgaatatgtttcaacctttaataattttcgattgaaactaccagaaagcccacttcgttatacagaaaccccgtgtgcggataccagtgatggtctatggggtgaatccggtattaatactgataatgtcgctatgagtgccaccgaaactgaatttaccaataccaccatgttaggcctcgatccattggtcaatgacgggattggcgaagaagccatgctgactgttgtccttccgtatatccatagtgcccgtgaaggcgttaaacgacttggtgatttggtaaccacgtatggcacttgtgaaagtaacggaattgcgttttccgacaccgatgaagtttggtactttgaaacggttggcggccatcactgggcagccgaacgaatcccggacaacacctacgtgattgcccctaaccagaccggtattcaagaaattgattttaacgatcccgatcattatatgtacagtacagatttaaaagaatttgccgaaaaaaatcacttaaacaaatcgccccaaaattttaacttccgcgatattttcggtgaagacgttcaggctgatcactattacaatactcccagagtttggtacggtcaaaagtatctgaaccctgaaattaaccaagatccagaaagtcgaacaatgccatttgaacgcatccctgcacatttggtttcgattgaggatgtcgcctttattttaagcagtcactatcaaggaactgattttgacccttatagcaaaaccggtaatcaagaaactcggcttcgttaccgaccaattgggatgaatcgaaaccaggaaatgcatattttacaaattcgaccggactttccggccgaacatgctgccattcattggttagccgagggcgttaacatttttaatgcaccagttcccttcttcgcaaactgcatagatacaccaaccaactttaagaatacgccagcccggacaacaactgagagcttttactggttaaataaattaatcgcgatgttggcagatccattctttgcggaacacgacttggatgccatgactgccgtttcagaaagccgaaagtttggcttcgcccatggccgccaagccgttgccaaagctgacgctgcctaccaagatgttgacaagaccaaactaccggaatggcacacaagtgttaatgataagattgctgcaaccattacttataatctgaaagatctacttcatcaattagtattgctaagagctgaaaagatggtgccaacctttgaaaagggcggcgagttgtaaccgacttccctttttggaaaaaatgccatcatgaggccaactagatattcaataaatctttgtatgaagggaacccttgccaatgcagcttttcaaaacaaaacacgttaaggtaaccgttcgaaaagcaacacccaaagaaactatcgttgcacttcttcaacttgctttggtagtcttgctcatttggcgacaccgatatcgagtaagtcagaaatagcttaataaattttagccgaaaaaacggactgaagaaaatataaaattttcccagtccgttttattttgcttgaactatttgatacatctatccaatcacagtggctaatgcccatgtgtctttccccgaatcacatggtcagcgtgctccagcatttcgttgatcacatccaggatatgtggatcatccagtcgataataatttgccttgccttcacggtgggcgctgactaactgatgttgacgcagtaaagccaactgatgagaaacgacggattgctctaatcctaaaagatcacctaattcaccgacatttaactccttttgctccagaacattgagcatttgtaagcggattggattgcttagtaacttaaaaattcgtttggactcggccaagtgccggtcatcgattaaattaatttttgattgagcggacggctcttctaccacggtttaactccgcctcctgttaggaatcatttaccttttattttagcatgcctaattgtaatgactaccattatgtggaagtttgggggaatctttataatcagagtgatttaacaagcggttagctcccagaatataaacaacattagctagtattcctgattttggaatgctagctaatgttgtttatatggccgggagttgcttgttaaatcacgtttcaactcggtagtcagatcatttccgcatttggaatactggctagcattgcttatatggccgggagttgcttgctggcacccgatttagctcaataaaaataacttaggaatggtactaaacccattcatatcgtttgctaattatcttaccctggtttctaacaatatccgactttaatagcgtttattatcaaaaaaattaaagcaagaattcacaatgtctccatcattaaaatggtaaaatagggttagataaagcgattacaattggaggcatttaaatgacaaatcacaattttttacaaccatacacattgcgaaatggtattaccatcaaaaatcgaattgccatgtcgccaatgaccgagcaatcaagctttgaggacggttcaattaccaacgacgaaattgcctattatcgcttgcgagctggtggtgttggcatgttaatcaccggctgtgcaaacgttaatgaccttggcaaaggctttgaaggtgagttgagtgttgctcacgataaatttctaccgggattaacccgcttggccaatgcaattaaactcaatggcaccaaagcaattttacagatttttagtgccggcagaatgagtcattctaaagttctccgtggcaaacaacctgtttcagcgagtgccgtcgctgcagttaggccaaacgccgaaacgcctcgatcattaacagatgcagaggttaaacaaaccattcacgactttgcttcagcaaccaagttggcaatccgagctggctttgatggcgttgagctccatggtgccaacacttatttgcttcaacaatttttcagtccacattcgaatcggcgaaccgatcaatggggtggcagcttggaaaaacggatgaccttcccgctggctgtcgttgatgcctgtgcggaggcaattaaaacaactgctaaatccccctttattttgggctaccgaatttcacctgaagaaattgagaaacctggaattcgaattgatgacacccttgaattggtcaaacgattaaaagccaaaccaatcgattatcttcacatttcgcttgctgacgcttggcaaagttcaattatcaattcagatgaccgccaaccactattcgagaaatttcaaaaagtggttacagctgatttgccacttatggtagttggtcacctggcaactccccagcaagttgaaaaactaatcgactccggcattcaatttgctgccatgggtcgggaactgatccgtgagccgaaatggcttcaaaaggtcgtagccggtgacgaaaaagccattcgctatactttctcattaaatgatttagaggagttaaaagttaccccaccgctactgaacttcttaatgactgcctttcgtagaggattccccatttctaccgattcaaatcaattaaacttaccgtaataattaatgatttaaggagatgatgtttcatggttgaagttagattatcaacaaattgggacgcagaaggtttatacaatttctatttaaaaattactggtcaatcagataatttaagttatagccacgatgaagctcaacaatatctaagtaaaggaaaatttgtcactgacttggagaaacgtcacagtatggtcacactcatcgcacttgacgaggatgagactatcatcggtgtttcgcaactcactcggcgaatgatcccccgcttttcaaaacgggcagatttggtaatctcagttgataaaagtcattggggacagcatgtcggcagtgaactaatggaacacgccattgactgggccaaaaatcagtggcacgttgacgggatttatttagacgtcttagccgataacattcgagcaatcaaactatatgaaaaatatgattttaaaattgttggtgactttccaattctattaaccatcaatggtgaaaataaacccggaaagttaatgtttaaggatttaacgcaatagccttgtccgacagctcagttcgcgcaattatctatgggggtaatttttgtggtctcgataagaacgtttgaatgggaagatgcaaatgaattctataattatttaatgaaggtagctgatcaaacgccctatctcagctttagtggtgaagatgttcgtgttcgtttcacacccgaaatgctcgcatcacaaattgaaaacgatcatttaaacatttcttttttagcaattgatcgtcaaaaaattattggtctttctcaattaagtcgaaatccacttccacgatttgccaatcgggctgagtttgccatttccgttgataaagactattggggcaagcacattggcagccaacttcttgaaaagacaattcaatggggtgaaaatcgctggcatgttggtggcatctacttggacgttgctaatgacaatgagcgggcctttaatctctattcaaagtacggcttcaaaattatcggcgagtatccgatccttatcacggtagatggtcgggacatcgccggaaaaatgatgtataaagatttgagaaataagccgcgagtccgtaaacggtcagtttctagatataagtaactgtaatggtattgaaaggaaccaattaatatggtctttgtctaatctcagctatcattttaaaattggttaactcgattctttttaacgcctgaagatttaacggaagaagatccttaaatgaatcattcatctgctaaacaaattttgacattcaaagttcgcggcatgaacatttggcttcttaccgcaatcacaatttatttggctttttgctctctaacattaacttttgagattgcccttagtaacgccggcgccgctagtgaagggacatcgttagcattcaaaattagcgaatggtcaattattgtttggatagttgcgccatttttgccttggttgaaacaagttcctgcgtggctggtttcaactggtattgcgctgtacgttattttactaattttttatgcagtacaatcacttttctatgattacctttattcagaaatcatcccgattacgctattgggcatctacattagctattctgcttttcattcaaataagcataatgaatggtcaccaaccttgccgccttatacgatcaatggaatcaacatttggctcttattcattatcacactttatcttattggctttgcgtacattgacagcagcatctttctaaacgaacccagctatcctgacaccgggcaatgggttcccctcgttcaattatttaatgagtgcctatttattttcctaatttccgctggtgtccttctttggataaggaaatcaccagcatggctaatttcacttaatatgacattatactggctaatttctgcctactactcaattcaaatgaacaggaccatttcatggttcacatttatttccctgggactgatcacagcgtacgtgagttactgtgttttctaccacagaaagtgattttttccagctagatttttaacccttttgttgttcgaaaccctaatcagaataaatatcgataatcacttgactctatgaacgtatgttcgtatattgttcatagaggggatgtggtaataatgattcatgatgtgccaagagatcagtggctttacaatgatcgaggaatgaaaaaatggatgggctgttttttgagtgaccatactcaggatatggctaataaacagcaggaagaagtgccaactcatcgattacctgagcaggattccaagacaattgatcagattttacaaaccagttggaaaaattcaagacaaatctcacttcaaattaatgacgacagctatttaaatgtctacaatattaatggtattattattggtgccaatgatgatttagtttatcttcaaagcaacaaactaatgacgattaaagtgagcgatattcgccacgctgaaattaaagaaagaagcaatttaatttgaaagaagcctttaacgcaccctgcaccgataacgagattaccattacggtagattcaatcaattatcaatatttagcacttcgacgggcatctttagatgttgcgcctttagattcggttaacgtcacgttaaccgatgaaccaatcgatggccatgcttattatcaggttgcaggttttagtgtcgcccaatcgggacagttgcaggactttaccttaaagcctggtgactatgcggtttaccgagctcttcccggtggtgaaccgagcatggtggttcagcttctcggacataagactgagtaaactttctataccagattctaaaaaaatctggattaaaaacaattattctacaaaaacgaaccatttcaactactaattttcaaaaattctcctaccgtttggcaacaattttctaataccaccagccgggtgaggatcatcaccacgatatcgaggaataaggtgaaaatgacagtgcatgactgtttgaccaccaaactgaccaacattgacgccaacgttgtatccatcaggatgggattgttgatcaaccagacttttaccttgacggagcaactcatgaattgccaatagttcagcttcagttattttaaagtaagtttccttatgatctttgggaataactaatagatgaccttcactgactggatgaatatcccagaaagcaagtgccaatttattttctagaactggtttaataatggtgcgttggcagaaaatgcaatgcgtttttttcatgttgaggactccctaaatatagtgacctcagcaaaggaattaataggtatgctgattgtagttttcgctgtaaaatataaaattttctggcaccaaacaaggagcctcgttactaaaaatccaagcaagttgagataatagcttacttggatttttaattaccaataaatttgccccagttgttgatattcaaaaaggattcatttatagcatcccaatagctgctttaattttccggcattcccccactatcgctaacatcttgcagttcgttggaatagattagtaaccgctgggcataacttggatgatcaaattgcgtttcaatgttgacttgtagttcatgcaaattatccgtaatgatgccatcaacattcaaaaacatcatgcgggtcatatcatcgtcgtcatcaacggtccaagcaaaaacttgttgcttccgagcatgcgcctcatcaacaaaattctgattcaacgttgtttcttccattgtgtagccgttggccttcgtttctggaaatgaaaagttaaacggtaaaatataactaacaaatagttttggtgcccgctttttcaatccagaaatcacctgataatccaacgaatggatccgatcatggtcacgcaataatcgtttttcataacgtttgataaacaactgtagcatatttgaactatcatattttgttgttttaatttcaactaataatttttgatgatcccgttcagcagctgtcaaataagcgttaaaactagcaatatgtgccgtatgtccattttcatgaaccttcaattttgttaactgcttaagggttaactgatgcggtgctttgtcaacattggctaaatcctccaaattttcatcatgcatgacaacaaattgatgatccttagtttcatgaatatccatttcaacgtaatccggcttttcatggctggttttatttaacgctggaatcgtattttgaacgccattgccgttatcaactccacgatgagagatggttaacggccgagttaataacgccccttgcaaatagacgccattaaaagcaacttgaacaccgagataaaacagcactaacacggacgcaatgattcggcgtcggtaaggatgttgtcgcggctgattaggactcgttgctgtttgtgctgaacgacgatcgtccaaattaaaaatcaataccagcatgaagacgaccaaactgaaggcgccaataatatattgccaaattgataaaagccccatattaatgacggcgccggtaaaggcaacgccattggatttttgatcaaaataaagctgaacttggtagagtaatcctgaaaacaaagtggtcgttaaaacactgacggcacccaaaacaacaattcgccaaatatagcgccaactgttatgccgagtcatttgccagcttttccttgccgctgtgaatccaggctgctgatttaaaatcatcaatggtaatacctgaatcaaccgaatccccaaataaaacaatagcagataggcaaacaccactagagcaatgtatagccaacttttatccaccgcttcaaaaataaagactggcacttgaacctttgatagcaatggcgaatttaagtaaatgtctgaaatcggcaaaattaaaacaaaataaattaaaaagaataaaaaactgccaacgcgaagatggcctaaatttttaaacgccatcaacgcgatttgcggcaatcgctgattctgcttctcaccaatattttgaatgccaaaaagcaagaatgcaaattgccaaaaaaccaatgccaaaatcacaaaaagcaggatgaacaactcaataaccgcgactggccgctgagttaacagccaaccaacgtttgtataggacagataagggacctcgttcattcgtaaaataagactggttgaaaacgttgttaagggtaccaccacccctaacatcaaaaaattgatcacaacaaccaaaattgtataagcgccccaatttttgaaaaatgctttaaacgcttgtcgtaaaagcggtttccgtttcattctattagtcccctcattggttaaaattaattattaaaaacaatctaattttatcatacgcggatttggtttgtagaatcaatcaatcgggtttatttttcacatattaagagtcatatatgaaacgctttgttaaccatcataacgacaaagagaccagagaaaagtccactctggtttcttgaagattaaattgttaggctgacgttcattcaacaaaaggctctggcaactctcatcgataagtcttggccaattgatcaaagttggtaattcccaaaccagtcgcttgattataaacggttcccggctgaccaacataatacaaattagaattatttttggtgctgttaagtggtgtaaagggtgaattgggttgttgcgccaactgataaatttgtggattccaaaatcccattcgattccggccgggctggctattaatcaaagccgctgttgccgcatattgaggcgaggcaatactggttccatcaccagaagggctccacccatttttgggatgtttttttgttcttcgataaacccaataacaagtcgttgagtctgcatttgctgcaacatctggataattacgcccatggtctgttcccgtgacgacattcgatcctaaaactggttgccctaaccctgacactaagtttctggccttaaatgtattaactcctggtacgtttaactgataagtcggcgtttgatattgatgactgaagccaccggtactaccagccattccattaataaacaaactgtttggaaatttttgaacaagcttaaactgcttttgaaaaaatggccagagataatcagttccccaagcacgttcatgtttattaatgattgtcccatatcccgtcttcacccgaaatggtaaggtggttccgccaaccgaagtaataaatggattgctatcaaagaaatccgatgaatttaatgtccggtcaagcatcaattctctcccattttccgatttaaccatatagttaagagcgccagaatctccagaagccgtaaaattggaaataccttgaattgcgccctgcgctaaaacaaacgataatacttgtcgataaacaggcgttaataaatgccgatgtcgcaaaatggcaatgctcccactatctagaaggccataactattcgtcgtgctactaacaacattatcgttaaacgcttgttcgtaaacatcgataaagttcgttaaatttgaatccgtattagacaaataaatttttacgtttgcatctggtgctactgaacctgcatactccgcatccatggtcgtttcgtcagaattttggatatcttcactaggacaataaggtggcgaaaaaacgttcttaatttgaagtctactaggatttgtagccactttttcatgccgccaaaaacgaaaaatgttggcttttcgaacattttcaaaagcaataatcccgatggtctgtcctttacctgtcagttgctgtttatataacggtgtaacatggtaatgtttcgtaaaccgactagtaaatccactattaattgacggtctcttcttagcccttcttttaaatggtaaagaagtatccggataaatatagtcacgattgtgatctgtcaaaccaataatcgtccaaaccgtccgacttaattttttcggaattctaggcgtcttagtcccaaattgaactggattctgatgatatttagccttattcaagttagtttggaataaccgatcaattttattaactttaccaaatacccggataatcaaccgattcttcaaaggaacggctttaagcgaatgatgctttaataattttacccactgtgaaataagtattggggaagcaccatatttacgtccaaattgattaggcgtcaaataatgcttaaaattagtatctccaggcgtattaactgccaacgcgtcattctcaatatggttactattttgagatttcaaaataatatcaaaatatgttgtttgccttttcttaaccggtgttgggggcagattctttgccgtcgtcaactttttgtatacatccgaaactgaggacgatgtcgatgctgcctgcgtctgtccaccaaccaatacacaacacactaggggtgatagtaccaatcccaaccactttaattttctcctcacaattaaccgcctcatcttatttatggcttccaacaaaagccaattctgattcgaagcttctaggcatatctggtcgtttagctatccccaccaatcaatggttagcaccaaaagcaggctattccaaagatgcccggttaattcgaacgtaatctaagataacggtaatttagttataaaaacaagcaatgtctgttttacattgggttacattgaccggtatcaaagcaatctaataaataattagtacttgttcttagatggtttgcgattagtttccaactcaatgtaaaaacatcaatgacagaaaagtacagataaggcaaattagttgcctcacctgcaccatttattttcgtaaccagtcgattctacctattgactggctttaaactgagccaacaaatcagccaccgacggataaacattttcgttaactaatttaagtttttcagcatccgcatatttggaccaagctgccgagtaacaggcaatctcaacctcacgacatgctttaacatcccccaccgtatcagccacatacgccatttcatccggggtaatttgatactgctttaataattttttgaaattatcaattttattgggcccgtctgcggaaccaattaaaaccggtgagaaagtgtcggacatgcccaactgctccaagctaatttgcgagctgatcgagcccttgccagtcaccattgggataatcacgtcgttattttttaaccaatcgattaacttgataattccgtcaaacggcttggtcaactgccgatgactttctcgatattgcttataaaagtcatctaagatattttttggtgcatctggaatcagcttctttaacataccaatctcattggcgccaaacgttgctagaatcgttttatcatcaactaatttattagtgtacttataaacaattttccgaaatgaatcaaaaatcaccgggaaagtctcggcaatcgtgccgtctaaatcaaacgcaacaactttatacattcaaaattcatctccagtttcgatatggatattacactcatagtgattattatacgctttagagaatgaaagcgctgtccaattttggcttatattttaaaaatatttcttgtcgcaaatatccagaacagctaattcaataatttaaattaggccgatcaatcatctgattaaaaattagttaaccccagtatagcagtttacaagtaaaaaaggccataataaaaactcctcgccaaattgtgacgaggagtttttatgaagatatgcgaatcctgtttgcccaagccacttacttaggcaaaccaattaacgcaaatccaaagaggattatttttgaacgatcgatattctttaagcagtaagttgctgaaacgatcccaaattatccttgagccttttctggatgtccctgcaagtagataacatgggtgttcaagaattcttcgataccgtgacgaccatcatcgccaccgattcctgattctttccagccggagtgtgacccattcatagcttcgaagttgaatcggttaatataagtttcaccatcttcaagttcgttggcagcacgcattgcgttgtccaagttctcggtgaagattgatgaggtcaaaccgaagtcactgtcgttagccatttcaatggcatcatccaatgtcttgaatgtcaacactggaaggactgggccgaagatttcgtcttgaacgatttctgagtcttgcttgacgttggtgataaccgttggttcataatagaagccattagcaatcttaagggtatggccaccagcagtaatcttgccgccagctttaacagcccggtcaaccataccggaaactttgtccaaagcttcttggttaatcaatggacccatgccaacgttctcgtctttcattggatcaccaaccgtaattgcggccatcttgtctgataacttcttgataaattcatcagcaacatcttcctgaacgtaaacccgttcacagttgttgcataattgaccattattatcaactcgtgaatcaataattgattgaacggctaaatcaatgtcggcatccttgcaaacaatagctggtgctttaccacctaattcaagtgatactttagccatatgagttgcggcaccggccattactcgcttacctgattcaacagaaccagtcaaactaatgataccgatcttcttgttcttggttaattcatcaccaacaaccgaaccaggaccggaaacaatgttgacaacaccctttggaataccaactttgtcacaaatcttagcaaattcaagtgcaaggtttggtgtgtcggaacttggtttcataacaattgtgttaccagttaccaaagctggacccattttacgggcaatcaagaagaatgggaagttccatggtaaaattccggcggcaacaccaattggttgctttgcaatcatgatgttttcattcttattgtcggattgaagaatttcaccttcatatgttcgagcagcacttgccatgtaatcaaagtaatcagctgagaacataatttcagtggttgctaatgacttgatcttaccttgttcctcttgaagcatttcaatcaagtgatctttttgattacgaacttctgtggcaacatcgtgcaagtattgaccacgagttgcagctggcactttcttccatgtcttttcagcttcatatgcggcatcaattgcttcgcgagcttcttcacgggttgcgctgggaacagtggaaattggttcaccagtagctggattgataacagttaacatgttacctgattccgaatccttaaattcaccattaatatacatttgatagtgcttcaatgaaacagcattttgtgccataataaatctctccttttgataattacctgtcggcaataactaagattgatcggttattttggcgggcacaaatttaatttttatgtgaacgtttaaattaaactaacggaattattctcctggtttgtactgatcatcaatcactaagactggtttgattgtcttaccactaactgaatcagcgtttgcttgattgatatcatcaaacttgtagaacttttcggtcttatcgaagtcaaacatgcctaacttatagaaattaatcaaacgaggaacatcaacttgaggaatcgaatcacccatgttaacaccaacgactttacgatcgcttgtgcaaagatcattccaggtatccaaatcaatatgctgatcggtaacggcaatcgtggcaactgtcccgccttgtgccaaggcttgaattgaaccttccatgactgacttaacaccggttgtatcaaccgcataatcaacaccatgaccatcagttaatttcttaattgcttcaacggcatcttcgtctttactgttaatggcatcagtagcaccaagctgcttagctaattccaaacgtgaaggcacaatatcaacggcaatgactttggtgcatccagaaattcggccagccatcatagcagccaatccaacggcaccagtaccaaagacggcaattgttgaacctggttccggcttcaacgtattgaagacagtcccactacctgtgacatagccacagccaagaggtccaagtttacgtaagtccaaatcctttgaaactttaacggcgtttcgttcacgaacaacggttgttgttgtaaatgatgattgatcaaacatatcagcaaccttgtgaccatcttcggtaaagtgggcactgccgtcaggacgaacacctgacaagttgtttgctgcgtagttgaggcattgagttggaatcccttttaagcaattaatacaatttccacagccatagaatgaaagaacaacatgatcacctggtttgaagtttttaacttcggagccaactttttcaacaattcctgaaccttcatggccaagaataattggataaccgatttcagcggttcctttacgtaacgcttcatctgagtgacagataccagtggcaaccatgtgtacttgaaggtcgtcagcctgcatgtcggccaactcaacgtcgtccttcatttcaaacttcccatccttctgattaacaactgctgctttaattcgcataatcacatctccataacatatatttgttaattagtgagcaactacgattaaagtaaaaacagacaatttttactaatcgcctgttaagtttttgaaactatcgcacttgatgtgagtgttggaatttcaaaatcattcattcactcgctcgaaccataaccgcttacaactctgttataaccaccattcccaaaaaattcaagttaaaacaaggccaaataaaggtaaaagcaaacaataattctcgaaattgctactctcactaatggtttgaaaataaaaattattttcaaaaatattgtgaataaattcttttgcattcatcttgttttaacagttgagaattattcttgaacttttggtaaaattaaagtaacgactagttcaatttagagaggaaagaataccatgcaaaagattcatcaatttttgactttgtttttattaacaacgggactcattattggcatcgggttgtctaacacatctgcccaagccaaatatacccaaacacccacttccctacgaggttactggcagcgaccagctaaaggagatgcccgatcagttttaattattaaaaagtacaagtttgaaggcggcttactaaataaagagtattttcaaattaataccaatgacgattggcaaattcggggagataaatatctcaagggcactaaaacaccgcaactgtacgttaataaaaagaatcgcaacggttactataaacttggaaaagtgaataccaagacccgttggtacctgaaaaaggttaaacacaacggtaaagtggccttaaagtcctacgtgccaaacgcgcttggaccagccgaaggaaaagtcttctactactataagtttaaagggactggtgattttaaataacaattcatttttaatgcccgaatcagtttcttagtcgtatcgccaaatcagaaattcgggactcaatctgatcacggacatgacgaaaggcagccaattttacttgattgtttcccacagcctgagcagggtcttttaatggccagtgctctttttttattgcattaggcaccactggacaacgatctcgcgcatcaccacataacgtcacaatcaaatcactggatcgcaaataattgatgtcgatgcgttttgaatattgattagaaatatcaattcccctttcagccattacttgcactgctcgcggatctaatccatggcactcaattcctgcactggcgatttgacagtgatctcccaaaatttgtttggcaaacccttcggccatttggctacggcaggcattaccagtacataaaaaatagacttgaaccattaggaatcttcccccttatatgactggaattaaaaactaataagctacatacattcgggattaactaaggggtttcgaacttgctgcttgaaagcagatatttttttattcttgaacgccccaatttgctaaacgcggattcttcaacaaccgaacccgaagcatcccgggaacctcccttaattccgtcaataattgaatgatctgcgtttttttcatcgtcgataaatcggtatttaaaattgtataaccataaccatcatttgtcgtatttcccatcatccctttaaccggtaaattcttttcatttaaaatatctgccacatccgcccacatattatcccgggcttcaaagaataaagtgaagcgatgcggactaataaaaggtaaatcaactctcgggaagtttaccgagtttcggacggtgccatattcaagaaaatccagcaaattttgtaagattaggttggcactgtgggtcaaagcttcagtcgtatttccacccaaatgtggcagcaacgtgattttaggatgattttgtaattctttctttggaaaatcactggtatagccggcaaattcattatgatcaagtgccgataccacggccgaattgtccacaatttcgccacgaccaaagttcaaaaggaatgcagtcgatttcattaacttaaaatgcttggtggttaataacccattggtttgatcggttagtggcaataacaccacaacaaagtccgccagctccaatacttcctcaatggttgccaattgctgaacatgtcggagatttttaaaactacgattatacccaataatttgcatgcccatatgataacaagcatctgctaaacgttgcccgattgtgcctaaccctaaaatgccgagtgttttcccataaagttcaccgccaacataatcttttcgctgcgcctcggcaatcgattgaaggtcttcgccggcatcagctcttaaatcattcatcatctcaatggcgctgcgaagtggtcgaacacagcgaaataaattttgaataacaagttccttcactgcattagcattagcacccggtgtgttaaataccgccgtcccattctgagtacaggcctcaatattaattgtattcgtcccgattcccgaacgggcaaccaaaagaagtcggttggaaatcaactgatcatcaacgactgagcttcttaccaaaaccgcatccggtgtattggtatcagccagtttaaagacatcgccagcaaaatttgtgacattaaattgatcaagtgctttaacttcgtacattttttcgacttcctttaaccatattttggataaatagattataattgaaaaacagaaaaatttctttaagagaggttatcatttatgcatattaatttcgttaaattatcaaaagataaacccacgatcggtaaagatacgcaaactaagaatactacttttggccaatgggttgaactcggagcgagcaatttaatcgataattgtacaattggcgattatgattatacgggtcagtattgcttcatgcaaaatagtgatctaaaaaaattcatcagcatggctgccatgatcaggattggaccaactaaccatccctatgaccgggctgcccaacacattttttcgtacaatggtggtgcttacggtttcggtcatccagacactgaatttctggaacatcgaaaacatgttcgaacaaccgttggcaatgacgtttggattggccacggcgtcattattcaagcaggtgtgacgattggcgatggtgccgtgatcggatcaggtgccgtggtgacccatgacgttgaacccttcacgattgtcggcggtatccccgccaagccaatcaaagatcgtttccctgacgaaattaaaactgacttggaaaagattgcttggtgggattggtcacgcgaagatcttgaaaaatactaccttgactttaggttaccaattgaagaatttgtgaagaagcatcaagtaaaagaataaatcaaaatatgggataagaggctgctgccggaatggaaccaaatcatattctggaaattcagacctgttatcctttattttttatcccaaggtttacaagaacccctgactataatatgatacgtaacgtatttgacatttcatatcgacaggcattcaagcaacatatcatgactctgatgccaattaaaaggagacctttttggtacaatcaacattaaatttaactcgtgaacaagcaattgacttattagaaaaagcaactggcatgcaattttctgatgaacaacttcagatcttaaaacagccattttctcaaccaacgctcattaacgcttgcgccggtgccggaaaaacaactatttttatgctttcaactttagtcaccattatgaccggtgatatttcagcacgtgcaattttaggtatcaccttttctaagaaggctcaaactgacatgcaagttcgctaccgacagtatctggatcaactcagcgaagttgggatggatttatctgatgccccagccccttattttagtacctttcacgccttattctaccggttattacgcatcacaccggcctttagagagactcaggttctggcgagttacaaacattttgcgccaaagttaagcactcacattaaacacacacatagtcaagttaactcaccaagtgaaattttggacaacatgtttgaattagctgaattcatcgttaatcgaggcatttccgataacgccttcgccgacctgaccgatcccaagaaactccgagatcagttacgtgaagccggcaaagatgaatttgatcttggattctatacggattatttatcagtaatgaatgaatataccaatttaaagcggcaaaatcggttagtcgactttaatgacatgaaaattcagctaaatcacttgttgaacgatgacgcttacttgcccactttccgacaggccatgactcgcttcaaattagtcgtcatggacgaatttcaagacattgataacttacaatggagaattatgacaaagcttctctctaacgatgctttagcacaccttgttgtgatcggtgatgatgatcagagtatctattcttttcggggcagtaatccagactttattctaaactttcaccacctgttaccggcggccaaaacgtatcatctctcaaccaattatcgaaccggcggccacattttaacccaagccagaccagtaatcgcttccaaccatgtccgattggttaagcaactgaaagcctttagtcaagacgacggcaaggttaacgtttaccaaatggcgcatgctggttttgatccggatagccaaatgtttcgccagctgattcaacaaataaaagatccaaaaattgataaccatcaaatcgcactgctggttcgatttaattctgaccgaaccttggttgcggattggttggctaatcaaaatatcttggttaacatcaataatcgagccgctattttacaacatacactgatttatcggatattaattcatttaacccaagcattctgggaggatgattttgaacaattccactctcaagcaactcgaattgggtttaccacttatcgccgtcatgtaactgacattgaaaatgcttcgggtgacaaattaacttcaatgacggcttatttcagtgccgctgaagtatttaacgatcaacaccaaaaaacaacgaatcaaaaacgatttgcccgtttagaccagcgaatccagaggatggttaatcgaattcaaagaagcaaacaccaatggcaaaaagccccatcaactgatgctttacaaaaaacgattcaacaaatttggcaaaacattcaggaactgacagctgtttatttccactatatgacgtcaaacgattttatctcaaaagaaacgttgactgataccaccaattacctaatcaccgaattaaaacaagtcacagatttagatcagtggtttgaccaagagaccacgaaaaaacaattgctggaagataatctatcaaccggtgattccgatcatattcagtttctaagccttcaccaggcgaagggattggaattcaaatacgtttacttgtacggcttaactgacaagcagctgccaactggaacgaccattattaatcgttggtttcatcccgatatttcatttgaagattttattgatcgctggcagtcgcttgccagccaaagcaaaaaaatcagtgaattaaccagtgttcttgaatccgcctttatcgaacaaactgaagaaattaaacgaaatccacatattgatcttaaacagctccaaattgaacagtacagtgataaagaaatgaatttactttataattggtacacaagtattcgtaattattctcagctgattgaagaggagcgacgtttaatttatgtcggaatgacccgggcgtcaaaagtgctcaacattagttttgacagtaatttcagcccactcctttgggaaattccggtagttcgcgatgctttagaaaaacgtgacaccaagcattagagtcatggatagcggactatgggaaatgccagcgtacctgacaactattttaattgctgactttcatcattagcattcacttacgtttggattgaatttttatttgcgcatctgattactatttcattactattttctccccacccccacaaggaatgcttcaagatgtataatgaatatcgtcaataatcaagcagcagaactttgcggatagttttgctgttttctattgggttcaatcatctgtgtggtggtaatagcaattaagcggctagtctaccacactcatattcacactgacaaaattcagggaaactattgagtaattcataattggaggaatcagcataatgtcggaagagaagactaagacatgcgtaatgtgtggtaaaaccatccccgcatattccaacttttgcccttattgcggcgcaaaacagccttggcttgaagaagatgagatcaagaatccggatgtcaaacgaattctaaagtggtaccaaaagccattcggtaaactggttacatatatcgttgcctttctaatgatcatggcagtcggcagcatgttcacgctgcacgatggtccaagccacaaaaccattcaacgggaactcaatcaatacttattcaactcccggaccaataccccatttggtaagaagcctaagattaaggttgataaaaataaaggaacttcaatcaagatttccaaatccagtcaagctcttaaagatttgaagaataataagcctgccacttggaatcaatttgttgtccgagttcaacgacgctccagctcattccacaatgtttacgttaaccaaatgtactcaaagatcaccgtcactgctaaaaagaataaaaaattaacttacttaaaagttaatcaaggcaaagtaacttacaacgttgctgatcacatcaaaaaataaaccggctaactgattttcgatgctggtaggagcagagcgggacaaaaggcgcttaacttccagaccgtaatctgattatccaaatattccaggcttgaatatttggataattcggttacgcggcaggaagttgccttttgtcccgcgtttttgctcggtaacaatcgtgtttaaactaacggagactgggtaaaacaactattgtcccaggcctttttagtatcgtcaccaatgatcgatcgccaaatcaaactgtaaccaaacggctttcggccgtgaaattgacttttgttatgccactaccaatgattaaaagttaatcttgaaattaatcattccatcaaatacaattgacttcattagccttaagatcaacgaaaattaaaatcaactaacaaggagctggctacattgcctttgcgtcattcacaagtagatattaatgccctgaccgcttcgatgtatttaaaaggagccgcacctaaatccagttcgccagccaaaaaaatggccatcatttctgcaggtcaatccaacattgatggcagagttccccttgccgacctccctgatggtatcaacattccattcaataactgttactattgttcaaactacacgcctcattatttgcagggaaaatttgaaaacgggattcatgccgcagacttagacgctaatcgctggggatttgatttaatcacctattactatttaacacagttggctcaacagaaaacttacgtcatgaaatggtcacaaggtgggacatcgattgacccaaccggtgataatattaatcattggacggcgttttacgaacaactcgattctcctgatcattcactgctgtgccacttcgaacatcttatccgtcaatgtatgattgccaacgctgataaaatcgaaattcgggccatgctttggcatcaaggcgaagccgaccgacaatcttactcgccacttgccgcagaacattattatcagaacttaaaggccgtgtttgcgtactgtcgcgggatcatcggtaacagtcaactgccgatttttaccggcacaatcagtcattcctcagaacaatttgatccggttattgatgccatcattcgtcaaattgggcaagaagatcccaacgttcacttaatcgatatggccggagcgtcattactggacaactggcattttgacagtcttagcagtacgtactttggtaaagcaatctataatcaaatgatctcggcggggattgttgctggtccgcaggtttcattgaaacgaccttggtaatcgtcatttaaatttaaagtaaaacatcttcgaattgtaacggtaaaaaaccgcaatccgaagatgtttttttattattagcaatgctggttagcttttaaaattaaattcacgtcaaatctatcatgatgggtcattcgaatgcctggtagaatatcttctaagcagccactttcgcccctcttccagcaaaaatagtggtactggaatacaaaatagaaagctccactcgatgatatttaacggacccgtgttaaagacggtttgcaggaacggcacgtacatcaataatgcaattaacccaatttcaacaccgattccaagccaaattcgccgattactaaataatccaactgaaaaaacagacgatatttgagtccggcaattcattgcggcagcaatttggcagaaaacaattgcggccaacgtcattgttgtcgcttcagcataaccgactcccgatgacgccaacgatatattcggccaaccgttttcatgattaacaaagaaatacgcaccagtggaaataattgaagcaatcaagccataaagaccaaatgctttccaaataatcgacttatttaatagatgactatcttggggacgtggtggttgattcataatgccaggctcgctcttctcgatgcctaatcctaaagccggcagtaaatcagttcctaaatcaacagtcaaaatctgcataacagttaatgggagcgggaccaatccgcgagttaacagaaaaacaactgatggtgcggcttcaggcatgttactgttcaaaatgtaaagcagaaacttctgcaaattgctataaaccgttcggccttcttcaatcgcactaacgattgaagcaaaattatcatccgtcaaaatcatatcggcagcatcctttgcaacatcagttccggttacccccatcgcaatgccaatatcagcacgttttaacgcgggtgcgtcgttaaccccgtcaccggtagaagctacaatttcaccatttttttgacacattgaaacgatccgaaatttatgttctggcgcaactctggcaaaaattacttcgccttttacagcctgacgtaacgcgtcatcactcatgttatccaattgatcacccgtaataactgatgctttatcagacgtaatgccgatccgaacagcaatactttttgcggtaattggactatcccccgtcaccatgataattcggattcttgctcgccgacatttcttaaccgcgtcaaagatttccggccgcggcggatctgacatgatcgctagcccaacaaagatcatgtgagtttctgcatttccaatttgaaaatcatctaaagaaacatggattaaaggatcatcttggtcaacctcccgataggaaaatgctaatgaacgtaacccctgcttagcatatttttcattgactgccataatgtgctgtttatcagcatccgttaacggccgaacaatcccattgtccagaattcgatcacagatcaataactcactgctcaacgcaccctttgtatcaatgattacttggcctgtctgatttttagtaatcgttgacatcaattttcgattagaatcaaagggcaactcttttaatcgcggataagtccgattttcagctttgacatcaattccggcctttcgggataaaatgaccaatgacgcttccgtagatgttccgagaatcttcgctttttcttcgccagttccttcatcgacctcagtgtcattatttaacgtcgcaatccggagcaattgagataaatccggctcttgggttagctcaaccggtcgatcatcaacctgaatttgaccattggtaaagtagccggtgccggttacatcataatccttcgctgccaaccagagatgattaattgtcatttggttttgtgttaacgtacccgtcttatccgaacaaacgacagtagtctggcccaacgtttcaacactactcaaattttttaaaagtgcgtgtcgtttagccattcgctgggttccttgtgctaatgacaacgtaacagttggcaacagtccttctggaataaaggcaacaatcatccccagtgcaaagataaacgattttgcgattggatagtggacaaaaaagattgccaatagaaaaaatgcaattccaattaataacgcaatgatggtcagctgacgcgttaaatgattcaactctcgctccagtggataaacggtttgtttttgtccctgagcgagtttcgcaattcgtccaaattccgtcttcatcccagttgcgaaggcaatgccatcagctgtaccactagtgaccgtcgtcccagcaaaaacaatattttgttgtgcgaattcaccatcaccctgtttatactcatcggtcttttcaaccggtaaagactcaccggttaacgatgattcgtcaacctgtaatgatgaacacttgaagactcgtgcatcggctggaattgaatcaccagcttgaattttaaataagtcaccaggaaccaattcttcaacccgaatttgcttaattttcccgccacgagtcactttaacatatgatggcagcatcttttttaatgaatcggtggccttttgagcagcgtgctgctgccaatacgaaaaacaaccgttgatgacattgaccgcccaaattgcaattcctaattctggcatcccggcaatcattgcaacaataccggatacccacaacaaaattgccattaaggaagtaaagttttcaataaaaattaaaatttcagatcgttgctttgccgtttgaatggtattcggcccatatttttcaaggcgttgcccagcttgatcctctgtcaaaccggttgaatcggtccctaaagtcttcattaaatcggccactgcgggctttgctgcgttattcagtttaattgcttcactattcttcattataaataaatcatccccactttttgatcatgatatgcgcgttattcaatccaacttgattataaggcacccaaggcaaagtaacagctgtaaaggaaaaattcatttcaaatttatttaagatcccgaataggtgactgaagcaggccttgaaaatccatcattattattcaaccaccctgtcattaccatgcttattgtcaaataaagcgagggattgctttcaaagtaaaccagagtagctcaaagcgattagaccccaaaatacaagccccataaacttcatattcccgattttggaatgttaagtttatggggcttgtattctgaggttgacttgctggtccatgttttaatataggtaagataattccgatatctggataatttgtttacgcgacaggaagttgtcttttgtcgcgtatttcgctcggcaatcgtgtttactaacagagaatggttaaaacgattattatcccagccgccaccagataaacgttgttcacgccattttattttataatccttatcgggcagaagactgctcaattgctccggcttctggaaggttaacccgtttggcattcgttaaaacctcaggtgaaaatagttcttcaaccagcgttgtcggcaacagtcgctccccttcaacgattcgttttacagactcatgagtcgcaaccgcttttttaattaaagcggttgttttttcataacccagcaatggtgataagattgtcgcagcaattgatgaatgttcaacttctgagcggcaataatcaacattaactttgattcccttaacacagttatcaaccaacgtttcgatcgcattggttagatgttgctcactcattaaaatatcccgaaacataattggttcaaaggcgtttaattccaattcgccattttcagccgccatcgtcactgtaacgtcattaccaatgacctcataggcaacctgaacaaccacctctggaataaccggattgactttaccaggcatgattgacgatcccgcctgttgcttgggtaacgataattcattcaagccagcttgcggaccactggaaagcaggcgcaaatcattgctgaacttcgaaaggttaacagcaaggcccttcatgactcctgagaacgcgacaaatgcgtcactgttctgagtttcatcaaccaaatcatcggcctgttttaatgataaatgagcgacctgattcaaagtcggaacgatgttagcctgatattcgggagtcgtattaattcccgtgccaattgctgtgccacctaaattaacgtcactcaaaacaacttcaacatgttttagtcgagctaaatcacgtttaaacattgacgcatatgctttaaaggtacggccataggtcgttggtaccgcatcctgcaattgagtacgaccaactttgatggccttttcatactcacttgatttcaccattaaagcatcaaccaaatcggcagccattgtttgtaatccgggtaacagtttaagcattgccattttaccggctgtcggataactgtcattggtcgactgagattgattaacgtcatcattgggatgaatctcaagtgccgttttcccaccctgtgcacttatcttcatcgctaaatgggcgacaacttcatttacattcatattagtagatgtgcctgcaccaccctgaatggcgggtacaataaatggttcgaaatcatttgagaacaataattgattgcaggctgagacaatataggcagccttttctttattcaaagtccctgcagcctgattagtcagagcagccgcttttttgatttgaagataactctttaaaattgctggattcactcgttcttcagtaattggaaagttatgctgtgctcttaatgaatggatgccataaagtgcttcatccggtacaaacatttcaccaatgcaatctttttcaattctcatattctcaagccctcatttcatgtaatatcttttaacatcagcttacgaaatataatatatacccatttcataaaatgtcaaccactattcagcagaatgcccaaatgtaatatataccaatttatgacatcgtgatgatacttatcctcatttttgaaattattttagagaattaggctttgagtgtcattaatcataacatgtgtcaggtgctacattaaaaatcagtaaagtatcatccggatgcctccttcatttgatttgtctgttattcttagaatagtaaaatgaatttaattgggggatttattaattatgaaaaagatactcacatttagtgcgattttattagcaacaatttcattagcagcctgtgggggcaaaaatagctcagatggttccaagaatgcccaacaagccagccaatcatcaacattgaaagttaaaactaataagggaatcacccatgccgcttatgataaaattgcaaccgcaaatattacctcagccaaaggtgggactgacgaacaaattgtcaaggatgcctttggcaagcccaatagtaccagcaaagtaacggttaatgacggtagcaaaaaagccgccgttcaatatgcctggactaacctcaacaagcgctttagggcctcagcggttaccgtcgaatttttaaaaggtcatgccgttggtaagggctacattgaagccggccttcatcagcgccgctatatcgcaaaggataacatcaatcgagttaaaaccggcgatacctatgcagcggtcgtgaaaaagttgggaaccccggcaagcgaatctctgaccggaaagggatcactttctgccagaagtgtcacctatgcaacgggcaaggacggcaaagcaattagtttgatgtttacaggtgataaattaatatcaaaaacagccatcaataaataaaatcagagtggaccagcaagcggttagatcccagaatataagccccctaacttggtattcccggttttggaatatcaagttagggggcttatatggccgggatctgcttgctggtccacgtttcaactaagtaacaagaccagcaaggtattcccggttttggaatatcaagttagggggcttatatggccgggatctgcttgctggtccacgttttcagctaagtaacaaggccagcaagatattcccgattttggaatattaagtcagggggcttatatggccggggtctgcttgttgacccatgtttcggctaaataaaaagttaaacaagttattcccgattttagaatgtcaggttagggagcttatattgccagggtatacttgctggtccaaattttaattaagtaacaagttcagcgagatattctaaatttgaatatttggataattcgattacacggccggaagttgccttttgcttggtaacaatcgtgtttacactaccagagagtggaaaaaacaacaattgttccagtcactttacattcatagggtaacaatgttatctttttagtcaaaaggaagtgttttaatggctggaaaaaagaatcataccaaagatgaaattgtctcactggcaattcgtcaaatcaaagaaaccggataccaatccatttcattacgtcgtttattaggtgacttacatctaacaaccggatcgttttacaaacactttgacaataaaaatgatctgttcacaaccatttcgatcaccttatcaagtcaactcagtcagcatgctcgacaattcgttctggatgcaaaaccaagtaccccacttgcgtctttaattgtccttggtgaatttatgattacccaatttcaggagcaatctaatttaacagaattcttattttataatccaagcgttctggcagtttatcaaagtgatcaaaaagatcagtttccactgctgaatgatgtccaagcactcatccaaaatattaaagtgacttatcatattaccgactcagtggataatctgttcattaaggtttggtcattcattcaaggctacggcattctgattcaaaatggtgctgctaaatatgatcacaaattattaactaatgccgcaactgaattgattggagttgagcacccatgaaaaaaattattgttgtttactgtcatccttacgtcaacagttttaatcacgccattttggaacaagttatcaataatttaaaacagcaacatttgaatccggaaatgattgacctatatgcagaacaattcaatcccgtgtatgatcaggaagaattgcagctatttcacagtggtcaaacccacgatccgctcgtgacgaaatatctaaacttactacgacaggctgatgggattatttttatcacaccaatttggtggaacagtatcccagccatgcttaagggattcattgataaagtaatgaaggaaggtgaaggcctaactcataccgttacaaagacaggcatccgcggtgagctggttaatcttaaacgtgcgtatgttctgactacttccacttccccaacattttaccttcgatggttttgcggaaatgccgtccaaaaaatttttattaaaacaacattgaaacaacttggtattaaatctggcaaatggcaaaattttggtagcattagcaacgcgaaatcagctaaacgaaacgcttatttacaaaaaattgccgaaatgccattccatttttaataatcccccattgactgccggccaaataaaaatgatctcaggtaaacaaacgcactgttttgcctaaggtcattttttattaattatcattcagttaaaatacgatgtgcacaaattattttggtaacaactacattctaggcgaatctttgttatttaaccgtgacatcggctgccttcacaaatgcaattcgatgattaaactgaatttgaacatacttatcagttcctttgatcacatttttagcacgatttgaatcaaaatttgaattgaaataatcagaagtcacctcaccgccgaagacataatgctgacctggctgcatggtgtaaattgggcttggcttaataccggtcaccttattcttcttaagcaacgactgacttggataggcgcttccatagactgaaattgctttagatcctatcggcgtcacaactttacccgttgcgcctgttgtgttggcgttgtctgggttatagaaccaagcattttgcccgccataatcaatctcagtccagtcaccggattggccaattttataaaactgttgtccttcgacagccttatccgtccaatcatctttttcagtggtaccggaatcagcggtcgtaaagtctttgtccgcgatcagatcactactgaaacttggttgtttgtaaagatacacgaaatttgaaccctttagtggtaatgtcaccccggcatccgttactttctgaccagaatcagccgttaagttgtgattggcatctggggtaattgtaataatatttgactcacccgctccttgactgtctttgaaattaacacccaataggtcaaaataatgattccaatcccaataggtccctggatcccagtgcattgttttttgactggctggtgttaaccccggcacattatcatgaccaataatgtgctgccggtttaacggaatgttatattttgcggccagatatttaaccaaatcggcagaggactgatacattgcctccgtgtaccaataaccgccaacagctgcataaccttcatgctcaataccgattgaatgagaattgatgtaccaattgccggcatgccaggccacattttgcggttgaaccatttcagcaacggttccctgaactgagctcacgacatagttagcagacgtataacttgcggttgtcgaaaaaagattaatcgcttcatcaaacgtggtctctgtattgtgaatgacaatatagtcaattttcaggccatcacttggtcgattggcaatatcataattgccataatcacccttattatcaaattctttataaagtgccggtatccattcaatcggtaatccatccgggccatcagttaccccgggtgttgattgaagctgggcatcttcagattgatctttcaatggactcaccttctgtgcagtaatgatcgtgccagacttggacacgccattcttaattgttttataaacatgattggcaaaaaaggctgccgcttgcttggcgccgtcctgactatacttctcaaccgcaccataccaagaattaacatcactagtcaatgatttacccaactgcttctgataaaaagctaacagagcagctccgccctcaatattagccttagtatctgttttaagtgttttgacggatttccctgtcaaagcggctgccttcttcaaagtttgacttgccgtcgtttttgcggcaaccttcagcccatttttagaactggtaacagctgaagcgctgacatccgttagatgcataataccatagccacccgcgacactgggtttgccattatgactttcccaaagcgtttcattatacgaaaccgacattaaaactttaaccggcacgtgatatttttttgccgcctgttgaaattcctcctgcagcgaattagcactcgcagcattcgcactaatagttaaaaaaatgattgctaatccaagcattaaactcgttaatacccaacgcgaaatccataatcgtccatgttttcccaacataatcgtcactcctcttgcatagatatacgataatcgaataaaaaataacttgaaactagaatacaacgactattagaaaaagtatactaaaattaaaatttgtttaataatcagattatttattcatgacatctcgttggcactctttaggatctaaaaagtcttttgtatcattaattgaacagtcatcttagtcatacatggatttgtctattttaaaaagagatgcttgatttcactggaacgacggctcacaagcaaatcattgaatgttacatataattatcatcgttttttaatttttaactgaattcggatagcactacccacataataagtgtatacttcttgaataattataatttgattggaggaaagtcatttgaaattacatttatcccattatttttcagctttaacaatcaccattagcttagtaacggtcaccgctttttccaagtcagctgatgctgcaaccacagtgtcaacagatgaaccactacagaccgatgctaatactagaaattatctacccaccggtgcaaatgccctttattcaaaagttcccggtcaaagtggtgccaaggttctggccaaagcaactgatcttaaaacactagccacaacggccgatcaaggtcaaacctattttcgcgggtatcgggttgcccagactaatgatggtaacttctatttaaaagttgtttcattcaataagacttaccggggttggatttatgttgggaccgcaaatccagccgatgacagtactcaagtaagcaatggcttaaagtccgttcaaacttttaaagaaggcactttagatcccaatgttgctaatacaacttattacttctcaacgccaaaatcttcgacattaacagtcacacaacccgattggactcaatataaggtcggacgtaatctgagcgcaacaacttcatacgtaaatgattcattaaatgtcaccaaggttggcaccaaacagaataaccgtgacaacaacgcgacgtattactatgttcaagatgacgctaatccacaagtgaatggttggataaaagcttcagaattaacaacagtgaaacaaacttataattactaagcagcacagcgagagtggggcgaaaggtggttaacttccagagcgtaatcggattattcgaatattccgaggttgaatatttggggaatttgtttatgcggcagtaaggaagttgcctttcttcacgtttttatgtcccagccatactgcgttcaataaaaggttattttaaataatttcgaaactaaccgttgtcaaatacaaatattaaaaaattattctatttcttccgaattgtttgtcagcgaattttatgataatctttcagtatcagtaaaagcacagtccggttggtagtccggacacggtgaccttcatcactgttagtatccttccctcctgggtcgtccaactgattatttttatcaaaaggagggctaacaatgaatcggattgttagtggtacattaaccattgtctttgatgcaccattttacaagggaatttttgaaacccgttttggtgaaaactatcaagttgcccaaatcgtgtttggtacgtcagatcccagtttgcaacaaattcttcagttcacaaatcatcactggcacaacttgaacttttttcaaactaattatgctgacccaataataatgaagcataaaattagtccgaaacgccttcaacgccttgctaatcggtcaatttatcgtactggaattggcacaaaagcacaacaagccttgcaaaaccaacgcgaggcaaaaaaagaaacaaagaataaaaagcaaaaagcttttcgtgatcagcacaaacgcatcatttacaaattgaagcaacgaaagcgtcacgagaaacatcgtggccattaaaaagaggctgtacaatatctgttgttggtaatagatttaatctattattaatgacagatttttttgtatattattattgaacaaaaaacgggcatttcctgtccgttcatcaaaaccaactacca

SEQ ID NO: 692 - DNA, 66330 bp, Unknown
  Metagenome-assembled genome
gatgccattgttcatcacttaattcatagcgacgtatctccatcgtgatcaatcctttatttttagcatatcaaactggataccatgcagaaaagtttaacgcctgtagtttgaagacactacctagtgttatttgtgatggtggcgatgggcttttctgttggaaaagttcaggcccgtttgctagcgatgacttgttttgcatccagtgaagttattttactggctttagtgattgtcgcttccagcattttttcaatggaatttcagaatcaggctattctaacagttatgtataaggctcccaacaagctttatgtttattttgccaagttagtaaccatttttatttataatctgattttacatttaatcgcaatgctttttacgtttattttaacgctgactcccattgtcagctcattctcttggctggctgtttatcagcatcatcaacctttaattgtcaacatgctggcaactactggtcttgatctggtcacatcaacatttattattagtttgattttcttaacgtcttgcattatcaattccaacgcagtagttgtaacgttcaatattgtggttatttatatgggagcatatgtttcctatcatttcttgttggataatgccaagttagcatacttgcttaaatggaatccctttaatatgacgaacttgactcaacaatattacaattccgcaatggttcaagctaccagcctgagtgtttttcagctaacaattggaaccctggcatattccttactgttctttgcacttggttatcttgtttttcgaaagaagcgattttagaaataaggtaaaggagcatttgcttgttcatctttagtttgctttgacacattaaagcaccctgatttttttcgttaacttttcttctcaaacaccgactgatccaacacatcccattcatcatagctccaatcatcactatcaaaaactttgccatgttccaaaaagtccttggctttcaagaccaacggcgatacgttattgatgtttagttctgctaagggaatttcaagtgcgcccagtgaatcttgaccgatgaattgcgtcacttggctggtcagcttgccattaagattagtgatttcgtaaaagacacagatgtgttgattgtaattccagcgtttgtattgccacggaaaccggaaactggtaacgcctaactggtcaagttgggtgggaaccagtccggtttcttcttttatttcgcgaacaattgcgttttgaagtggttcgccatcttccaaactaccgcccggcaaatcatatcggttaatgtacggaccgccattcttcttaataacgaccacgcgatcgtgatgactaatgataccgtaaacgccgaatgcacgatgaaatttctttgacattgggagacctcctaaatgttgatcgttaaattttcgggttagttcatgtagatcaatgtggtatttttcattatatcattcgcaatatttccagttaagaacgatatcagttgggaaaacatcttttcatacgattgctcaagaacaaaaacttattcatttggctcaaaacgcaaattcaatcaccgagaaaaaagtgagactataataatctcataaaagccagtttagaaagaagataatcaaatggaaaaatcatctcgctacatttggcaggtagccggtttgtttgcaacgctgattattgcgatggcttttttagctgttattttgtttaccgtaaaaaggtcggtcacaatttctcagtccttaatgatttgggctcaagatgtccctttatttgctattttttatttcattaaccgacgatttaccaagcaacaaattgggatcaagccgactatttcttggggccaattactagtggtaagttggccgttgtatttcgcggttgcaatatcagttttggaaatcgtcatcgacaggaacttgtactgggtgttagcaatctcagctggcttatgtgctgggatatttgaagaatttttgtttcgaggattaattttaggaatccttttgaaggcattcaggcatatgactaaaaaacgacaggtatggtcggctgttgttatttcgagcgtcttatttggtttaatccactccgtcaatgttttacgccaaccaattggtgacacagctttacagatgttgtttgccgtatggttcggactaatactgagtgtgctttatttgcgttcggggacaattattctaccaatgttattccatggcacttgggatttctccatcggaattgctaagggctctattaatgaaactgctacggtaacacttgctgaggttattattaatgtcgttctatttttaattgttttactcatttgtgcctgttgtttgcgtcaaaaaaagcttaattcgattgatctcactaaattgttagcataatgatcaattatctggaactttccaaaggtgtgaggagaattgattattagataagggttactaatatgctgataaccagagaaggtttctaaattaaagaaaatgaatcctattatttaattaacaaacaaaatcggcggggaatttaatctccgtcgatttgttgtcgcctgaggtttttggacattgacccaactaataagaattacccgcagctaaattgtcattggacttttagtaaaaaaactgccaaacaaatttagtttcggtgctatactaactttggaggcgagatcgttgaagaaaaaaagcttattactaactgtattagctgccggtttaaccgggctggtcttaacaagtacaccacaacctattaaagcagctggtgtctatcggactgtcaaatcccaaaccgctaacaacacagcttttcattggaacggtaccagtaccgaagcctatctctggagctataatttaactcaaaagaaacatcacttaactaattatcctaaaaccacctggtacgcaaacagagtcttaaaaatgaccaatggtaccaaaaccggaattttttactacgtaaccaaccaatccggaaatacatatgggtatgtctggcaaggttatttaaccaagggatctgcttcagaaagtagtagtcgcaatgagacgactacaaatagcaatactaattggactactaaagataatccggatggtattccacacccaactaaagaagaacttaataatttaaaaggtgctgatgatgaccaatatgactcaactgttacctattatcaggacttaccaattatgcgttcttttacagggaccagttacaatcgcaaattaaatgatgctgcgcaggggaagttggataatgattttggctcagtaacccgacatgaatggggagataaattacaacaaataaaatacctaactgtgtctaccagaccaacccagcagcaaattcaagaacttgtcgatggaaaattaacttttgaaaacttcgtccttagtgatttaaaaaaacaaggtattggtttaaatcaatataagggttggcagattggaatgtatagtaatcctatttataagaagaacaattttttaagcggcaacggtatttacataattgcgttgctggcacctcaatatcaataattcagttatttaaccaatcatagagaaagcaacttcaaaaggatttgtttgctggtcatacctgtatatcggattattttgattggaattgccattggttctagaagactcaagtttaattgggtcgatcttattcaaagaagctgcgcggaattgaaaaaatgccacgtagctttatttttttgattcatatttaaattttgaaatagcctattgacgattaactgcataatcttatacttaatttatgaaaggataaccaattttaaataggtaattctttaagaatcgaagttgactatgtagctattgtaattaaagaatatgggtttgacgaggagcaacttaatgaaactgagacatgtattattagtggccgttgggattgtttcagttggtgtcggatcaacaggagtagggcatcttttaccggagaacgcttgggccgctgagaagcaatcaaataaaaccaagtcaccgcaacttaagcagtattttgatctgaaaatttatcatcaatcacaaaaggctattaaaaaaatgaaaacattgaaaaagcagggcatcgaaatggcattagtgccacttccctataccgcattcatcaaggcaccggccggtagtcgagtggttgttaagcagggaaagcaagtctattacgataaggttgttaaaaatggcgtggcctttttaacaaccgatcctaagaaaccgttcaacatcaatcggtcggttgcagcctatgccaagctccctggcaaagcagtttcggcgacggttcattatcgatttgaaagttatccaggatattagggattagcagaatatattttatgaaagcacgatgatttccatcagtttcgtgggtaaataatagtcaatgcagttaaacagttaagctaattaatcggaataatttaccttatcatgtaacgacgcaatgttcggcttacatttataatgttaactttcaaattttcgttcttggacatttaaatggcctcattccagcctttatctgaagtgaggccattttttgaaatttagtttttaagttcagcagacctttgtcataaattctttattgctctgcgccacgaataaaggtttcagcaataagcgtcgggttaataacgcctctaccagtgagggaccacggagaaccagcttgatgagtgatcttgcttaacccaaatgctgttttatcaacataatcgtttaaaatatcggtgagtaaattagaaatttcaggatcctgctgaataagattaaaatcattaaaagcctgtttgctcaatccctcagaaacgatatctctttttccattaaatatgatgattatcagacattagtgcctttaataatttattgtttgactttgaggggaaagcacctgcttcatataaagcaactgtattagagctccagccaagcaattttgcgaactctctttgagaaaggccgatttttgcccgatattttttaacatcttcaggtgaaaccaagttcatatcattgcgatacattgaattggcaatttcaacggcttgatcgtctaatatcagatcgtcaaccagtttgtttgtatcactatcaaacctggcaggtgccgtaactgtatattcatggccatgaatgatgaacgtattagtataatcttttatatacgtattagtcatatcaacaatttgccttcctaaagtaatttgatatgtgaaagctaataaaccggaccttttaatttgctggtctagcactttgtcccttccaggttttaggataatactactgttacttttttgccaagagcattagcaatttttgtgagagtatcaatactagtgttatttcccttctcaatgcgagaaattgtactcttggggacaccagacttatcagccaaactctgctggcttagtccggctgcttcacgagcttctaagatggctgctgcactggccaacttggctttttcagcgttgaccccattgcgataattggagtctttcatcatttcggcaaaaaagtcatctaaatcgtctgttactccttcggcatatttttttaaatctttcattattttccctccatatagtttttataaaactcggcgcgcaaatcaattgcatgatcaatttcttttcgtggcgttggatttgttttttgctgaatccacggaaatatgaaagctaagaaccacgccgagttagcgtatttcttagctttcatgttgcaaattactagtgtttgatttttttatctgacgtataaggttgatgaaacatcctcgaaacgccaaatggaaccagtgttagaaaaattgaccatgagattaaaccatgaggcaggttatgagtatacattggcagtaaagcgacataattgtgagtcacacaatcatagatgacaatgccaatcgtgatcactagaaagatacctgatattgataataataattttctgatatccataatagattcccccttgaaaggtcaatagaaaatacattgaaccgtttcttatcagtattttttctggagcagaataatttggaagttgtttgggtgtgatggctttgagtggaattaagtcagctttactatcggctgattgcgctttaaattagaatccattgcaatcaggccaaccagtccgactagaagaattggaacgtaagctaagaatagccaaatccaaggactgcttcctgcagaggagccaattgatagttgagtgtcaaatagggagtggagtaaggctgaccatatcaaagtgttggttgagacccggacgactacaaagaaaagccctatacaagtcgcgtaaaagatttgttgcaaagtagcttctatcgtttgaccatttaatagatttacagaatggaagaggccaaaacaaactgatgataggatgccagcaaaggttagtggccaccgggaattaacaaatattttttgaaatagtgaaaagactaatccacgaaaaacaaattcttccaatatgccgcctgagaacgccaggcagatagccgaaacagcttttggagaacgcaatacgccaaaaatttgaagaggagaaacaaaaaggaacactggtaagcagcaaatagtcagtgtcgtaattagaagtggggtgcgtctaaacttttgattgcgaaccttcagactacccagtccataatagataaaagcggcaaccaacaaaacatatgctaatcgaataatcgcatatagtgttggactaactgataatcttaatgagctgtctatcggtattatcggtataaatacagcgatggcgataattaattgtaagcgccaattccaacgagtcttaatcaattctaatcatcttctcatatgagctatccttaaattaccacttgagtttgacttatacaagataaaataatgtattaatgccggcatacatagaaatacattgattttgatgtgtcgcgttctgatgagagcatgaagaccaatatgctgaagcgcaaccattcttatttagcagctattgtgtcattaatccactgatcaagttggtcaatatcataaattcgcttaatcttcgttaatatttgtgatagtgggatggcttccaaagatttacgaagctgctcctcaaccgtatccatcacttgtgagatgacacattctttttcattgccgttgtctttgccttcaatgaaatcattgatcaaaaattgactgttgaaaatactaccattgccttcaacggaagcaaatacatcgtacaggttaattttatccagcgattgattaagagaaaagccaccattttttccagttgatgaattgatcaaatcattttgaaccaacgatttaattaatttttttaaataagaatgtgagacccctaatcgttgactaattgccaccgaatttaacgttgcgccttggggtaaacgagacaagattaagataacgtagatactttgttcgagacctgatgaaattttcacttgacaatcctcctgtgaatccttagtctttaaatcaacggtattagggataagctatgtccctaatatactttaattacaaattttcttggaaaatgtgttgctttatttagggataaaatatatctctaatgattgtaacacagcaacgtcgatgattaaagattagaagaggggtgagcaatctgtggattaagactaagtacatattaactgagttgagcgaaaaaatttgatgagttaagaaaggtcgattaaatgatatggaagaggacgttcaagtaagtaagcgtggttcactggtgttattggtggtcttatcatttggatttatcatggcagtattggacacgaccggggttgttttagctattccggaaataaaaaaattcttagttgtttcaattaatgattcggtttggattattaacgcctatacactggcgttgggcacgtttttacttttagcagggaagttggctggtaagtatggtgctaagcagatgctgattctggggatgacgttgtttgttgcggcttcattaagttgttcgtttgctggcaatattatcctgctaattagttgccgatttgttcagggacttggggtagccttgtttatgccaagttcgatgtcaattttgatgcagtcattttctgatcataatcaattggctaaaatgttgggaatttggacggctatcatttcggtagcaacgggaactggttcctttatcgggggcacacttattcagtggttgggttggcgaagtatttttctagtcaatgtgcccattggaattgtaacgattggctacatttcgttaacggttaaaggtgaccattcaacgaacaaattgaatattgatattttagataatctgttattgattttagcgattgctggagcagtgatctttttggtagaaggcaaacaattcggttatcttaatttgagaattgttccgttaattagtttggcaattatatttggttggttgctgatattgagggagaagaaaagcgcgcagccgatcattccaattacattgttgaaattaccgaggtttacggttatgaatttagttggtcttttaactaacgtttcgttatatggcattgttttggttttagggctgtattttcagatggcacttcattgttcatcaatattatcaggattattaattcttcccggaatgacagttttggttattggaaatattttctacgcgaagtatgtggcagaatttaacccagttaggttggccaatgtggcaatcattgttactttagttggatcaacagttttatatttgttgtcattatttatcaaaccactaccagtttttgcgatcattctccttttttcagtaatgagtattggaatcggtgttctagtaccggccagtacgactttattaatggcggtatcaggtacaaaatattcgggaattgctggtgcaacgttgaacgctaataaacaaattggcggcttgtttggaacagctattatgggaatggtgatttcaagtttcgggactaattggaatgggattattcaaatgacgtttttgattaatgccgggttgtatgctttaggagcttttttgatttggaagtatgtgttggttgaaaataaacaaaaataatgatttatcattgaaataggacatatgcccttttagttttggtgctatactaaaatcatcaaacggaggccaaaatcaatgaataaaactattctattatctgcaataacaacattagggttgggcattaccggcgccgtgatttcagcgcagccagcgaatgcttcaacaagatactatccagttaagacaatcaatcgaaacaacctgccatatcatgccaaaacccaagggtcagcttatatttataatctcaatcacacgcggaaattacatcaattaaaaaattttccgcaaacaacatggtatgtttccaagagtttgctaatgcgatccagttacaccggtaaaagggccgttttctatgaggtgtccgataactctggaaagataactggtattgtttggcgcggttacttaactactggggctgcttctgacagttcaacgactgataatcccactgctggaaacggttcatccggcgatcaagggacttcagcaaatgataatgggcaaaatagtggttcaactacctcgggaagctctcagtctcagactgcaacggtaactggtaatggggtcacccaagcttatttgaaattaaccggtgataccaacgatacgagtttgcagggcttaacgtcaattcggcaagcagcttacgcgcaatctaatggaaataaaacaactacgacattggccgatgatgcaacaaaaagtggcattgatccaacgggattacaggaaaaatatcttgttttgaacaatagtgatattagcgatctcgaagacgataacgctgatcaatcagtaaaaatgtcggatgaaatttgtgcagctgctcttaaaaagcaatttagtttttccggaaaggttggtatttcaacctttgtgacctactacggatacagtggtgacgtcatgagtgtcaaaatgattattttatatcgaaactaagtaggtggtattttttctaaatgaaagggttgattcaagttgatcattgagaatcgttggtcatggggacgtttgttggcagcaggggttggcctgtttttagtttataatgccgtgatgctgtatctttacgatgcttcagaatggctggttgccggtattgacgcggtaattgcccttgtctcactgggaattacgtggtggacattgaaatcgtttaagctcttttctcagcggccaaagtttagcaggtccatgaagatttggggattaattgcgttgatcacggttatgatcatgatgattcttaacggattctttcaaaatttgccattactgtttggctcgaatgatttctggttaataaccgtcatcgcgctagctactgggatatttgaagaaaccctttgccgaggtttgtttttctcgggtttcttggaccataccttatataatggcaattcctttcgtttcacgcgatcggcgatttattcggcatttttattcggggggttccatttcgtcaactttctgggtggtaatccggcagttgtatttcaacagatgttttgggcttttgtactcggtgtctttttggcggctctgcgggttgcgactaacacacttgtctgggggattctcctgcattttcttttggactgggttccgagtatttccggccccattagacaaagtggagcaagctggtgggaattaattgtggtgtttggcccaatctttattgccagtctgattttcttagtgtataccgatcagcggtatcgagaaattccagtagaaaatgtgtaatgaatcatgttgctgtatcagaaaggaaggcggcacacaatgaaagaagagccatatttaacagatgttgatcaaacattttcccatgatcttcaaaatcctgagtttgcagatggggtcagggctgaaatgaacaaactttcaagctctgttgcgatccagaaggaaagggaaagcagttcaaattagtttttcttagcaataatatttatatcattcacaaaatatatgatcgttgaagatgagatgataagcaaaaatctggactatcgcatctcaaattagaaagtaaaatctcgtaaaactagtgagttcactggctttacgggattttttgaaaagtgattgtttcttctattaaaatcaattgaaattaaaacaatttccaagtataactggaagttgctaaggctggttaagcgtctattggatcatgttattcagttggtagccagtacccatttcgaatttcatccaatagggtgactaattgtttggtttctttaacatcgtgaactcgtaaaattcggccgcctttcaagtacatttccgcttcggttaccagggtcatcggtaggcgttcgtccttcttcagacctagtagtaagccgagatatccctttcgagaaatggcggtcatgattggtcgacggaaatcattgaattgatcgagattacgcatcatgacatagtcttgggcaccgtcaggaactttggagtagccgattccttgatccaaagcaatccgttcgatatcgataccggcgctggtaatgtcagcgagattttgttcgaaaaatcggtgcatccccgtggttagatcatcatactcatggccgcggctactgtgcattgtcagcagaccaacgttattttgcgctaatagggctaatttatcagggttatcagtaaaggcattgacatcattaatgattgaaacgccttcgtcaattgcggccttcataacggggagcttataggtgtcaatcgcaaagacaacctttgggaaggcctgacggattgctttcatataaggaatcgttcgttcaatttcaacttctggcgtcacttctttaaagccggggcgggttgtttgaccgttgacctcaataatatcggcaccatcagccagcatctgttctacatgtttcaacacggcgtccatactttggtagcggccgccatcataaaatgaatccggtgtgatgttcatcacggcatagatcatggccttctcagtcaggttaaaccggtgatcaccagcctgccaaataatatcatattgtttcaagatttgacgtaattggctttgggcggctacctgattgttaaatagtttcggccatgcttggtccagacgtttcgctgcttccagcgttagcaagccggttactgtccgatcgagtacttgactggcaccatccagttgatgaatgacgtgttgcaaacggcctgcttgaccagcatcaacgtcggtaaattgcaggtttaagcggttctgcctggttgccagcgcgaataatgcccggctttcaaaatcagagtggttacctaaggcttgagtggtatcttgaattctcatgggattaattcctttctccgaagcatattgattaattgttgggcggctcgaccgcggtgggtaagtgggattcgctggctgtctggcagttcggctaaggttttccctaattttggcagccaaaaaattttatcaaaaccggtggaaaagcgccccagattgtgacgggcaatttgaccagtaaccgatccggtggcggtgatcgttgggccattcgggataacaaccgctaacgttgaccgcatggttgcgtttctgtcggttcctgaatagtcggttaaccacgctaaaagtgtttggttatcgctaccgttggctttctcatgtaactcacgtttggttgtaacgccaagatgggaagccaggatcggaatttcaatcccactgtcatcggcaattgccgcctggccggtttgccggcataaaaaccgggccttggtgatggcgttggttacgtaactggtcgttgtttctgccggaaaggttagtggcgccaagcaatcggtgtaggggattgccgtcaaaccgaagaatgccagatctttttgcaggtcagctgccttgaacagattgttggatgcaattagccagttactcattggggtcaccatcccaagccaatttgaatttattaatgaagtaaaaagaaccggtgccaatcacaagcccttggttggtgccttgcagttgtttggcctgttgggcggcattggcaatcgaatcggccaggatgattttggcagctgctgatttgggattcgcgtgaaaaatttgggctaattggtcagctgccagagcacggtcggggttatccggagatgagatgataaacgttgcgttgacatcaagtagtcggttgacgcattccgttacctgcttgtcttttagaaaacccacgacaaaggtaacggttcccaagccctttagcgataagagtgatgtcactaagccgttgatcccgttgagattatgagcgccgtcaattaagactggtggttcagcttgaataagtgtcattcgaccgggaaacgtgatggtttgtaagaccgagagaatggtcgttcgggtaattttgaatgttgcggttcggttgaatagggcaacccaggttaaaacggtttgcaagttacggatctgatattgaccagccagattaaaatgaacgttgggaagaatctcaccatttaaaattaagtcaatttgggagtggtcgagaaatggctgattaagatgaacatgatcaaagctgcttaaatataatttagcatttacctgaaggcagcgattttcgattactttaactgctaccgggtcttgatgtgcgtaacagacaacctgcgctccgggtttaataattttggcagttgtggttacgatatctttaagtgttgatccgagaatatttaaatgatccaaagcaaacttagcgaaaataacggtttcaacgtttcgggtagcattggtcgcatcaagttcgccgcccaagccggtttcgtaaaccacataatcagctcggcggtccgcaaaataaatggcggagattaaataccaggtttcaaatatcgagatgtcctgctgggtcaggctgagttgtttgagggcgtcagtaaatgtttggtaacacttgataaattcatcgtacataatcaattggccatttagccgaatcatttcgcgatcgtcatatagggtgggactggtaaataagccgacttgatacccggatcgttgcagtaaagctgccgtcagtgttgaaattgagcccttaccattggtgccggcaacgtgaatagttttgaattgtttgtcgggtgatcccaaaacatcgagaattcgccgtagcaagggtattcgggattcgtttttgccatacttcatgacatgaggaatttgagaaataatcgtgtcatattgatcttttaatgtcatccggagttccttcttacctgttgatttcttgtaaaaattcagcttttttgtcgcggtcttttttaaaaataccatcgtaatacgaagtggtcgtttgactgtttagcttcttgattccgcgcatttccacacacatatgacgagccgtaatgacaacggcaacaccttggggagctaaaatcttggtcatttctttaccgatttggctggtgatttcctcttgaacacttggtttggccgccacatattcaattaaccggggaattttacttaacccgataattttgccgttttggggaatgtaaccgacggacacggtgccgaaaaatggtaacaagtggtgttcacacattgaatagaacggcacgtgtttgacggtcacaatttcatcgtcaaccgacttatcggcatcaaagactttgccgtcatcaaaagatttcttttccagcgagctgaagatttcttcatacattcgggcaactcgggcaggggtttcttttaatcctgcacggtcgggattctcaccgacagctgttaaaatatgtcgaatactggtttcaataatttgcttgttttccggactcataatgtctctcttttctaatcaagtttcttgatatattgactgccagacaacttggcaatggcggctttgatttggggaacgcgctggtcatcaggatcgataatctctaataatggcacaaggacaaataggcggttaaacatctctttatgggggacgattaattcggtcgtttgaatgtggtcagtgttgaaaagttcgatgtccaggtccaatgtacggggtccccaatgaatggtccggacgcgcttgtatttttgctcaagttgatgcagcacgttaagcaaccggtgggcatccaaactggtggttagcttaaacaccgcgttaatgaattgatcctgttcgacgccaccaaccggatcggttatataataggaagaaactttctcaacttggatgtcggcatgatcgtttaagtctgccagggcacccttaacgattgcttttgaatcacctaaattactcccaatgccgatgtaggcagtatttggttgcgtcaaattgacacctccacttcggcattgtcgaggacgccatcgattggtaagccctttttctgaattgcgaccgtcacatgttcaagtttatcctcaaattgatcccaaacgcgtttgcaaattagcgaggcaaccgtttcaactaattttgtatctttcttggcaacgacttcgctggcgatttgataaacttggccgtagttgatcgtattattcaagtcatctttggccagcgtgtccaggctgacatcttttagattaagggtaatattgatgacaatgtcttggccgatcacccgctcttctttgtagaaaccaatatgcgagtgaaactgcatttgattgagtttaatggttagcataatgcctaatactccttataaatgatttccaaatgattattggaattaacgaaagttcttaatatgtattgtagcgcgctttggcaggttgatcgatataaattacttggttgacttgattaacgaactttttcattattatgcggctgtttgttcgtgattacctacctatctattattgattgagtttggccggtttgtcaattagaaatatgaagcaaagggttaaaggattgcctaacaagtgcaaattattctttgacaatgccattagtcttaattatcaaaacacatgcaaaagggagccggtttcaaaaaatattgatcccaactccctttgtgattaatgcgcggtattcagttattattctcgcgatgaatcaggctgataaagctaacgatgataactagccccaacgtgattgcccagttgactttaatacttgtaatcaactgaccatgaaataaattgatcacagttgagccgatagctgttccacttgcaatcgcaacgttttgaaccattctttgcagtgaaccgatgcttccctgagaatgttgattaccaacctgcataattgttgcaatattagcaggttgaaaatagccgcccccgattccgtaaatgaacagaaaaagtgtcgtgaccaaggcgggccatttctggttaatgactaacagtcccaataaagagacggcaataattaataatcctataaaactgaaacgctgattctttgtgccatcattttgagtacttgaaatccttgaaaataagaccagtccgattggggcacccaatacaagtaggccagtcagaccaacgttaagattcattgctttttcaaagataaatggcggtagaagaaaaatcattgccgaagcgaacccaaagacaattgtttggctgagataaagccaactaaccggatattgatttaaagtgtggaaatcaattagtggcgctgactgtctaagctcaagtcggtaaaatagtaggctaactaaaataccaattgtgattagtcctaagccaacagctaaattgttccggttgcttaataatgaaaaaccgcttagtaaacaaataaccattaatgcgttaattagggaaccgataatgtcgaagctgatttcatgcttcttttcagatatgtgtttaattaataattcgttacagattaatcccaaaagggcaaatggaacattaatccaaaaaattagtcgccatacgtttaaggataaaaagaatccgccgactgaaggaccaagaactggaccaagtccgatcataattcctagaatccccaacgcattcgcaatatgtttgggatcaatgagtgttgtgattaatgcagcagatgtggcttggagtgctgcagctccaattccttgtagaattctaaaaacaattaaagcatcaacgttagtagcagcaccacatagaattgaaccgattccgaagataatcaagccgactaaggatatctttaatttaccaaatcgatcactcaaataaccaaaaggtaaaataaatattgctaaactaactgtatagccgatgacagttagtgcggtgatgctggttgaagaatgaaactgtctttgcaaaaacggtagggcgacattaataattccagtatctaatgttgagaggagcattcccattcccgcaatcatgataatgagcttattttgagttttatttttcatataggccttgcctcactgagagatgcttatttttcggatatgtcagcaacttatgttgttcaattaaattttcaataggattaatcatcatttttacgtcctttcttttaactaatgttaatgataaaatatagccgaataacgttcaaacgatttaaagattttgaaatcgaaaggagataaagacagcgtgccaattacaattaatttcggaaagtatgcattacaaaataacgagacgctgacgcagagaattcaatttgtttactcgccgctaaatgagctgtttcgtagtttgcatgtcttactcaatccacggcatcatgggatgaatattgaatgggcgttagaggctaaacagcagctatcaaatgatttttttaatgatttacattattttagtttgatttatgagctgggagttccaccaattttgtttaataattttgagaggataaccacaaaccttgatgcagaggtcaagcagttaaaggaatatttaaataaaactgacgctaaagtaatcttgactagtttacagaaggtcgctgctgatcgtgagaatcaatttatcccgtcgctggctcggggattagaatggcaaggttaccagccagaggattctggaaatctgttaaccgatttaactaatcgacctgatgaagtttatcggcatttgtttactttcatcagtaagtatcgggaacgtgtttttgatcaaacttggaaagataaatctttggaatcttttttactaaatgaaattaaacaacaatcggagtacttaaggctgcatggctttgtgagtttaattgatcatctacaggttgatagaattcattggcagcaaaatcaattggttgtaacaaaacccttttccgagacgattgatttaactgatcgggatgctgtgttgttattacctagttattttatttggccacatttatttgttgatcattttcaacatggcgttgtcattaactacgatgctttaaataagctaaaagctaagattagtccagatagaatggcaaaaatctttaatgcgttgagtgattctgtccgtttaaaaattatgaagtatttatcggatcagccatatacaactcaagcactcggccaaattttgatcatgagtgattcaaccgtttcccaccatctcaaattattaaaagaagcacggttagtgacaacgattaagcagggaaaatttgtattatataaaccaaccaatatcattagtgatttaatcccgggattctataactatttggaggaaaatgagtaggaggtacatttaattggatgggaaaacgacattactttcagcattaagctgtcgacggtacttaacactgattgaattagcaaaattaactcaccaagataaaacaaaatgtcgacagaatctattagtactgagaagtcatgggacaatttcttgccgtcattttgcgggacgcgattatttcataagtcggaaaaagtctaagcggacaactttaggccaacaagcagacacatatttggaaggtcgaagcgctgcaatagaaattggcgatgcgcggacttgttatcatcacctggcaggcaaagttggcacacaactatttaaaaattgtctagataagggttggttaaccaccgatgagggtgactatataatgacaattcagggaagagaagcctttcagaaattgcttcgatggccaattaaacaaataaaggttaaaacatgtattgatttttctgaaagactgcctcatttagctggaaagcttggaactgacgtactaaaaaggttgattgctgagggtgacgttagattgggtaagtatcggcatgtgcttataaaaaagccacttgaagattggctatgatacaaccgatctctaagtggctgattgatgacggtgatttacctaaaacctattgatgaaatgctaagtcatcttttgggaatgaggctttctggaactaagccatttcgtaatcattactgcgatgagtaagccggcgactgcacacaagcccacgcctttaaatgcccagtggggatagacaattccgccaatcagtgaccccaacgttaggccgaggtacagaaaagaactgttaaaagacatgacggttgagcgatttttagggacaacattaacaatataggttgttaatgccgtgacgcctaatccttgtgctaaggcaagcagaatgaggaacgcaatcaaaaagggaatcgtgtttgccacaaaggtcatcccgaaaataaaaattaccgatagaagaccattgataatgacactgcgcatggcgcccagtttggttgtgacaatcccgccaaaaaagctggcgataaagttactaataccataagcgataaaaaccaagccggtttgggcggtattatcgtgaaaggtttgttcaatataagtgcctaagaatgtataaatagtatagaagccaaacatccagaccaggttaatgctgagcgcccaagtcgcgtgatgggtcgttagtaatgttcgaaaagaatcaaggtaacttatccgttgatttggaagggagctcatattgggaatgacgactaacaggacaaagtaggcgatcaaggttaatcctgcggagccccaaaaggccatatgccagtttgaaatttggactaattcagttcccagtgggacgccaattgcaattgataaggaaagtgccgacatggtgattcccatgatcgtatttaacaagtgtccgcgaaaatggtcaccgataattgcccagatatttggcatggtcaaagctgccccaattccggcaatggctcgatagacataaaattgaccaagcgttgtcgcaatcgcgcaaagaagactaccagccagaaagatcccaatcccaattgtcaaaatccgtttcttttcaaacctatcgccgagcggtccgaaaaacggagagccaatggcgtaacacagcgcgtagattgtaacggccagcgcagcggaacttaagttaacgttgtagtcccgctcaattgcaggaagcaacggcgaaataataaatgaatcagcgcccataataaaaacgattaaaaataaaccggttaccatcaaaacatctttagaagttatttgatctgttattaccaagctaaccaccctctctgcattaaaatataaaaccaaagggtggaaatgccaataagggaattttttgatacccattcccagacaaaaacatgtggtagaatagtcgcaaagtcgttaagctgacttttggaaggaagcgttgattggaatgaaagcgtctgaaatgagtcgccgtcatggtgagctttgtccacttgataccacgttaaaaattttagatggcaagtggaaatccattattctttgtcggttaatgaagcatgagtttcgatatactgaattattgcggacactgccgggatgtacgcggcgaatgctgtcattgcagctttcacaactggaaaatgatcgaattattgttaagcagactgataccagttacgttccggtaaaaacaagttaccgattgacgccagctgggcgatcgttagtgccgattgttttggcgatgaatagatggggagcgacgtatttaaagcgtttgattccggttgaagcgaagtgagttagaaaattacttcccaccgttaaggctcattttgttgaatcgggccggggattgtataatggttaattaacaaaaagtagttaaatttcggctttaagaaagttgataactcatccttgttttattaaaagcttgtgctaatatattgattaggatttaaattagttaattgcattatctatctgggaagtgagcttggtgagttactcaattattatctcaaagatttttaacaaattcgcaatattcaattggggcgtgacaattttatcatttatcatggcgattgttttgtatccgcaattgcctaaagaggtccctgatcatattaatgcttttggtgccgctgacagttatggtggtaagttaacggtgtttatattaccttttgcattagcgatgattggtctgctggtttctagtaaatggattgataaccgatatgcggacctgaccattcagaatacgttgacaaaaacgctgatgttggtaattatgatcctgctttggtatggggctggcatctttttcctgacgtattatcaactgaccaagtagttggcggcttcttgggactacttgacggatacgatgaccttgagtattatgaaattgtgttaaatatacaaactagaacaagaaaagggagcccccggatgggctcccttttctaatagacatctgaaaaaccttatcgatgttgggaatggtgataccaactcgaaaaaagtgtattaaaaatgctgacaacgatgcctattataatatacaaactagtttaattacctcccttaccagccggatcgatgagtcgagatggctggcttttttattttacccaaaatcaatcgaacataggattgagattttcataatttttcacaagaattctctcattttgaaattctaacgttttattccaaatttcttttttcgcctttttcacatacttgaaaggatatatttgtgacgaatggcgatttagtttcgataaacgcgaaatagaaccggaaagatcggccatcttcagtgttgcgctcaagcaaagtttgagtgattatgaaaattgcttccgaataattttgtgttgattttcacaatcctcccatttataattaacctcatgattgattgaaatttcacaagttatacaaaacatggaggcttatattatgtcaaagaaagttgctttaattactggtgccggtcaaggaattggtgaagcgatcgctaaacgtcttaccaaggatggcttttcagttgcgttagttggacggactaagagcaaagttgagaacgttgctaaagaaattaatgataacggtggggatgcttatgccatcggagccgatgttgccgatcgtgacgaagtattcgccgctgttgatgaagcaactaaacattttggtgattttaacgttatcgttaataacgcgggagttgcaccaacaacaccaattagtactgtcacacctgatgttttgaacaacactttgtccattaatttaggtggtgttatctggggcattcaagccgcttctgataagttccatgaattaaaccatggtggtaagatcatcaatgcttcttcacaagctggtcaagttggtaaccctaacttaacggtttatggtgcaagtaagtttgctatccgcggcgttactcaaacgactgctcgtgaattagccaaagataacatcacggttaacgcttattgcccaggaattgttaagacaccaatgatgaatgatattgccaagaaggttgctgacaatgccggcaagccattcgaatggggcatgaagcaattctctaaagacattgctttaggtcgactttcagaacctgaagatgttgccgcttgtgtttcctacttagctggtcctgattccgattatatgactggccaatcactattgattgatggtgggatggtatttagctaaaattttggatgacgattaataaagagtgaggcaaaaaacgctttggaagctgttttttcctcacgttttccactcgataataatcgtgacgacacaaaacgggactggacaaaagtaattttgtccagtcccattttgaatttggcaacttgttatcgtcttttttatttactgaataaaaggatagccgtgtgagaggaacaatcccaagacaccaaccaagatgacaaagcagagcagccaccaaacaactgattttgagacggccttctgattgtatttggcaaagccgatttcaatggcagcgattaagccaagggcaaccaagactttgatgaccgttagaatcggattgtcaccccaggcatatggcagtaggaaaactccactaacaatggcaaacaggtaaacaacccgggcgatcatttgataaatttttgcttggcttgtcggggcgacaaatgctaagataacggcgattgctaagacaacccaagaaatgatgtgaatccataaccaaatcatttttaatttccccctatgaattagaatcgatctctttcatcatagctttctgaaaggggcattgcaattttgaagatatggtgtgtcattctgagtggattacattgtaatcaccgagcgcccggatgcttcccaagcttttgcaacttggtctaacgggaacacttgtagattgatatataggtgatcgtcagcggcatagtcaaaaatgcccggaagttgagtcttcaggtaagttggaaaaacatccggcgcgaaactgccaatgcctgagccgatgagttcaacatctttactcctgagaacttgggacggcaatgttatatcactaccggccatgccgcccaccgaaatatatttaagatgtttttgaagcttaatctttctgagtgccttaaaaatgagttcagcgggatgtccccaaaggtaatcgacaaccagattgaacggggcttcatcgtaagctgcgataatttgtttcacaatttgatcatcggtaccattaatttgaattgtgatgtcggcacctacagttttcaatttatcaagggattgggcatttcttccggttgcgataactttagcggcaccatggaatttagcaagctgaacggccatcatgccagtggctccggtagcaccgttgacaaggacaatatcgccttgtttgatatgaccccgttcaataagcgccacgtcggagcccatcagagcgttgggtaatgccgctgctcgaacattatctaagccggctggcagtttaaccatttttcgactatcaatcagagctttttcggccatcattccggtaatccccattgcgtaaacccgggttccgtcatcaagctcggccacgccgtccatgcccattacggcaggtagtggatcaaaattcgtatagtgcttaccagccgctttactaatgtctaactgtttaattgatgaagctttcggcgaaaccaataattgattgtcattggtcactttaggatctggaaaatcctggtattctggaactttaccgtaagcgtttaggactgctgctttcatgatctgagcacctcgtttaattttattttgaccaaccgtatcacgtttgaacgttaggctcaatgaaagggcacttttattgttgaaaagatagtgcgtaaaaataaaatcagcgcggccattttgatgccgacactggttaggtattttaatattgatagagcggtggcggggggacaagtagaatattcagcatctttttcaccggcatatattcctacgtaagttggctatgtggtttaaaaattgatatggaagacaaaaaaagttagataaatggcagctaggagggttatgagaagaacaaatatcgatcctttttgccaaatacttagttttaattgatgctgtttgaccgattttatccataaagtgatagcagcaattagcaaagcaaagattggaattccaattaacataagtgtattcagctccgtcgtattataaattcttgtggccgatctaaacggctgctgtggcatatcttgttgctttaatgattcaattagatcgctttcttagatagatttattctatctattcttattttgatagttaacttctttaaaaagatagattcctaagtatagtaaagcaaataaaagtaatatcatcagaactaagtggtcataattagctcgatacatatagatactaacaatcgctaataaaacaattgtagcgatcattttaagtcttgttctataccatttttcgttattagttcgatgattaaaattgtcccagtatttttcaaggctttcaagtccagcaagattaattatcgatagcccaagaatgatttcaatcaggttactcccatttactaagttaaaaaaggaagtaaagaccaatgctaaactagtaacccaacaaagtaaaaagattaatgttgcaagggtaatatgatttttggatgcggtattctgtttcacattaaaactcctaacttttttgacctagtgtaagtcagatactttcttacatgtaatacaaagcataacaaatgtagaacacccttttaaagtgtaattggttaatattttactaactaagttggaatatacaacgaagattttatgaattctatataaaagtaatatgacctatttgtgaactcagaaaccgatctaacatatttggatcggtgcggcaattcaattttaaattcgactctacataaaagtgaaggtgagaggttatggttgtcatcccattagtgaatagagtaaaaaacactgttgaaccctgatttgccaaggttaacagtgttagactactttgtgaaaataatgtagcaaactaaaaaattgaatatttcttgttattcttcatccatttgcgcgttcttttgaatttctggtgatagatcatacatcttagcagcttcggttaacagggcatgatacacgtatgaaccttctttataaggctcaatgaccacttgatcggcaattttggaaaatggctttttgccatctttttcctgaattgaatttagatcttcaataattttcttctcaacatttgactcattacctacgatttgtttcgtttgcaaactgccacgaatagaaattttgttcataataaattcctcacaatctatcggttttatttgacgaagaaatattaccgcgtgattcttcctgggtaatatacctacctatatcataccaattatttgtctcccatttcaccaaattttgacaataatgtcaaatttattttgggaaggggtggtattacctcaaaatcgtatttaacggatataatggtcaatctttttgtctgaagcgtttgttaatacaacagttaatagttttgcaaacgactcatggctattagataatatggttattgaagggagatttaataatgaataaggaaatggtcgatataaaaaaacaaataaaattcttgatgttactaattccaagcctgatcattggttttatcctgaatcagtccagcacaacccaggcagcgactgaccgttttgccgattcgtattatttaaatgatagcgacacttggactcactacttttctttgttattatctttagtatcagtaaaattaatgtcactaaggggcacattattccagtcaacgttggaaacttggtgaggcgtgatgtgattgctgatttagtttaacgataaagggatacaccgtatcctgaagattaattgaggagatattattatgagaaggttaagtagttttattggactattcgtcatgggattatctatcatgacagtcacgacgctgaataaatcggcatcggctaacagtccaaaacgagtcagcagtagctatatggaaaagcttagtaagaagatgcaatactatcgactaaataaaaatatccgaccagcatcttccaacctcagcaaaaaaacagctgtgcccaaaggaacgattcttaatttagactatgtgatcgacagcggcagtcatcaaaaagaaggcaaagcccttatcagtgacctggttgagatgagctacgtctttaaaaaaaagctggggttcaagcctgcttatcgttcatcttatttattattctcatattatccacatttgtttacacgggtaaagcggccggcttacgtgttgccgtatagtgataatgtcctttatttcggtggcctgtcagcccttaaaagggaagctgatagtaattttgcccaccctaaatctaccagtaaggctttgagaattacttcggacggctatctggaactttacgtacgtggtcgtaagccgctgagtgatcccatatttaattggcaatatgctcaaaaaccgacagcttacgttaagattgcccatgcaactaacaaaggttctaaaaaatacttatattatcaaaagaaattgccggaggtccgggcgactcgtctttatcacggcaagtatcgttaccgattgaggattaataatctgcacacgccttatcgctataccagtgatcagggtgctaacacttatgcaagcttttattcggttggtggatcgcgatacttcacagttccttggggagatggcggtgacggtgactaataatcaaggtttaaaagagaagctgaaaaaacagcttctaactggatcttatacgttgtgatttattttgttgagagaaaacggcattcataattttagggtcgggggattttccctcggctcttttgagtattatgttcattaatagtgaagtatattgcgaatgatgatttctaattaggaatgattgcgtttacaaatagaatgtgatcgttatttaaaatgtggttattaataacttaccgtatctcaaaaattggtttcttttcgaaaaaaggatgaattttttatgaacttataagttaaccctgcggtatatcagctatggccgacttttcgatgtttattgacgataataatggtcaaggggatactataattaatgatcggtcaaccgacgttaattaaaggagaaaatccaatgtctaaaggactaataaaatttgtggtaacaattggaacgatgctgattgtgtttgcaatatttaatgggctaacgaatgggctgactaattggccagttggcgaaatactggtttttgttgcgtttggattcagttatgccgtcgttgcttgggttaaaggggattaatatggaaacaatcactcgtgtcagcaaccttagaaaggcggatggcttatggaaaaattagcattaaagaaaacaaccaagccaaaaaaattagcgatcttgttgattgaattcattattattgaaaaaatcattgaaaacggcatgttagttccggtattgataaaatcaccactttccgaaatcaccagtaacattgtctacaagggaattgaaattgtgctggtgcttggtcttaactattttctgacgcgacaagtgatccaccttaaatttaaaataacgattaaacaggtggtcttttttatcctgtcgttgggatatctgaccattatcattaagagtggctcgcctaagtatttttttgaaacgtttgtctgggtagcgttaaccgctatttctgaagaattactttttcgtggcgttattttaggaagtttaattgacttaatgataaagtggacgacttccagccggttgaaaatttggggaacagttatcctggctagtttggtttttagtttggaacatttgactaatttgatgaaccaaacgttaccggttactatttgccagctgattcaaacgttggggatgggcgttcttcttgcagcggtttacatccggaccggttcactcgtagatgcgatttatttgcatttcttgattgattttcccgccctttacattagccagtttacgactttacaatctggggcagcttcacaggtatcaccaaagctgtcggttatcgggtcaattgttattgccgtcatttacatattaattgcgattgctctcacgaaatcgtttagccaacagaaccgactcattagcttaaagcgtcagatcttgaatcataaataggatcataattgcgtctattgtcccgttgcagtgacgtgctacaattaaatcaaaatatattgactgaggcgattggatgacaaccattggattctgctcgacatcgacaccgattacggctatttcaccgaagcggtttgcacgggcaaaagcatttttggaaggtaagggagttaaattaattgggggttctttaaccggcaagcaagatcactatcgttccgggagtattcttgaccgggcggccgaagtgaaccagctgattcacaacgatgaggttgggattattatggcaaccattggcgggacaaatacgaattcaattttgccttacttggactatgattatctcaatcagtatccgaaaacagttgtgggttattccgacgcaacggccttgttgctggcggttcaaacccaggctccgaattgccgaaccttgtatggaccagccctggtggcttcgtttggcgaatggccaccgtttgtgaatgaaacctggactgcgtttgaaaaaattattaacacgcggcatgggcattcggtgacgattaaggcgccaacatattgggatgatgaagcgattaactggaatgactttgagcgtcctaagcagcaacgccctaaccaatggcattcaattggcacctcgaaattaaccggtcgaattatgggcggtaacctcaatacgatctatggtattttagggtctaactatttcccgaaattatcgccgaatgacctgctgtttattgaagatgccgaaaaggatgcttcgactgttgagaagaattttgcgatgatgcgggatgccggtgcatttgatcaggtttccggaattattctcggcaaacacgctttgtttgacgattcgggaaccaatcgcaaaccaattgacatcttattagaggtgctgaatggtcagcagattcccattatttacgattatgattcatgccacacggtgccgatgatcaccacgccattaggtgctcagacaacgattaatgcagatgatgggacaataactttttcacggttttaacacgataaataaaaaccaggtgattattttgcagcaaaaccaattatttcaaaattttgaaacggtaggcggaacgatgagctattactatcggccgcccaaaaacaatcacgcgacgatactctttttccaagcatttggtggtgattcggattactacaattttaaaacggtaattgacaacttatcacaggacgatgggattttaacgtttgattaccttggctatggattgagtgatctaactgataaaccgcaaaccttatccaacacagttaacgaatttcggcagctatttgacagtttgaaattaggcccgacggttatctttgcccatagtatcggtggggttttcggcctttatgattatctgaatttttcaaatcacgttgttgcttttatctcaattgaacccacaacctacgaagtcgttcatgctcatcccaagggagccgaatcgtttgccaaagcggctgatgcgttcaatcaactcacacccgatcaaaaagccgctcggcaaaaagatttagccattcagggagacatcaacccgttattgagtgctgaagacgcagccgccaatacgaaaatcctggctggaaaaatgtataatcggaacttggtcgcgcaaacgcaaaattggaatgcgatgttaaagccggttgccaatcaaaagttgccgaatcacttaccaactctgcttttttcaaccaccaagcggcaggccgagttcaagcagtcgggatatttaacccaacatcccaagtcacggttgattgccttggaggggaatcattacttacactggaagtatcctaaactgattgctaaaacgactgatcaattcattgatagtcttggataatgtaaaaaagagtgaggattgctaattaagagaaggccagagagaagtttgggcaatattaaagttgccaagattttctttgaccttttttggaattgataagctgagaaaatggtaaagttaacttattttacattttttacatcagatttgtgaaactgtcatgaaaaagtatcaatcgatatcatacctaccagattaacaaagaaaccgattaccattatttcatgtgatagaaagtgggacaaggatccttgcatattgaatgaaaatcagtaaactattccgaagtgactaattttaggaggatatgctgtgtttcaatcaattattttaaagaaaagtaaacagggatttgtcggttttgtgaatatgttggcggatatttttgtgccgattattccggccattgttgcggctgggttattaatggcgcttcataacgtgttaacggcgccacatttatttatggcctcgtccttggttgctgcctatccgaacatgaaaggatttgcggctttcattaatgtgttagccaacgcaccgtttgcatttttaccggtgctaatcggtttttcggcaaccaagcgatttggcggcaacccatttttgggagcagcgatggggatgatgatggtttcacccgccttggtcagtggctatgatgtcagtacagccctggcaagccatcaattggcttattggcatattttagggatgccggttgcccaagccggctatcaaggttccgtcatcccaatgctggcggttgcctggttactttcaaagattgaaaaatggtgtcatcggcgaattcctgaagcacttgattatacctttaccccgttaattacgattctggtaacgggactactgacatttgtgattgttggtcccgtgatgcgggatgtcagtgatgggttaacaaacggcctcctatggctttatcagacgtcaggcgcggtaggtaccggtgtgttgggcttgttatacgcgccattggtcattaccggcctgcaccaaagctttccagctatcgaaacgcaattaattgccaacgtgaaacaaaccggtggcagctttatctttccgattgcttcggtgtccaacatcgctcagggtgctgcagcgttggctgtctttttcctgactaaggataaaaagcaacgcggattggcttcttctgccagtatgtcagcgctgttaggggtaacagagccagcaatgtttggtattaatttgaagttgaagttcccgtttgtggcttccatgcttggttcgggcgcggcaggcatttaccttggcctaacccacgtattggccgtttcactaggatccaacagtgtattgggctttattagcattgcgacgcagtccattccggcttttctaatcagttgtgtgattagttttgcggttagcttctcagccacttatgtttatggtcggcgtcaagaagtaactgaagttctgcggacggctgatgaacagccaaaagaagctgtggctgccaactagttttatttaaaaaacgatcatttgaaatcaaaattttgatactgaaaaggccccgcaaagtcatagccaacgatgattttgtggggccttttgtataggtaattttaaatggatttaagctgaatcgtagtgtattgactggttagccaaattttaccttatgcgccataagagccacttcgagtgtaataggttgtactaccgatcttatactgactcatcataacggcaccttggtcaccgtcaaacaatgaaaatggttggtgaaggttagtcactgttaggcgatattggtagcgcccggatttggcaacccgctgatcatgcacaccggagatatggtgtgaatagtacaaataacgggtattgcccttaacaattgttttgtttattttggcgaatgattgtggaatcaaactaaataattgattgttcttcgtttgtccagaaataattgggtagaattcgacgttaccatccggtgttatttttaactgatcagttgtcggagtaaacggatcaattttgggggtatatggatatttgttgaggattccccgcgaataggttggcaggtattttggcggtgtaattcgtttaaaccggcgattaagtgattgcttagatttagccgtcacactaatagcaaagtttggttctgcaaattgtttggtaattttgggtttcaataggtgataacttaatgaatcaaaatcaagattaaagctatatcgaacaagtcctttctctgagtcattaaatttgttcccggagacaatggtatttttagggatttgtaagactttaggatgggcaagctttgtgttttgtcgatcaccaaacttgattgtcacgttaacgggtttcaaagtgcgataaaacttgatatgataccaaatactgccgtaatgttttttgatacttgccagttgctttttagaaacgggctggacggtaaccgcatcaggatcgtcgtttaaagaagcctgcacgtggactgaggcggcgagccccaataagactgcggcaaagattaatagattgcgaagtttcttcatctgatttccttctttctcacattagtatcccttgaaccaagtattttgtcaaaatttaggtggtaatgggattgtggttgtttgatttggatgcgggccatcgtttgttcaaaagcggcctgctgattgtgacctaaaagtaggaataaagaaactacaatagcgattacactgatgagtagtaaaaacgtaatcaaaaagggagttggtccctgcgagaatggactgctgccgtttggaaaaccaactagatctgccaaactatgcaggatgatgctgatccagattgtcccggtgtataaacaaatcgtgctgtaaataaaaccgattccaatggcacttaaaatttgaagtagggtagctgggacactctgatagaacatattttgcgcgtgccacaggccaaacagaagagagctgaccaccacgccaaagatcatttgggccttttgtgatcgctggttaacgtgtagtaattgccaaaacagagcataacgaaagatgatttcttcgtaacagcaaatcgaaagaaccgttacaatcagatacgtgatcgggccgcttaccggtttcaacgtaaagtggtggaacaaatttgaccagctcccagcagtcgtacacaaataggctaatgccgggagaatggcaaccaataaccaaccatagttgacttttgaattgattttaattttggggagaccaaatccccaacagtgcatgacatagaataatgcggtaaatgtaacggtgtaaaaaatgatgatcattgggaaactgttgtcaacgttgaaaccgattaagcgcaactgatttacggatgttggaaagctatatagataaataaaggaaaagaacattctggtaattgggccagtctcattaattaacaaacctttgaaatatggtgggatgctgaccagaaatcctaatagaattaagtaggcaggaatggtggctgaaagatgtaatttatcaatcaaggatagtgaaagtagggaaaagccaaaaattagactggtgggataggcgaaaatcaaaatggctttgataatccctttaattgcgcttttgagaagtgaacgatgctgcgaggcgacttccaaatgtggagttagtaatcccaaaagcgttacgataatcgtaattaggattgatggtagaccagccttggcgatggcggcatctggattggttagtgaaatgatacaggtaacggctaaaataatggcacactgaattctgaaaatcagtaattgtgatttatctttaataaacatgagttgatctcccctttagtctggtttaaaaaccgagtttagttatgaattggataacgtctctaaagtaaccggtggcaattggtcgttcaagcaatgaatcatagcatgtgaccattaggccagtggaatgggcttaaccggggagtttgtttttgaaagtcatgaaaaaacaatcgataacctggaaagtttccggttaccgattgtttattacgtggttatcttaaataattaaattcgaatacgggccattgtttgcttaaaagctgcttggcgtttctttcccaaaagtagaattagagaaacaccaatttcaaggagggcagccagtagcatatattcaatttcgaaagcactcggggtttgggaaaaagcactggtaacctcaggggcaccggccagatcggttaaactgtgaagaatgatggcaatccaaattgtgccggtatacaggctgatggtggctaggataaagccggttccaatggcactgaccatttgaagcagggtggccggtaaactttggtcgaaaatgttttgtgcgtgccacagaccgaatagtaatgaactgattagaattgcccaaaattgttgggttctgggcgatgtatgtttgaagtgtaacagctgccagaagaacgagtaacgaaagatgatctcttcatagcagcaaaccgtgacaatagtcataataaagtaggcgagcggaccgctgacaagctgccaatcaaagtgataaaagacattatgccagcttccggccgaactgtttaattccagtaacacaagggcaacgatgaggcttaaccacccataattaacggtcgaattaattttaagtctgggtagactaaatccccaacgatgcatgacatagccggtagtaataaagagaaatagataactcaaaattgtgagtagagatgtgctattgaaagttatccaaatgccaaatgaataagaggtattgaaccctaatatgccaagctgattgaggatgtatggtgaaaaaaataaataagcaaaaataaagatcattctcgtaactgcgccagtctcgtttatcagaaatagttttagatatgggatcaaaccaccagcgcccagtaagaatgcgagatagatgattggcatttttgagatgtgagcttgcgttaccagtggtagaaataacaagcaaatgccaaagaataacacaaatggatacagcgtggttatgaccagccgaatcgtattcttgatggccttttgaagtagtggtaattgcactgctggctgaccaacgttgggtgtcaggatgccgattaaaggaaccaacgtgattatcatgacacttgtcagactaccaaattgatctaacgtgttttgaaaattaactaacaatgagccaccaaagatgattacaattagtgcgcattgaagcttgaagataagtgacaacgagtgatcgttgtttgctgccgagatttccatgattaatttagcctctccattattattttagtgttctaaaaatagtaagaatcatagaaatgaatcggtgcttttggctatctactaaaatcattgcgtaaatagagaataccctgaacgactaaaataaccccagccataacgcaaacggtttggacgccgaaactcatatcccataatttgagaattgcgctcataaatgacagcaccccaaggataatgtgagttgataccaaaatcggctttttccacttgctcggtttaagacgcaatagcagatgaataccgatcataataaagattagactggtcatccaatgcaacgcttcaaaagttgttatgaccaatagacgtccggcaatcaaaatgcctaacgtcagccaaaataaaaaaatggctgagttttgcctgctcttcggaagtgggctaagctttttagcaccaagtacctgcagtaaattatccgttgagacgccatagaggagagcaagctgtttaagggtaatgatgtcaggggtattccggccggtctcccagcttgaaatggtttgccgagagacatgcattttttccgccacatcactttgagtgagccctaaagcttggcggtggatttttaattgttcgccaaagttggttggattcatttctgattcactccttaaagttaatggctaattatttttcgatcaagctatgtatactggcatattgtgaaatatgtgatgccagtaaggtttgatattagtaatcaccttctaatataccatttcttttatcattctggataataaaaccagtaaccatgtttgcggttaccgattacttttaaataaagttacttataattttttcaaatagatttgcaccaacgatctgaaattggttacaatattcccaatacataatctagaaagtgtgcattatccaatgaacaagaaaatcatgtccggttcgttctggctgtcctttggtagtattttctcccggatgttgggagttttatacctgattccatggttgtatatgattggcgttgatcatcaaagtggcgctcaagcccttaacaactcctcatatcagccatatgcgttattcatttcattggcaacagccggttttccgtccgccgtggcgcgacgaattgcgatgtataatggtcaaaataaatttttaaatgcgaagcgattcaccaaattgggcttctgggtcatgctggcttccggggtcgttagtggaattgtcctctacttaattgcgccgattatcgccaagaacagcccagttgtttcagttaaagctgccacgacctcaattcgggtactagtaccggcaattgtaattattccttcaatgagtatcactcgtggttggtttcaaggtaatcaggatcttaaaccatacggggtgtcacaactttgggaacagtttatccgtgtgatttttattttggtttctacctatattattatcaacgtttttcataaaagctttgtgattgctgtttattatagtgtatttggtgcggttgtcggtgccattgccagctacatttatcttgggctgtattataaaaaacaatcttcccagtatgcagcaatggccgctaaaagcttaccggatgacttatccggagttaagaaaactttgttgacgattgtgtatgaatcgattccgtttgttatcgttggctccggaattacgattacccaactgattgaccaattattctttaaacaggtcatgcaaaatatgctgcataagtcggctgaattcactcagtacatttatacattattctccgctaatccaactaaagtaactacagttgttgtttcactggctatctcagtagctgaaacgactttgccattgttggcacagagtaaaagtgcgcacaagaataatatcggtgaactggttgttcaaaatctgaatctgctgttgtttgcgttactaccagcaattacaattttgagcgctttatcgtatgaaattaatggggtgatctttaactttgatttactcggtggcgattatttattctggaatatcatccaaagtttagctttagggatggcaattaatgggttaaccctgttacaggcgttacattacagtaaaaaggcaatgtattacctcatttcagggatcctaatcaagcttgttttgcaagtaccgcttgtttattggcttcaagggtttggcgcaatcttagcaaccacggtggcatttggtttggtcagttttttaagtatttggcaaatctgcagggattttcacgtcaagcttcgcaatcttggtttaaccctcggtctcaatattgtgttctttgcggttatggtgttggcctcaacgggattaaatcggatttatctgccgacctctaaaattgaagctttgattgccgggatgatcttcggcttaatcgggctggtactttatttattctttgtcaacgagaccgggctatctcaacgggtctttaacaaaaaaattggctataagtattttagatataaacattttgagtgattaggtgattgttagttggatggctgattgtcgtcgcccttttgccggctcggttgcaaataacagccggtggtgtaggaaaaagccgtaaaatgcaatcaagtatagacaaatagaaacgagtaaaattttcgatccgttttcgaaagttttactcgtttcttctatataatatataaatgctgtattccgataaatatttagtgactggattgtccggcaacaaatctcttttcaaggttttccaaatctgacagggtgcccatcgtgcattcatttgactgggcattgactttaagatgtttcatcaatcttggaagatcatgtggcacttcaaagtaaagctttgatgatgacgtatatattgtcgcaattccatttaggtcttcgatatagtacacgtctttatcctgtttcttggcaacttgattataatcgataaaggccatctgaagttggagcattaaatctcgtaggtccattttatgattcctccttctatgtccatgataaggctaaatgaaaataatagtttaagataatcaaaattgtttcgattatttttaattttttaaaatcagcggatctatttataattttaaaaatccttttcaacaattatcactatcgattagaacttttgaggagcttagaaagtaattgtgggcgtttgtttgcttttctgacactagttatttttatcggtgactaccattgttaaaacataggccaagataaccgctactatcagcagtaacagactaatcagaaatgatccgcctgatttggcgtaaaatgcattcgaagggaaacttgctaagtaaatcataaaacaacaattaatgatgaattggaaccaccgtaatatctttctgatcattaagcactatcatcctttcgtatccgtaagtgtatttcctaaataagttgtctgtgattttcttatgatagcatatgaaaaatattctcgctgcgataacaaatttgtagacactaccattaaattgagagtggagcgaaaggcggttaacttccactcggtaataatcgtgatgacacaaaacgggactggacaaaattacttttgttccagccccatttggacaattatatttgatttaaaatcattaagctttaacttcacttcgatcgactgctgtccgcattgatttggtgaatgcagcgatttttgcaggtgcttgttgtttttccttggcgacaatgtcaacgatagcactgccgacgatcacaccatccgcaatcgtggccatttcttgagcttgctcaggcgtgtgaacgccaaaaccaattgcagttggcacatctgtgtattttttaatctcggccaccaggtcctttaacccatcaaagaaagcatcccgttcgccggtaattcccatggatgaaaccacatagataaagccagtggccgccttggcaattttttcaattcggtgacctgacgttggggtaattaacgggataatatcaatgccgtattgattggctgctggcatgatttcggccttactttcatatggcaaatccggaatcaccaacccagaaatatttaatgattggcatttctggcagaaagccttgtagccatatttgaagacgatatttaagtaggttagaaaaacaattggcacatcagtttgtttgcgggcttgctcaacgatttgaaagaccgttttggtagagactcccgctgcaaatgcccgtaaatcaccagcttgaatcaccggaccgtcggcaaccgggtcagagaaaggaatgccaacttcaacaatgtcggcaccgttgttggctaaagcaacgatgttggcaaccgtcgtatcaaaatccgggtcgtcggcaacaacaaatggaataaatgccttatggttttcaaaaatctttgtcaaattactcatcaatatcgactcctttgtatttagcgatgctggctacgtctttgtcgccgcggccggaaagggtgcagacaatgatttgatcctttgacatcgttggggcaattttttgaacgtaggcaaccgcgtgacaactttcaattgcggcaacaatcccttcttgtcgtgcaatgtattcaaatgcttcaaccgcttcatcatcggtaatcccgacgtattgggcccggtgcatttcagccaatgcggcatgttccgggccaacccctgggtaatccaggccggcggagattgaataaaccgggttgatctggccgtcgtcgttttgtaggaatagtgacttcataccatggaaaataccagtagtgccacgttcaatcgttgcggccgtccgatcagtgtcaacacccttacctgcagcttccacaccgaccagtttgacacttgggtcatcgatatagttggcgaaactgccaattgcgttactgcccccgcccacacaggcaacgaccatatcggggagtgtgttttctttagcagcaagttgttccttggattctttactgatgacactttggaagtatttgaccattgctgggaatggatagggtccaactgccgatcccatcacatagaaggtatcttcacttcggctggcccactcctgtaaagttgcgttaacggcgtcttttagaaccattgacccggtagttaccgggtgaaccttggcaccaagaagttccattcggtaaacatttaatttttggcgatcggtatcttccttgcccatgaaaatttcacattgcatgccaagtaatgcggcaatcgttgcagttgcaacaccgtgttggccggcaccggtttcggcgattaaccgctttttacccattcgtttagccattagagcctggccaatgacgttgttaattttgtgagcacccgtgtgatttaaatcttcacgtttaaggtaaatctttgcgccaccaagatcttcggtcatatttttggcatagtagaggagtgatggtcggttggcatagttgacgagtaaatcgtgaagttctgcttgataggtttcatcggttttaatttcattaaacgttttttcaactttttctaattcagtcattaaagtttcgggaatatattggccaccgaagtctttaccgtaacgaccggttcgctttgtttggttagatggttcgtttaaagttttcatatgataattgcctctttcgcgttttttataaattcagtgatctttttaggatccttagcggcatttgtttcaaccccgctggatacatcaacgacgtcaggtcttacgagttgaactgcctgattaacatttttgggagttaatccgccagctaaaatcagcggtctggtaattgaaggaattgcctgccaatttaagatttggccgctgcctttgccgctatcgaccattaagtagtctgctggtgagtcaagatcaattgattgccgttcaaaaacctgaataacttttaatccggcttgttgcaactgcttgatttcatcgggagtacttttgccgtgtagttgggcgatgccgattgcgccagcttgataaatggctaggatgtcatcgatggattcgtcaacaaacacaccgacggtttgaatatttggtgcaagttgttttcgaagcgccaacgcggtttttaaagctatctgatgacggcttggtgcgaagacaaatccagcgaaatcagcttctgccacgttaacggctaaaatatcttcggttctcataagaccacagattttaacttttggcatgattaagcctccttgaatgctttgattaaggttcgtttatggtgagaccgcatgagagtttcacccattagaattccgttgaagccggccttggcgagtttggcaacgtcggcctgggttttaatcccactttcggcaatcaccggaattcccgcgggaaccattgctcttagctttaggctgttattgaaatcaacttgaaagtcttttaagtttcgattattaataccaataatttttgcgttggatttcaatgcccgggtaacttcgtccgcagtgtaggcttcaacaatggcggccatgcccagactttcggcgagctcgcggtagtcacgaagttgctggtcattcagaatagcaacgatcaagagaataattgaagcaccgttggctttggcctcgtaaatcatataagggtcaatggtgaagtctttgcgtagcgttggtgcggagacgtttttgctaatatcgttcaggtaggccagtttaccgttaaaatagtctggctcagtcagaacggaaatggcatctgcaccagcagcatcgtagtccttggcaatttgtaagtacggaaaatcactcacaatagtccctttagatggtgaagcctttttgacctccgatacgacgtgaagtccgggacgtttcaagattgtcagaaaatccggtttagttcgttgaggcatcttggcgacccgttgctttaaagcagttaatgattctcgggcttgatgcttagctaatcgaactttggtaacctgaaccaagtcgtccagaatcatgcaaccacgtccttacgcttattggagtaggcaattaatcgatcgagttcaccttgggccttgccactgtcaattgtcttggcagccaaggcaatgccttcctgaatggttaattctggctgggcaagatgcagggcggcaccggcgtttagcaagacgatatcgcgtttgggccccttcttaccagccaaaatatcgcgggtgatttgaccgttttcttctggtgtgccgccaactaaatcttcccgttggctgcgggtaaatccaaattgttctggggtcaaggtatagttggttaaccggccatctttgagttccacaacggcggtctcatcagccgtggtcatttcatcgagaccatcacggccgtggataaccatggcattcttaacgcctagtttctttaaaacatttgccagtggttcaagcaggtcttcatcatagacgccgagtaattggcgagttgggtgggccggatttgctaacgggccaagaatattaaagatggttcgaaagccaagttgttttctaactggtgcaacgtacttcattgacttgtgatattcctgggcaaataggaaagccagattgttttcttttaaactttcgtagctggtggctggatcttcgttaatatccaggccaagtgcttcaagcacgtcggcagcaccactcttggatgaagccgcccggttaccatgcttggcaactttggtcccggttgcggcaacgacgatggcactggttgttgaaatattaaatgagttggagtggtcaccaccagttccaacaatttccaagacgtccttagtttctggaaattttaatgcgtggcttctcatagaagcagcggcaccggcaatttcatcaattgttggattctttgcagttagggcagttaagaggctggcggtttcaacttcggaagcttggccattcatgatttcatctaagacagcttgactttcctcaaaggttaggttttcgtggttgacaactttttcaatggcttgtttaatcataataaattcctccaaattggttttagtttttagtcgattcaagttcggtaaattaaaattattatgaattttgccatcgtttaatttcactagtagatttcatttgagtgacccccgttactgttcgttttcatgtaaagaaaaaatccgtccataacaaagttgattgttaaggacggatttttccgcggtgccaccttagttcggttaattgggttttggggtggatcaagtttgattcaccaaattaagttacccaatcaatcacgcttagcaagggactaacatccccccgacaactgacgtatgcctgcacgtttttccgtactcgaaatctttcgggaaaacaaccctcagtggtccatttaatcacctgcgttcggctgcactctcagcgacggcaactctctttgcgggcacgatgatcttgatctccacttcaacggttttatggacgaattaattgttgctttgtatattagagacttatcatctaaatgtcaatagtttttaattatttttctgaaattggtttaaaatagaggtagaaagcggggatgcaatatggataaattgattcacgaatacatcgaagcacagccgaaatcacggcagctgcaactgattcaactttacaaaaccatagctgaacagatgccggcaggatatgatgaacgaatttcgtatgggatgccaacatttcattttcacagaaacatcattcattttggcaattttaaggatcattttggactttatccgggaccggtgacgattcaatatttttctggtgaattaaaaaattataaaacgagtaagggagccatttggctgtcggttgataaaccattgccggctgcgttgatccgccaacttgttcaatataatttgaagaaaatctagcatttcggaaaggggtgtggtatgactgatgttgaaggaatgattagtgttttgaggtccgaatgaaaacggttcaaattagcataattttgaggaaatttggaagcgattgatgtgcaaaatcaacttagaaatccacagaatccattaaagaaacaggttcaagagcaattacataagaagcaaattgatgaagttaaattagtgggtgattttgcgacaatcgctaatttggcaatgtacatctcgtatcttggtgagatcattgcaaatttaaatggtcaaccaacatcaccaatccaacctttgtttgcggcactaaacgcgacgttgtgggtcggctatggttggttaatgccaaagaaggattggcgattaatcattgcaagtttcccaggcgtcatctttggggtaatggcggcggtaacggctatgatgtgagagagtgcgaaaagaaacgattagatcccagaatataagcactgcaaccggtacttcctgaatctggaagtaccggttgcagtgcttatatggccgggatctgtttctctttcgcacgttttagcacagtagccagttaagttcctgaatttggaagtaccggttgcagtgcttatatggccgggatctgtttctctttcgcacgttttagcatggcagcaagtaacactttgcaatttaaaatatggccggggcctgcttgttattgcacgttttggcacggtagccagtataccggatgcagtattgatttggtcgaggtccgcttgtcataaatgccttcatcagtcttaaggattatttctccgactttaaggtataattaaaccattaaacataaatggggattgaatgctattgagagcaaaaattgctgacattgcgagaattgccggactgtcttccgcttctgtttcgcgcattttaaatggtcatgggcgatacagtaaagagacagctaaacgagttaaaaaaattgccgacgagattggttactataagaaccgatcagcggctgatcttgccagtccgtctaacaatacgattggggttattaattatccggccgaaacaggtgcaaatgatcaggtaattcgtggcattatggaagaagccaatcacaatggtttagatgtgattatcatgatgtcggagcgcgacgatcaggaaagtattggtcgaaccgtccaaaatatgattgagcgtcgggtgtttggggttctctttttatcagttcgtcctgatcaggaaattatcgataaactcaaacaagcaaatatttatccgcaagaagttgccagtgccagtgatcatcaaatctcatatgtgtcatcaaatgattttcaaatcggttatcaagcaactaaattcttaattaatcaggggtatcacgaaattgggtttgttggtgccgatattagtgaagattttattggtgtgaatcgttatcaaggttatcaaaaggccttggcggaatctcgaatcaagccggatgatcgatggatatttgagggtgacggaaagtatagttatgagtcaggaattcaagcggttcagtattttgagcaaggaccaattcgcatatcggcggttttggcaaccagtgatgatgcggcgctggggctgattaacgggatggcagatgttggtaagcacattcctgatgatttagcagtaatcggaattgacggcacccaagtttgtgttcgcaaccggccgcaaattaccagcgtcactcagaattttcgattaatgggacagatggcagtagatgagttgattcgaccgaatcggaaaataacggatgttcgacagattgaaattccattttcaattgaacaacgcgaaacgaccaagcagggccttagatgactgttggtcgatggtcatatcaaatcaaataactggggcagagacaaaagtcattttgcccagtttccgttagtgtcaacacgattgttaccaagcaaaaacgcgggacaaaaggcaatttccggtcgtgtaaccgaatcaacaaaatattccaaaatcaggaatatcttgttgaacttgttactaagttaaaacgtggaccagcaagcagcccccggccatataagcctcctaacttaatattccaaaatcaggaatatcaagttaggaggcttatattctggggtctaaccgcttgctggtccactctggttatttaataatagaacatcaatattttttaacccaatgcttttaaatttgatatcaggatgctacctaaaatcactagtccggaaccaataacgatacgaaccatttgatctttggttttatattcgtgaagcaggtagatgccgccaaacgtgccaataataacgccggtttgtgagagggtcgtggccatcgcttggccaatgagtgggttagcagcggagatgaacataaataaatttccgataccccaatcaatgcctgttgtgaggtttttccaggtgtatttctgaaacatgatggttcgctcgtggaataagaagataataattaagatcgaaccaatgacttgaccgaccgcttgaggggtcacaatcgcagtcatataattgatgccgttattagcgttatgaatatggttactaatatacccaactttgaccaacaggtttggaaaaacaaaataaagcataaagccaactgttgaaataattaaggcgatcattccttgattgtaagttgctggtcgtttagtggcttgatgtttatctaaggttgaacgtgcggctgtcaagattgcaccgatggtaattaatgcaattgagattgacccaaatagccacattttaacggtaatccattcacgtaaaacggctgcggccatcagcgcatttgaaataatttgaccggctgttgaaattggtaacgctgaagaaacccccatttttttgaacgcaatgaattgttcagacgtgccaacggcccaaaacagccctgaaaggatgccaacgatccaaatactatcagttataataacaccgcgtggaataacgaatgttaaataaataaaggtacctaagattaaagcgccaagcgattcacctaagacctgctggccagctgagccacccatttttgtacaaatcaagccaactgatccccaagttaatggtgggattaaggccattaaaattgccataataatttccccaatctaattcgataatagtagaaaagtagatttcaaaagataaggacatgagtcaaatattcgaaattagaatatccaacccgtgtccttaacgttcagaaattaacatattctctttttcactttgacgtgtctaaacgatgacatattaactcctcaatttttcgttgggataaatcatgacttttagtgagccgcccttatcagttctggtttcttcaagcgcatcacgagtctcatctaaactgtagtaattagtcaataagttttcaagaacgtcgaggtgtttagccagaatcttaacgcccaatgcataggtgttggcatatcggaaaataccgaagatttgcgtttcgtgatcagtcatgaaaggaatgtccaatggaattttgtcagtggttggcacaccaacataagcaattttaccaccccgttttagtgctcggaggtcttcgcgttcagctgccggattaccagaagcatccatgacgtagtcaacaccttcattgtttgttagagacataatctcttcaagcgaatcagtctttcggatatcgatgatttcatcggcacccatcttcttagcagtttcaagacgtaaatcctcactgtcgctgacaatgatccggtcgacaccaaactgacgaaaagcaagaattgcaaggagaccaacggcgcccattccggaaataaaggctgtggttccgggcttaacgtctagcttctggcaaacgtgaacgccaacggaaaatggttcgtttaatgcggcaatttcatatggcatttcatcaggaattgggaaaacaaaatcttgtgggtaaacgattaattcggaaagatcaccatcgactggtggcgttgccataaatttcatatttgggcagagattgtatttaccttctcgacaataattgcaatggccacatggcacacctggttcaattgctactcgatcaccgcgtttaacggtggtgacctcatcaccggttgcgactacgatccctgaactctcatgtccaagaatgagtggctttttaacaacgaagtcaccaatatgaccggtatcataatagtggacatctgacccacaaatgccaactgccatcactttgattaaaacgtcggtcggcttcattgcgggaagtggggtatctttcatttcgatatcaaaaactttgtttaaaaccgcactgcgagttgttttagggtaattatcctttgtataatttggaagtgaaacacgttctttgacatccatgataaaatcctcctaggtaatttgtatttaaacgctgataaataatatctgcacatcattaagtgaattgaagcggccactttcaatctttcgaataacatgagtaagcggttacgcagattggataatcacgctcaagtatttgaaacacgattcaactaattgatgagggattaagttgttaataattgctgaagtaagggagatcagggaattatcagttataaacctcactaattagtttaaaagtaattgaaaagaagtctagcgggctcctcaagcatttttttgttattggggaagcgcttacgcatattattgcaccaaatgatagcgctgtcaatttttaattaaaaatatatttgaccttgataattgtttaactgagtaaggtataattagattattaaacaaaaatggagactaaataatattgagagtaaaaattgctgacattgctaaaattgctggactatcaacggcttcggtctctcgaattttaaatgaccgtggcggatatagtaaggcgactgcaagtcgggtaatgcagattgccgacgaactgggttattataaagatcgttctgcgtcagatcttgccagccaaagtaaccatacaattgggcttatctacacggattctgaaactaattttaatgatttggttattaaaggaattatggcagaggccacaataaataaattggacactattttaatgattgccaagaagaatgatccaatcagtttaactaaagttgtccgagatatgattgaacgccgggtgtttggcttgttatttgtttcgatccaacctaatcagcaggtgattgggatgcttaaccaagctggtattttttcccaggtagttggggcatccactgaaaatcaagtttcgtatgtttcctccgatgattttcagattgggtatcaggcaaccgattatttgattaaggctggttaccagagaattggatttgctggcgcggatatcactaatgattatgtcggtcaactacgactccaagggtatcggcaggcattaaagacgcatcaaatgacatttaaccaggaatggttatgtgaaggcaattttagttatcaatcagggataacagctgccaagtattatcacaatcattcgactgttgatgcgattattggtgcgagtgatgaaacttcatggggattactaaacggattttatgatttgggtgttttggttcctgacgatattgcaattatgagtattgacggtactgaattgtgtacgcaaacccggccgaagttgaccagcattacgcaaaattttgcgttaatgggaaaaacagcggttgatcgattggtgaatcatgctgattcgcctcaaaccacaaccaccagtattccattaaaaattgagaaacgggaaacatcatagggtaacgaggaagagtccggtcatcaattgttcatttctgaaaaatgataaatattacaaaaaaatcacgttttcttagcagtcattgacatacttactgctaagaaaacgtgattttcacttaaatagataggcctttgattcatatggtcgaatttcagtcccttgatcatcagcataatttgaaatgactaatttacttgcatgagcttgatcatagtcacgtgaaactgttttggctgtaaagttgctaataatcaacattttctgtccttcatagttacgtgtataggcaaagatatccttgtcatcaggatccagctcgtggtaatcaccataaacgattagatcaaacgtatggcggagctggataagtttttgatagaaagcaaagactgaattgggatcgttaacctggttagctgcattgatttgggaatagttgggattaacagtcatccatgggcgaccagtgctgaagccggcgttcttactagtatcccattgcattggtgttcgggcgttgtcccgtgacatgtttgccaaatagtctaacatcgtttctttactaataattttttcttggttaaccagttcgtcaaatgcgtttagtgattccagatcttgatattgggagatgtcagtgtagtggcagttagtcatccctaattcttcaccttggtaaatataaggggttccttttaagagatgaagagttagagccagcatttttgcggataaagtgcgatattgttcggaatcgttaccaaatctggaaacagctcgcggttggtcatggttattccagtagagactattccaaccagttgcgttaaggccattttgccatttggaaagagaagcctttaaatcagtgagctttactggaatattattccatttaccgaggcgtttgtctttatttggtgttaaggtaacgtgctcaaattgaaaaatcatgtctagttcgtgatgaccccgaccggtgtattttttggcatcgtcaacttttgaaccaatcatttcaccaattgagaccatatcatatttactgaggacctcatgattcatttctttgagataattttccaaacgagggccatcagccacgatcggttgggcatccgcatataaggcatgtccggggttgggggcgtcagggtagccatctggtttgtccaatagactgatcgagtccattcgaaagccgtcaatgcctttatcaagccaccagcgcatcatcttataaacatcctgacgcattttgggattctgccaattaagttccggctgctctttggcaaataggtgcatatagtattggccaagctttttactatatgtccatgctggtccactaaagtaagatccccagttatttggcaactttcccggttcgccatcttgccaaatataatagtcgtggtagggattgtcttttgatttttgagactcgataaaccatttttgctgatcagaactatggtttacgactaaatccatgacaagcttgatgtgacgtttatgagcttcagttaacaattgatcaaatgtggccatattaccaaagactggttggatgtcctcataatcgctcacgtcatagccgttatcacgatcaggggacttataaattgggttcaaccagatgacatcgacccccaatttttgaatatatggcagtcgcttaataacacctttcaggtcaccaataccatcgccgtcgctatcctgaaagctgcgtggataaacttgataaataactgcattttcccaccattttttcatcatattattactccttgttttcatgtttttcaatttcaccatatgtctcatgaactactgaaacactaattgccgccagaaccattaatataccggcaattaacatcatccagtgttggttaccaataccatgattgccgccaaaccagccaataatggtaccaccaacaaggtttgccaaaatttgaggaatacaaattgtacagttaaataatcctaaataagtgccaatattattgccgtccaaagaattagtcaggatggtaaacggaattactgtgttagctccccatgcgagaccaaatgcaataaatgagaagattaacgtgtatttatttgtgactacgaatacagatcccagaccaactgcgcccataagtaatgagaatgcccagaaacttcggcgttgacgtgggtatttggcaataaataatggccaaaaagcgccgacgactgctgaaacggcacttaaaagtccgaaccaattgccagcttcctggaatcctttagaagccacgttagttgtatgccaaactttttcggcaatcccgccggtagcataggttgccatatacatgtaggcagcccaatagaagagttgaaccagtccggtggtccaaaatgcggttggggcttcctttaacaattcccaaatgtgtttgtgattgggcttttcactaatttggtggaatgccgcatattcctttggtggaagttcatgaaccttaaagaatgtgtagatacagcaaatgagtaatgtcgccgctgcaaagtaaaatgaaaatttaaccgtgttgggaacgacgccgtgtggggcaatatttgaaatgccaattgtggttaatagaagtggaaaaatcgaggccaccacttggcccatgtttaaaacaaacgtcataatggagtaagatttttctttttggccctcattgaccatatcgccgcttaacattttgaatggctgcattgccatgtttgatgaaacatccaaaaataatagcgaaagcacaccaaaaaccatagaagccgttgtcccaaatcccaaattaagatttccggcatttgggataagaattaaaacaatcatactaattaaaccgccaatgtaaagccagggtaatctacgaccgaagcgagtccaagtgcgatccgaaagagaaccaaccagtggctgcacaaacatccccgctaatggagctgccagccaaaagtagccaatgtcgttgggattagcaccgatggtttggaagattcgtgacatgttggcagactgcagtgcaaatgccatttggacgccgaagaagccaatattcatgttccatagaaatgaatttgttcgattacttttatttaaaatagctgtgtcaatttttgacactggttcatgtttggagatatctgtttccataatgaacccacctttcattatttttacgtaagcgcttacgtaaattcattgtatgcgctttccaaaaaatgtcaacttagaacgtgaagaaatgatggtgtgtaatgcaggacgctataaaaatgtgtaactgagttgattccaagcagaccaatttaacgagttagcaaggttatatggttcgcaaacaaagcttttattctagatcatttgccagttatatcaatgaatgtcagggtgtgcagttactggaatctttccggaaactggttctcatattaaagaaatcgattgaaaacaagtcataaaatagatggataccaaataggaaaaaatactgattaggagataacgtgatcactaaagcatggatgtgtaacggttgaaatggccgattatcagtcattcttatgactgcgtggtataatttttagaaatatgattttatttctaataaacccggaaagttaaccaggaggcttctagatgaaaatttcaatttcacttgcccagcttgatatttactttggtgatccagataaaaattttgcgcagattgagccggctgttaaaatggctgctgaacaacatgccgatattgtgatttttccagaaatgtggaataccggctatgatttaacgcggtttggcgagattgccgatccagaggggaaacgaaccaaggcattactttcaaatttggcaaagaagtaccaactaacggtccatggcggttcagttgcggtggttcgtgataatgcattttataacacgacctatatttttgggccggatggcaaacagttagccacgtacgaaaaggtccacttatttggtttgatgcgtgaagataaatatctggccgctggtcacgaagaagatcattttcaaattaagggtgttgataccaccagtgtgatttgctatgacattcgttttccggaatggttacggacgttgagtcttgacaatagtcgcatcatatttgtcccggctgaatggccaacttcgaggattccccaatggcgccggttattggcagcccgggcaattgaaaaccaaagctttgtcgtggcggttaatcgcgtgggaaatgatccagacaacccttttggcggtcattcgggtgtttataatccaatgggcgatgagctattgtcattggatgatcaacctcagctcaaaacgataacgattgatacagatgaaactgatgatgcccgcggttttatgccggtatttgcagatcgacggcccgaattataccggtaaggggggtccaacggctgcttgacattttgaggaatcgacttaaaataaaaccaattgcataacattaaatgttgatgagaagagtaatcaatttttgatttttagagagtgcagagacagctgggaaggcataattaaaagattggtgaagatgaactcgaataataggcgggtgcaagctacgcctacgactagcaaccgttaccctgccaaagcgctgaatttaatgaccgattcgcgtttcttaaggtagtcattgcgattacgaaaataggtggcaccacgttaacaacgtccttgtaattaattacaggggcgtttttattttgaaatcatcagcttttttggcatctagagccatcaacattaaatcgatagaaaaggggattattatgcgaattgaatcatcatccgaaaagtcatttcttgaacaagtatttaccaaaaccggtttttcttcggctgatagtgaattgctggccgacactttaactgacgcggatttacgtgggatttcgtctcatggtattcagcgactggcttggtatttgaacatggtcaaagaaggaaccattgtgccacagaataaggtcaaggtcttaaaggaaacgccaaccagcttatttgtggatgctaatcaaaacatgggacaaattgcctcggcgtttgcgatgagaaagctcattgaaaaaacaaagaagagtgtagtttcaattgcggttattcgtaattccaatcattttgggacagcggggtattattcccggatggctgctaaagcagggctaattggggtctcaaataccaatacccgaccattggtggttccaaccaatgcaactgaagctttcttgggatccaatgcgttcgcgtttacctttccggcagaaccccatccctttgtctttgatggggcaacctcagtggtttcaagtggtaagattcaggttttggataagaataaaaaagacatccctggtgaatgggcagttgataaagatcgaaaaattgttaaaaacgcaaaagctgcggaagatattttgtcaacggctgcctttacgccacgtcaaaagggtggcggtgtattaacccttggtggtctctttgaaaataattccaactacaagggaatgggcaattcgttggttgttgaactgttgaccggcattttggctcaaggatcaatttcagccgatactagtgttggcaaacatgactttagtcaattcttcctgacaattgacccatccttcttcggcgatttagatgtcttaaggaagaatgccaccgacatgtttaatcgaattcgccatttggatcataccccagggactgaaatcaaaattccgggtgaccgtgaatataaaaactatgcggaaaatacgaaaaatggggtcaccattgatgatcaaactgccaaagatttggctcgaattggtgaggaacttggcgttgaagtgccaaaggaattgtagtcgattagtgttacgatatcgatgacgttgattcagttgggcacagacgaaaaaataaaaaaactacgaatgccaaagtgaagtttggtattcgtggttttttagtagaactgataattgatcagaattttattggttcacaataatgactcggccatcatgtttctcttccagcagttgatggcccttaacaaagccatcccgggagaatggtaatgtgtagccgatgttaactgttaatttgccatccttcatcaaatcaatgactgcctgtaaagcttcgcgatcagtcatgtcattagtgggatggacatggacaaattttaatggcttgtctgttgacggcgaatcatgagcaacactggcaatcgtgccgttgggtttaaccattttaatgtcatcatccgtgccagctccgttcatggcactattgatgacaacgtcgccctgatcagctaaaacagttgccggatcactctgatcatatgcaacaaagcgactggctccaattgatgtcacaaagtcttcattatgacttgatgcgacaccgatgacgttagcccctaagtccgttgcaatctgaacggcaagtgaacccacgccgccagaagcccccttgacaataacggtttgtcccggctgaacgttagcaaaatatttaacagttttgtaggccgtaagtccgggggtgataatcccggcggctctggttggcgtaatcccatccggaacttcaacagtcgcgtctgattctgccaatacgaattcagcgtatccatgttccgtgtgggttaacacaagatcgccttcaacaaaatcgtcaatattcttgccgactttagtgacctcaccgacaacatcccggcctggaatggttggggatgtcactgcgccaaagccacctgctctttcagaacgttcacgattatttaagccgactgcaatcgttcttaccaataattgatttgcggatggcgatggttccggcacgtcatattcttgaaaaacgtcaggactaccatgatgatcgtaaccaaatgctttcatattcttcaacctcccctaagtaattcgaattcgtcttactggcgccattgtaagcggaaacactgaagagagcaagcaaagcgattgttaattgtcctgcggctatttatttaagtcttggcttgaaaaatgattttgcattaaagcggcggcaccaattgcaccaacgacaacgatgatcccagaagtaacggctacggctgccatcccgttatcatacgcatgaatcacaatccgctggaggtcctgtgcaaacggtgccttagccattcttgttgaaaaggcgattgtgtgaccagagaatggcccggcgtttactagtgcctctttgatcccgtcaagtgcatgggcgggcagtgatgaaatagtatgcagatgctcgtttagataaatttcatattgagcatcctgaatcaatccaagcccaacaaccccgacggtcgttccaaattgacgaaagacgtttagcaaaccagagaccattcccatttcatttggcagggcgccttccatcccggcagtgtttaatagtgggttgaccatcccattggcaatccccatgaggaccataccgggccatagttcgacaaagctgaccgttgggctgattgacttggccatcaagaagaagccgccgccaccaactaagagactgatgacgatcatccattttttcgaataccgagcgctgagaattccggctaccggtcctagaaccagcgaccagccactgattgttaattgtcggactccagtttgaacagctgagtagccaatataattttgcatcagggcggttagaaacgcgttgtaggcatagatcccggctcccaaggcaaacgcaacggtaatcgttcccagaaagtgggggcgtttgaacatttgaatatccatcatgggatcctcaacccgcatttcgacgaggacgaaaataatcatgatgatcacgccaccaatcagaaggccactgacttccggcttgaaccaattccagtggggatgactttcttttacgattaagccatagataattgcaaataaaccaattgcggaaagcatcatgccgatcaagtcaattttgtgatttttaccataactgggcgtttcctgaacgtaaatgaccgttaaaattgtcgcgataatgccaaaggggacattgacatagaaaatcgccggccagccaaaatgttcaaccaggtaaccgccgattagcgggccggaagctgaagataccccaataattgaaccaaggataccaagtgctaagccgcgttgtttgccgctaaagttggaagccaccaacgccattgagagtgacatcataccggaaccaccaattgcttggacaccacgaccgatgtctaaaacaaagaggctgggggccatcccgttaattgccgaagcaatcacaaatagaatcagtgacccaaggaaaatcttcttccggccatacatatcacctaattttgacataatcatcaaggtgaccgcatagaccagtgtgtaggcgtttagcacccattgtaaattagtgaaagtggtattaaagccccgcgccatggttggcaaggccacgttgacaaccgtgacgtccaagaggcccatgaagacccctaatcccatggcaagcagggcaatccactgcttggtagttgtttgtttattcatctaaattctccttatcatttttcattttttgacggcaattatcaatccaattggttttagcgtggcaaatggaaatgcttaagtctaatgagcgaatggcccagacgagataaggttgatttgagtcaggatcagctaatttttcggataaatgttgcttaaccttggtatagacgttaaaatccgttgccactgcattttcataatcggtaagaatctgctgttgcgtctggggatcgacaccggccattcctctgaatttaaaccgccaaattgattctcgtttggcgtcattcgggacttcggcagccattaattgttgaaatcgatcaatcccggtctgggtaatgtgagccagtttttcatttcgcggattttgggtattttcgatgaattcgatatatccctttttggataacttttgcaataatgggtacatgaccccgtttgaaatttcacgacgaggaaccaaactgctttcaaagatgattcgcagcttatagccggaaacatcccgtgacatgagtaatccaagaattaatagttcgtacaatctaagcctcctatatgtcgtaacgacttatctataataggtcgttacgacatattatgcaagacctttttgaattcaagtagcaagagtaagcggttcaatgaacaacaaaaaaggaatccagataagttcaaaaatcttatctgaatcccgttacgatattattttttcatgcagttgaattcaaaccatctggctatccaatatgtacaaaaataaattgtgataaagaaaccagcaatgcatacaaggtaactaatcgtccacaagacttgtaaataaccgggaagctttaccaattgaaacgaaaagaagataaatgtagatagaacgtcaacaattattgctactcgttgtccaaactttgaattagattgttgtcgtcgatttttaataaataggtaactcataaaatgtatcgaaatgatttgtgacatgattgttgctatcagaaatatgagcctgccccttagtgggtagtttaaaaagaatgagaaaagagatgcaattaaaatacccaggatatctaaagcaagtaaccaatgatatcgatttattgtcaattccatttttaaattaggcccctttcaaaaaggtggaattcgttcagcactaaaatgttaacaaacagaagtttcctaagcaaatcgtcaattttatgtagcaataagatcaaccaatactggttatttgcaaactagtcacgtcgtttctgtagctggtattagaaagagtcaaaaagcgtctcgagtttttctcgaaacgctttttggatagataagatgttattttatgaattatttagtagccgattgcttagcttcctgtttaacagcggcgttatgacgcatatccatttcaatttgttcaagtgttttaccacgggtttcaggaacgacgtagatcacaaagaagattgaaataaatgcgaagaaggtaaagacggcaaatgggccaccaacgttgttaccaaacattgtcagcaaggccaagaagaattgcgaaacgataaagttaccaatccagttggcagctgatccgattgaattaccaacaccacggacgttcaatgggaagatttcaccgatcattaaccagcaaattggaccccatgaaacggcaaatccaaaaatgtaaattccaattaaaatcatggttggaacagcagcggcagaaacactaatcgtaaagttcaatacggaaaggatcccaattgagatagtcatcacgattgaaccgaataatagaatcgttcgtcggttgaacttatccataatgttgtaggccaaaaccgtgcaaagaaagttgacaacaccgatcccaacggaaatccaaatggcgtcaccttcagcgaaaccaaagcctttgataaagacttgtggtaaaaagtagatcaccgagttaattccgactaattgttgtagtagcattaagccaattgcgacaacaaccgctggccgggcaatggtaaagagttctttaagcccaccctttggttctttagcaatcttaacaatgccttccaattctttgtcaggatcttcatttgtcttagcacgtaaaccatgtaagacatttcgggcttcgtcaactttgcccttctcaactaggtaacgcggagactctggtaaaataatggatccaataaataaaacgagtgcaggaatcaaagcggatccaagcatccaacgccagtcacgaataccaagtaaattatggtgtaagaaacttaagtttgaaacgtaagctaacaaaataccagctgtgatcatcaattgaaacatcgttccaagagaaccacggtgtggcgcgtcggcgagctcagccaggtaagccggtgtcaaagctgaggcagacccgacggcaaatcccaagataattctggcaataatcattgaaatgaatcccatggcgatcattgacaatcctgatccaaccaagaaaagaattgaagctaaaattaataatcgttttcgaccgaatttatctgataatgatccgattgataaggcaccaattgaggacccaattagaacggatgatgtgatgaatccagtctgttcaatgtttaggctaaagttcgattcaattaatggtgaagcacctgaaataattccagtatcaaatccgaacagtaagccacctaacgcaccgaagataaaaatgaagaacgtgtttaactgacgaactttcatagtttaatcctccttaataaatttaaaataatggcaattaaatgaaaaccttttacgaactcaaattgtaaaccctttcatggtaaatgcaagcgtttgcaataatgacttattttcaaaagtaataagaaataccaccatgccagttaatgatgagtacagaaaataattttacatttttcgttaaatcatcttcttttcgcatagtaactctgactgcaccttaattttagtgatttttgagttgtggatgcaagaaattgcatttttttgtcatgtggacgaggtgatttttcatatattcgatgtaagggataaatcaagcttttgatgatttgttgattaaaaatattgaaagatttggcagccgagcggaaacgtggtctagaaaacagctcccggccatataagtcgtccagccagatattcaagcccggaatatcattgctggggttggcagccgagtggaaacgtggtcccaaaggcagctcccggccatataagccactcagccaaatattcaaacccggaatatctggctgagtggcttatattctgggagctaatcgccttttggaccactctttatttattcattctccgataaatcacatatagaacgattgccacgacgatgccaattccgatcattggttcttctctaaaaataaaatgaagaaagcgaacggaatgtaatccgtgaattccaacaaaaaaattaaagttatccataaatttcgacttctttcttgtatactgattatgtattcttattttagaccatccgtggccgtcaggaggaaattatgaatattgattggtcatcgatatttaatatcatcgttgttgtaaacgcaatttttgccattattacggtctttcgggaaaaaagggatattgccgcaatttgggcatggttactagtgctggtgttcttaccggtcgctggttttattgcttatgcctttttaggtcgaaagttgcccaagaaccgattattcaagttgcataagcatgttcagatgcagttggacgaacgattaaaagaacaacgagcgcaacttggtcacagtgacaaaacaccggctgatgaggttgttcgacgttcgcgaaacgccgttgatatgttcatgacaactgattcggcatttttgtctcgtcagaataaagtacgaatccttacgaacggtaacgatttgttccatcgggtaatcgaagatattgaagctgctcaaaagagtattcatatcgaattttacaccttttataatgatcgaattggtaacgaaatcttagatttactggttaaaaaggcccagcagggagttgaggttcgggttatttatgattcttgggggtcaatggggactacccgtaaattttttcaacccttacttgatgccggtggtcgggccttcccattcttgaacacccgatcagttcttttggatttccggattaacttccgtgatcacagaaagattattgtcattgatggcaagattggttatacgggcggttttaatattggggatcagtatttagggcgtaaaaagaaatttggcaattggcgtgatacccacatccgaattattggttcgggcgtgtttggccttcaagcaaggttcattcttgattggaacgccaccagtccgcgggatcaaattgatgaagatgaagttgaggctaagtattttccggtcacgacgactaagggaacggttaacatgcagattgtctcgagtggcccggattctgatttgcagcaaatcaaaatggggtacatcaaactaatcacgatggcgactaaatattgttggattcaatcaccatatttaattcctgatgatagtgtgatggatgcgttacgaattgcagcaatgtcaggggtcgatgttcggattatggtgccaaacatgccggatcacccgtttgtttatcgggcaactcagtactatgcccgccaattatcagaacaaggcgttaaaatttactattataacaacggctttatccatgccaagacaatggtcattgatgacgagatttcatcagttggctcagctaacctcgattatcgaagctttaaactcaattttgaaattaatgcgtttatttatgatcagaagttttcgcaggatatgcgtcagatctttattaatgatatgactgtcagcaacttacaaacagctgaaatgtttgaaaaacagtcattatggttgaagttcaaacagacatttagccggctgctgtcaccgatcttgtgatttaacggatatttatggatagcgattgggtttagaacgtaccgattatccaaataataaagggcattctagaaatgagcaacatggtggaacccctttcagaaatagcttataataatagtgaaaggtgaatgactgatcacctgttttgacaaacgagggacatgcagaatgtaagtaaagcgctaggtcagcgtgcctagatccgagtagtttgtcaccgttttaacccaacaacagagatattaaacacaacgttttaccgaccagctaggtcaatgattggtctaatgcctttcagaatgatttattcgaatagtgtctttacactcaaagggtgtggggcactattttttgtggcctggttttcgattaagcgtaaaacaataagcagaatgagacaaagagcgattttacggcaagaatggcttttgcctcacgttttggcttagtaatagttgtgattacaaaaatgggactggacaaaattacttttgtctcagtcccgttattaattgaaattcatcgaatatgagcgatttttcggtcattattttgataggtcgtactttaagttaatcatataaatgataactgcaccaagtgtcatgcagacaaattctccaatggctgtggttaaataagcgctccagaatgttggccaaaaggcactacttccaagaaaagcaatttcaccagcaacgataaacatgtagaaggttccgattaatacggacgctgctaatttcttgataactgactgaatgtggttagtaactaaccacattgtaataagggcaattaatgtttcaccagtcccaataaccaagtcaagtgggccaagtgatgagatcatgttggaaataaagcagcctagggtaacggccaaaatataacgcttgttaaaagggactaagttgttgagaccctctgaaaagcgaaactggatgggaccaaaacttgtggctgcaaagaccatcgtcacaacgacgtagagtgcagcaacaacggcagccttggttaaatcagccaagttgtcgatgccgaatacatcaatcttagaattcataataaattccttcctataaagtttcgtaatgtctaaagtttcttagttttattcttgataatccttgttaaatcaacgttaaaaagaaaacacttgtcttcccccgaaagttccgacatagtgtaagtaccacccaacactaaagaactag

SEQ ID NO: 693 - DNA, 47507 bp, Unknown
  Metagenome-assembled genome
atgattatttttgttgttacttttattcaaagcgaattgacttcgcaaatgtttggctccgattaaaaatcgaagcgccctacacattcgtttgtcgaaaattttgttcagttttcaaaggtctaccatcgtcatcgaagcgcttgcttctcgcttttgacaactatttaatactatcagattttgaattgaaaatcaagaacttttttcgcgtttttttatgaatgaaactgacgaacaaagcaatctgatatttgacaacgaaaaatagtttaccaatttatacgaactgggtcaagtactttttgaaagatcaatcagaaaagtttctttgcctcaatcagccatttattgcgagcccttgaaatagttgaaaaaccaatggattgacggtaatttgtccaatagtgaattcgttgtggacgattatattttgactgctgaaaaacgtcaaaattaacaattaacgaacgaactgacaaactaatttttcctgaaaactgatcgatatcgataatcaacggctcaactgcgtcgccaattttaaaaagttcgtgaatatctgatacgtatccagcctgacactcggatatgtgaatcaatccctgctgatgatcacccagatcaacaaaaacaccataaggctgaacaccagtaacttttcctttaacacgcattccaatctttaagcgcatattatccctcccttaaagtgcttgaacaaaatccatcaagttcattcgaaaaaagttgttttttggtaaagctcttgcccatgattataaaatacagatttaatttggtaaaatcaatttaaaatatctggaaggaatgattttgtgagtgctttgatcgattttatcctgcacattgatgatcacctcgtaaatattgtaaatacatttggcaactcaacctacctaattttatttgcaattatttttattgaaacaggggcggttatcttcccattcttacctggtgactcactattatttgccgcggctgctcttgccgcaaatgccaattacgacttaaatatcgggttgttcattattgtcttcttagtggcatcaattaccggagactcactgaacttcttctttggagacaaatttggtgatcttattccacgacatcgaatactaggtaaattcatcaaagaaaaggatcttgaaaaggcacgacttttctttgataaatatggcgcttgggcaatatttcttggcagatttatgccaattattcggaccctgattccttttgtttcagcaacaagtaattttccatatgcgcgatttgcaaaatataacatccccgcctgtgttagctgggtcgctatctgttgtggtgcaggatacttttttggaaacattccaattgtcaaagaaaacttttcaatggttatcatcggaattgtcttaatctcgttattacctgccatctttggattcattaaagcaaaatttatgccatctaaacaggataacaatttataatttacaacgagggtgacaattgatataattatctttgttgtggtgagttggcagagtggtaatgcaccggactcgaaatccggcgaaccggctaataccggcgcgcaggttcaaatcctgtactcaccttatctttgaaccaccgaaacataaaaataggagctaagacaaatagtgaatttgttttagctcctattttttaacctaaggtaacacaaccaataatttagaagaagtgctgttagaattagctgcaatatcaatttttattaaaagatacacattaattagtctacgcctgttaatcaaaacggcaagttctcaaaactttatcggataaatcgcctactgtgagttttatcttcgctccagtattaaactttggtgaaaaacacccgacttcgatcaacatttcatagaaacaagcatatccaacaaaaaatcagatctcttaaatcacctcgtaccccaagcattttgaatcaaactaaaaggcgtcatgacaagtccacatttgggtagtcatgacgcctcatttattttaaaaaaatctaatagctaagtaatgtaaagaaatcataattcttaaccttgtcacgacctttaagatcagaaagttcaatcaaaaaagccgttccaacaacaatgccacctaatttttcaactaatcgaattgtcgcgtctattgtacctcccgtggcaagtaaatcatcggttatcaaaaccctctgaccaggtttaaccgcgtttgtacgcaaatacagagacgatttaccgtattccaagccatagcttgcctcaatcgtctcacctggcagcttatttttcttgcgggcaggagaaaagccaactcctaacttataagcgacgggacagccaacgataaagccacgggcttcggggccaacaatcatttcaacattccgattacgggcaaattcaacgatttgatcggtggctgcacgatatacatcaccattctccaaaagtggcgaaatgtctcgaaaaagtattccgggttcggggaaatctgggtatgatgcaatatattttgaaaaatcgatcgacatattctttcttcctttcatcagctgtccaaacaattttcgacaaagctgactaactcatgagtattagaaaccagtaattgtttctcagtttttaactgctcttgtctcaaatgatagctgggtgccgtctttaaatcacgacttgcatagtgtgggttaatgttaatcacccgatttttgattgtgataaagtctaattccaaaaaaacttgaatcataaaaacaatcattcgcgatgcaatgtttaattgcttagatagttgtgctaattgcgatgcaatattgatattcggattctcttttacgaacctaaatagtttagcataagaattccgatctggcatccccaaatttgataccaattgtttcttataaagataaagaaccgtagtctttggccgacatctttgcaaaacctgtgtcaagtcatcaatcacatcaggacaatcaacgacaaataaacgtttatccgggatcttttggtcaaccaactgatcgtacatgacacccttggcttcagcatctaaatacggctttaatttaaccaatgttttttcatgaaaaaaaacatatgtccccgatgtggtaaacatctgttgatgtagaatctgggttcggcggtcaataaccggcggaacggtttgtttaagatcatcaaccatcaattgtagcgttgtccgattgttccaagtattctcaccaatttgcccgacaacttgaagttgatctgaaccactttgaacttgaccggcaattgaccctcttccaaaagcaattgcaactaatcgttgatcaccttggcagagcgtgaattttagatgatcagaatttttccccattgttttaatatcaagaatttgattaaagccaaatttaaaagtcggcttcggattatcctgcccaaagggagccaatattttcaacttatcaacaaatgtcggcgtcaccttggcaactggtaaatccccagtaatcggaagtttaggctttgtcgtcaaatcaagctgctgatcctttgcggcctgttctaactgtgcttttaaaaccgcaagtttatccgcattgattgttaagccaaccgcagaatgatggccgccaaacccaattgtttgatcacgaattggatcaatcgccgcgaatagatcgaaagaatcaatactgcgacccgatcctttaatctgatcagtgccggctaatgtcgtcaataccaatgttggtcgcccgtatttatcaaccaaccgactggcaacgatccccaaaacgccctgatgccaatccttaccaaccactacgagggtggctcgattggttaagtcgtccgaattttcaaccatggtcacagcttgctgataaaactgatcaactagcgatttacgcaaatcattttgatcattggcaaattttgccagtttagcagcttgatcctcatcaaaagtcgataatagttcaacaccaacagtcgcatccttaattctaccaagagagttgagccgaggcgcaatggcaaaaccgatatcttgttcatcaaaatgagccagatcaatcttagctgctttgagcaaagctaggagacctggtcgttgactatttttaatggcgtcaataccaaatttaacaatggcccgattttcgtctcgtaaagaaaccacatcggcaatcgtcccaattgaggcgaggtcaatgagatcactgggcaattcatccaacaaagcctgggcaactttaaatgccactcctgcaccacacaaatcaccaaatgggtacgcccgaccctgctcatcctttacacggggatgaataattgcaagcgcatccggtagggtctctggtagtgagtgatgatccgtgacgacgacatcacaatgattttcgttagcggcagcaattgcgtcaaatcctgccacaccattatcaacagtaataattagtgaagaaccattttgaatgatttgcttaaaggcatcgacattaggcccatacccttctttaaaccggtttggaatatagtaattgacgttggcgccaagatcatttaaaacttcatacataattgtggtactcgtaatgccatccgcatcataatcaccataaatcgttatttgttcgccgttttcaatggcctgctgaattctcaaaattccctttttcatatcgtgcatcaaataagggtcatgaaaatcatcagtcgaaggtgtcataaagctctgagcggcttgcgatgtttcaattccccgttgaatcaacatttcagcaattaatggttcaatatttagttgttttgcaagttgagtgactttttgtgagtcatcaaccttattaatgtgccaatcatactttgcatcaatcattaaaacacgctaccttacttttgagatgataatttatccgtcaacttggtaatttctgcttctaagtcgctaatttgttgatctttcgttcctaattcctgcttaccatatgaattctttaatcgcgtttctaacgatttaagatgagttgtcagctgatcaatctgatcccgtaattcgtcctgcttttgctggctttggttctctaacgcacgatagcgacgattctttttcacactttgagtcgatgaaaacagaaaaataatcaaagcaccgattaacaagcaaattaaaattaacaagactaatggcatgcggacagatgtaaaaccaaaactgaccgagacccgctccagattcataagcgcaaaaacagcaattaaaataattagaacaatgctgataatcgtggcaacttgttttttcacagcaattcccccttaaacttgaaaaccttccaaataaaggaatagtcactgattataagccaaatattcaagatgactaacccatgacaaatgacaatagcttagttgaaataaaacttaatacgaggtcggaagatagaataaccactaccaaccctatccccatttatcataaaccactatcggcatattatttgttaaacggtacgtcaactacatcaaagtctttaacaaccttggtatttggaaatattgtttgggcctgtttctctaaatcgtatgccatccttccagtgtaacgagctgaaatatgatttagcagcaacatcttaacaccagcccgtttggcgattgcagccgcctgcatattggttgaatgaaaatagcttttagccagtttattttcaccctttccaaaggtactttcgtggaccaagacatcggcgtgttcagcaagtctagccgcattttcggttttccgtgtgtcaccaataattgttacaattcggccgggctgtgccgggccaatcatttgcttaccatcaatcgtgcgaccatcagccaatttaacaacttcgccgcgttttaaacgaccataaattgggccggaaggaatctgcaacttggccaacctgtcaaccatcagctcaccgggatgatcatgttcgacaacccgataaccaaaactggtaatccgatggtcaagtggcgctgcgtagactgaaaatttgggatcttcaaaaatcagaccatccgtgccatttgggagttcatgaaaaataatgcgatatgccagtcgactttcagagacctttaaactcacattgacatattccttaattccttttggaccgtaaatgtccaaaggcccattgcccccctgaaacgaacggctgctcaataagcctggaaggccgaaaatatggtcgccatggagatgactaataaaaatcttgtctatctttcgcggccgaatcgttgatcgtaaaatttgatgctgggtaccttcgccgacatcgaacaaccatactgagtttatttcatctaataaccgtaatgccaggctcgaaacattgcgaaactttcctggagaaccagctccagttcctaaaaattcaatttgcatgaataccgtttccttaatttttaaaatcgaatcagtcaagatgtttctaatgataagccaaacagtgatcgtccaaatttatcaacatcttgaaataaccttttcaattgtatcatatttttatagaattaatcatgaagaggaagtgagcaattattaatttaagtgaattttatcgtgccagcagtaccctaaatccaaaactaaccttactcatttcaaaggggaaacactttgtcccaatcacgcaactaaccatcgctgaggattcgttattgttagataccaaggatcaattcagtggtgggccagctaccattaccttggatcaatttttaacaagaaccagtcatttgccgcttactacaaatttgaggacgtcaaacaaccacgcattgctttttgggtttagaattgttaatagatcaattgtcttttattaggggaaaaactatgaaaaaaaatggattaatcttaacactttgtgccatcttgattgtgacattagctggctgcggccatagcagtcagaacaaccaatcaaccaataaatctgctttaagtgcaaaaatgcaaaacgacaattccgagtcgtcttctagccagtcgcaaccagcacaacccaaagtaaatctgggtaaatatcagtatcaagtccccaaaaaggaacaagccagcaagaactacgtcaagaacggcaatttaacgaatcagcatcaatttagttatgatcgttttggaactaagcagcggctaacccaatcaactacccagcccaaaacaatcatagccggcagcatggcctaccaaatcaacaaggttagaatcttaaaaaacactgccaaaacattagcggcaaaacaagcagtcgagcaagctttaaaccttccgaatgttcctgatacttattatacatttgtcgtcaattacaccatcactaatcatcaccgctttgagattggcctcaacggcgttaattttgtgaaaaccgaccaaggtcaaacactagcaaccacaaatcagctaactgattcgtcagctggcagtaaaatatccgctaatcaatcgcgttcatttgtgatgaccggttatctttaccattttgctgttgatccagcaaaaacattaacgattcatttcggtcaaacgtttgataaaactggtcaaaaaattgacaatgcacctgaaagaccactcgtagttaatttgaactaaaagcatgtgacatcaaattaaaatatggttcttttatgagccaactaaatagcccgcacatccttaattcaaggagtgtgcgggctattttaatggcatcttatcaaaatcggttttaattagctatcagtttcaacgttacactacttcatcattaaatgcttgcttatttctctggcaattaaatgcgtatagtatacgttccctttcggattaggatgaacattgtcgccccagaaccaatccgtttgattgaaactataccgatgccaatcgataacatagaaatgtttgtacgtttttgaagcctgatgaatcgtattatttacttcagtttcccaatttcgggttggaacgtgggtagtcacccagaaaatccggtgtcctttgccaactgtctggacaactgatttcacttgagcaggcgtcatcggcgcattagttcccaaattgattaacacatttggcgctaattcatttttacgcttcagctcctttaaaacatccccagcctgccaaatttgacggccaaccttagctgatacatatgcctgtttaaagacggtctgcagatcgtgactgttatcagccataattgaatcaccaatggccgttaacggttgatgagaaacagttaaatattgctgcttcgttaattgatacttcttggcaatcttatattgcttaatcgtcaactttttattaagaaggcgtttcattcgctttttgctggcagcaattttgcgagcttttctttgcttggctaacgcttgcttgttatgcacattggcactgctttgatttttaagaatactttcctgaagcacatttcggccagccttggttggcgcaattgcacttccgtataagcagaccccaactaaaataactgctggcgccaaccagagccgcttcaaaccatatttagaattcggttggacaaactcgtaaatggtttctccaagtttgcgatagttgtaatgccgtaatggccgttcgatgaatcgatacgataattcgctaattcccataatcaaaagaatctcaattaccgcatgagtgatggggtgagaagcaatatccggaactcgcatttcataaaaaatcattaccggaaattgatataaataaatcccgtaacttctggttccaatccaagaaaaaaccggattggtcaaccagcgattaacgtcagcgccaggatgcgcacaagtcgcaatcagtgccattgatgcaatcgccataatgaacattccgccacgatacgtaaatgtattttgaccagccagctcaaagtacaaataaaccattagcaaaaatgatccaattcctaaaccatccaaaattaatctggagcgccgattaatatgctttcgtagatgggcagatggccacacaatcgccaaaaccgcaccaaaaataatcgaaaacatccgggtatcagttccgtaataaactcggtttaatgtgcttggcccggtataaatgaatcccattaacaatgccgaaatcaccgcaaatgccaacagaatataggcaatcgttttctttttacgaataatcaagaccagtgcaattaagattaacggccaaatgagataatattgcccttcaattgacaaagaccacaaatgcgtaaaaggtgattcaccattaaaacgatcaaaatagctttgtccgtgaccaacttcccaccaattatatagatacacaagatttgaagaaataatcgaacgtaaattagtcagtaatgatcgttgaaataacgttatgtaggtgccggttcctaccagcataaacaccagcgcgggatataaccgtttcagtcttcttgcataaaagcccaagaaatcaattctgccattctgttcccattcttgcaacagtaaatcggtaatgagatacccagatacaacgaagaaagtcggcactcccaagtagccaccttgaagtttgtaaggcaacagatgataaataataaccccaataacggcaagtgcccggacaccatcaaatccagtaatgtaacgactatgtttaagtcgctttccctttgtttttgtttgaacttgttgcattgaaatcttccctgtcttatttttcgttgtcttattctacataggtaaatgagaaatctaaaattgtgaccgtatccccatccttggcaccggcttttctcagggcatcatcaattcccatgccccgcatttggcgagcaaatcttaacatactttgatcatgagctgtatcggtcatcttaaacaaccgctcaatcttatcaccggaaatgacccacgaagcaatttctttatcatagccaatttggaaattagttggtgcttgagattggtaatcatattgcttttcggtttcgaccggttgctgaagatccgaaatgtcagttttctccaaaagatcagctgtcattcggactaaatcagttagcccagtatgagtgaccgatgaaattggcagcactgtcggtaaatcatcagtattatagtcagcctccaattgtgttttaaaggtcttcaaatgatcggctgcgtcgggaagatccattttagttgccacaacgatctgcggtcgttttaaaatatttggatcataatccgataattctttattaatcgccacaaaatcatcgtatggatctcgaccctcggttccagacatatccaccagatgaagaatcactcttgtacgttcaacatgacgaagaaattggaatcctaggccaactcctttagacgccccttcaaccaaaccaggtaaatcggctactgcaaaatcacggccgtcatccaaacgaaccatccctagattaggcaccaaggttgtaaaatgataaccggcaatcttgggcttggcacttgtaataacagacagtaacgttgattttccagcggatggaaatccgaccagaccaacgtcggccaatacttttaactccagccgaagcatgacctcctcaccaggttcaccattttcagcaatttccggtgctgggttggttggactggcaaaatggacattaccacggccaccgcgaccagctttagcgacaatcaattcctgatcgggcttaactaaatcaccaatcacttcgccggtgtccgaattagtaaccgttgtcccctctggaactggaatgacaagatcgtcagcactccgaccagtcatttttttattcgccccattgccgccattctttgctttaaacttacggtgataacgaaaatccattaatgtattcatccctgaatccaccttaaaaatgacgttaccgccacggccaccgtcaccaccggcaggcccaccgtttggaacatatttttcacgccggaatgcaaccattccgttgccaccatttccggcttttacatcgatttttacttgatcaacaaacatcttatcaccatttcaatttaatcctaaagtcgttacataacataatacctttgaagtataccgagtttactcggcaaggtcaaaggtatccgaaaaaaagaatcttttattaacatttacgatcatccggctattcagtcaactttttatcttgatagttaaccactttgcgttccttgtcaattttactcaacgaaaacttaactgtctgggcgaccgtctgtgaaatgcctaatgcccgaatttcatcaactgaagcagcagaaatctttcttaaggagccaaactttcttaacagcttgtttcgcgttttagggccgactccgctaatggcatcaagtcgtgaactcaacgaattcttggcatgaactttacgatggaaggtaattgcaaaccggtgcacttcatcctggatcctttgaagcaggtaaaatccctgactctttggatcaagttgcagtggtgtgtcgttatcaccaaataacaagtctgcagtttggtgatgttcatttttcaccatgccaccaaccggaatattcaaccccagttcgttaaccaacacatctttaacggcattcatttggattgtcccaccatccattaaaattaaatccggcattggcgcatgttcctttaataatctcgtatatcttcgtcgaataacttcgcgcgtactggcagcttcgtcagcatgatcaacggtttttaatttatattttcggtataaatttttattgggctgcccatccacaaaaacaaccatggctgaaactaaatcggccccctgaatgtgtgaatggtcaaaagcttcaattttatgaccaggggcaatccccatcgcatcagttaattccttcatagcccccgtcgttttactctcatccaactcaagcagtcggaacttttcttccaagaccagtttggcattcttaccagccatttcaagcaagtcccgcttttgaccacgttgaggtgttcgaacgggcacatcatcgacaacccggctcacaacatccgttggtaatgaatttggcacgagaatttcctttgggagcaattgattcttttgcttatagaactgagaaatgaaactgaccatctcttcttcaggatctgtaatgattgggaaaagccgtttttcccgcttcattaatcgggattgacgaataaagaagatttgaatggaaagccatcctttatccatataataattgaaaatatcgcgcggcgtattatcatgagaaataattttctgcttttcgacggtgatttcaatatatttaatgagatcacgaatttcagctgcccgttcataagccatactggcagaggcatcttccatccgcttcatcaataactgttttgcgtggccaacattgccattcaagaacgacttgattcgtttaatctgttgatcataaacttccgttggaactactttgaagcaagctcccaaacattgtcccatatggtaatacaaacatggtcggttttgaaatccgttacagcgtcgcagaggatacactttttgtaaaaagttgacggtttcttcagccgcatacacatttgggtaaggaccaaaataatagccgccatcttttaacagcgaattgacgattttaatctgtggatcacgttcatttgtaattttgatgtagggatacccattgttcccctgttttaatttaatgttaaagtatggccgatgtttttgaatcaacgtaatttcaagtaaaaaggcttctttatcagttgacgtaataattgtctcaaaatcggcaatttcagaaaccaatcgagccgttttgccctcatggctactcttaaaataagagcgaactcgatttttcagattttttgcttttccgacataaataatcatgccattaatatttttcatcaagtaacagcccggcaagtcaggcagcaaagaaagtttgtgctctaaatattcagttgccacgatagtcacccctttgaaatattcaccataagagtatacctcgaatatatgtttgcttcaatgaatcatactttctacgagtgtcatggcttactcctatcataaaaaatcgaggttagagcaaaaaccgctttgccctaacctcgattcaattccaacgcccaaaatcagctcaatctacacactaccaataatcttgccaataaagtccttggcacggtcgttcttaggatgttcaaacatgtcatccggcgaactgcgctccagaatatagccatctgccataaaccaaacttcatctgccaccgacttggcaaatcccatttcatgagtaaccacaaccattgtcatgccctcattggccagttcctgcataacttcaagcacctcgccaaccatctcaggatccaatgcggaagttggttcgtcaaacaacatcacttcaggattcattgccagtgctcttgcaatcgcaacccgctgttgttgaccgccggacagactgcttggatatgcgttggccttttcttttaaaccaacccgatccagaagtgcgattgctgttttttcagcctcagcttcactcatatgcttaacccgaattggtgccaacatcaagtttttaagaaccgtcatgtttggaaagagattaaagctttgaaacaccatccccatccgctcacgcaagtctaataactgtttactgctaacatgggttaaatctgtcccatcgaatttaacttcacctgacgttggcttttcaaggagatttaagcaacgcaagaaggtacttttaccagccccagacggcccaatgacacaaataacctgccctgatttaaccgttccattgatatcttttaaaacatcggtttcaccaaattttttacttaggtgattaacttcaattacttttttatcctgcatgtttcatcttcccttcatagtgattcaatattctcgtcaaagcaaatgtcatgatgaagtaaagaaccattgcaacgaaaatcgggataacacctcggtacgtgtccgctctaacaatgttcaattggtaaatcaaatcagtaacaccaataatagaaacaattgaactttccttaatcaatgagatgaattcatttccaagagctggccagatattcctgaaagcttgtggtaaaacaacatactgcatcatatcacgcttcgttaatcccaaactttcagcagcctcagtttgaccagtcgcgactgaattaattccgccacgaataatttctgcaacgtacgcaccactgtttagagatacggcaatcatccctgaaatcaatgccggaatgttaataacaaccccaattccaaagtagacaaacatcacttgaaccattaaaggtgttcctcgaatgaattctgtataactgattgctaaaccacgaacccatttttgtttgctgaaccgcattaaagccaggatgacacccagaacaaccccaaagaatgttgatactaatgaaatcaggagggtgtactcaacccctttagcaaagtatgtccagtagtgaaacattgatgtattaacggtgttgactttcatatacttaccagcagctgctaaatatttatcagtgagatgtttcttttggatttgatcaacacttttattaactgcgttaaccaaactacccgaaccctttttaaaggccattgcggccccaacatcatttttattcaaattataacctgaactaatcatttttaacgttggatcatttttaacataggcctcagcagttggcttttcaatccctaaagcatcaatcttgttggtttttaaagccaaaaccagatcggttgacttgtccattcctttaactgttgaattaggaatccgttttttagccaagccatactgcaacgtcccggtctgagcaccaatcgtggccccttttaaattcttggcacttttgtatttattaacatcctttgaattaatcaggaaactttggccacctgagtaataaatcttagaaaaatcaacactttggcgccgttcattggttgggttaattcccccaatcgccatatctgctttcccagtctgaatggctaccaatagtgaatcaaaattcatgctcttcattaccaatttgacgtgcaaatctttggcaactttcttggcaacatcgatatccatcccaaccattttacttttaccattttcattcaccataaattcatatggtggataatcaggactagtcacaacgatcaattccccccgctgtttaactcgctgtaatgatgtatctgcggcggcagcactgctcgtatgccaagcagcaacagttaacagcgccatgatcacaataattgcttgaataattgctttaaaactcttcttcattaactttacctctcccgatttataatacacactaggttacaccttaatcgtaatttatgcaatatatttctataattagttgtttttatacattcgcttcacaaaatgttaaataataatcaaagataagccatcgaaagtgacattcaatgggaattttgctatgattatgacgtaaatagggataaggagatgattcgatgtcacttaaagttaatcgacaagataatttggatgcactttttggcaaatttgctgaaatggatccacgagaccccaaacgtgataaatttctaaagcatgataaaaaagatcaaaataaaaaacgtaaaaacgaggaacgacccaagaaaagtaaaagtaattaaaaatagttcagagatatttctcttcaaaaagaggggctgagataaaagtgattttgtccagcccctctttttgtaatcacgattattaccaagcgaaaacgtgagacaaaaggcaacttccggccgtacaaccgaattatccaattgtactctggaagttacccgccttttgtcttagattgttttgtgaccaatattgattgtcgaaacatcgattaattattctccaagttcattcttagcatttttgatttgtaatctaacctgatcaaaaccggtcccgcccagtgaatgccgacgttcaacggcaacttccgatttgagatcatgataaacatccttttcgattttcggagaagccgcttggagctcagttaacgacatatcctgtaagttttggtgagtttgaattcctttaagaaccagttgaccaacaataccgtgtgcctgcctgaatggaacccctttggctgctaagtaatcggcgagttcagtcgcattggaaaaatcattttcggttgcctgtttcatccgttcaacattgggtttagcggtcttaagcataccattgaaaaccttaagagatggcagcaaagtcttaaccgtgtcaaacacgccttccttatcctcttgaagatccttattgtaagctaacggtaatgatttcatggtcgtcaataatccaatcaggtgtccatatacgcgaccactcttgccacgaatcaactccgccatgtcggggttcttcttttgcggcataattgagctaccagtggtataagcgtcactcagctcaagatacttaaattcgtgactcacccaaagactaatttcctcacaaaagcgggaaagatgaagcattaaaatcgaactgttgctcaagaactccagtgcaaaatcccgatcagaaacagcgtccagtgaattggcgtaaacttgaccaaatcccaattccttggccgtatagttccgatcaattggaaatgttgtccccgccaatgcagcggcaccaagcggcataatatcggtatgctgcatgttaaacgtaaagcgttctttatcccgctttaacatttgataataagccatcaaataatgcccatatgaaataggctgtgcatgttgtaaatgcgtatacccaggcataatggtttcaacattttcttcggccatttcaacgagcgtttcctgtagtgtcgaaatctcatcaatcacttttggcagtcgcttctttaagtacaaatgaaaatcagtggctacttgatcgtttcgagatcgagccgtgtgcaatttaccagcaaccggtccaatccgatcagttaaaatactttcaatgttcatatgaacatcttcgttttcaactgtaaacgttaacttccctgcatgtaaatcagcctgaataccttccaagcccttcacaattttggcaacgtcgtcggcactcaatatctttgtatgctcaagcattttaacatgcgccaacgatccttcaatatcctcatcagccattaattgatcaaatgaaattgacgcaccaaattcatctacccattttgaggcttgagcttgaaatcgaccaccccatagtttctttgtactcatctattttttagctcccgtatgtgctgaatacttttcctgaacggttaccttagcctttgattgtaacttggtaactgctttaacaaattgtgattgcttgtttttaagctgaacctgtgaataaacctgagttggcaatccccaaagtttgatgaatccttttgcagcttcctgatcaaaggagtcggaagccgtgtaagttgccaaatctttgtcatagagtgacgagttggattttcgtcccaaaatcatcacgttacctttgaatacttgtaatttaataacaccattaacaacttcctgagacttatcaataaaggcctgaagtgaatccattaatggtgagaaccaaagcgcattataaacaagttcactaagttgcttctcaacaaccggcttaaagtgagccaaatcacgttcaaatgtcaaatcttcaagttctttgtgagcttttagcagaacagttgccgcaggtgcctcataaacttcccgactcttgatccctacaagccgattctcaatatgatcaattcgcccaacaccatgctcgccagccacctcatttaattcctgaataatatcggcaaacttcatctgcttaccatttaattcagttggaatacccttttcaaacgtaatttcaatttctttaggttgatcgggcgttttatcaatcggattagtaatcgcaaaggcatcttccggggcactttgccaaggatcttctaaaatgccggcttcgttagcccggccccaaatattagcgtcaattgaatatggtgaatctaaatcaattggaattggaatattgtgttcctttgcatattcaatttcttgttcccgtgaccaatgccaatcacgaactgggcttaaaacttgaagttgtgggtcaagtccatgaatggcaacttcaaatcttacctgatcgtttcccttcccggtacaaccgtgagctacagccattgcgtgctcttgatgggcaacatccacgagtgctttagaaattaatggtcgtgaaagcgctgaaatcagcggatatgatccttcgtacattgcgttggcttttaatgcaactgccgcataattgtcagcgaagtcatccagggcatcaatgacatatgctttaacggcaccaacattcaaagccttttgcttaataaagtcaagatcttttccttcaccaacattaatacagcaagcaacgacgtcgtagcccttatcatttaaccatgcaattgcaacagatgtatccagaccaccggaataagctaaaattactttattattttctgtcatatttttttacctcgtttttttaatttcaatacttaagagattaacaccaatattcataaattacaaccttttttgttttttattcatgatatttcaaaaaaatatgtttaatatacatttatgggctaatattaataattaattgaataatttgtgtgtcattttctgaatgagaacaaaaaatggagccggacaaaattacttttgtctcggccccgttaatattaatcaaaccaatattgttactttaacgctgacggataccgctgctttaaacgcgcaatgttatccgctgcaacttcatcaaatggaatatctgcccattcggcaatctgtgatagataccaaagaacatcgcccatttcttttaccaactgatcatgatctaatttatcactttggaaagtatatttacgaattaggtctgccacttcgccagcctcaccggttaggccaagggcgcaatttgtcaatacctgctctttgcccattaatgtccgattcgctgctttctgataatcatcaaaatccattccgctacattctcccttcaatccattgccagacttcattcttcccctgcttagtgagggatgaaaacagaactaactgctcattggcatccaggcttaaagattgtttaattaatgattcttgcttattccatttgccacgggaaattttatccatctttgtggccaccgttaacgtcgggattttataatacttcaaccactcgtgcatcgaaatatcatcatctgtgggcgcatgacgaccatcaattaacgcaataaccccctgcaactgctgacgcttagtcaaataggtttcaatcatttgcccccatttttgtctgctggctttggaagccttggcgtaaccataaccaggaacatcaacaaaatacaatttgtcctcaatgttataaaagttcagcgtttgagtctttccgggctggcttgacgttcgcgcatacccccgccgattaatcaaaacattcgttaaagaagatttgccaacattagaccggccgacaaatgcaatttctggaaactgagtattaggatattgtttttcagcaacagcactaatcgttaaatcaacattatgaacatccatcagatcacctctttgaattattttttacacacttaactgctacctaaattgatcatttttaacttatcattgaaagatgatttctcaacccttaattagaataacaagaagataaagagttacaaaagttgttttaaatcatctcatcttccgatagtctggttctgccttgaaaaccaaacatcttccaacttgtttcctaattaccgtaattattattactttatttttaattaaacccctattttaggcaaaaaaagaagtctgatgcaaactaactatagcctacatcagacttcaaaaaattacgatgccttttttaaaatcaattccggttctttatgatcagtcaccgtttccggcgtaataatcacttttgaaacatcattgcggcttggcagatcaaacataatatctcgcatcacaccctcaataattgagcgcaggccacgagcaccagtgtctcgagcaatcgccaattgagccatcttttgcaatgcttctggttggaattcaagcttggcgccatcaagttcaatcaacttttgatactgcttaacaagcgcattcttaggctcagttaaaatccgaaccaaatcatgttcatccaacttatccaaagcagttaagattggaagtcgaccgatgaattctggaattaacccaaacttcagcagatcttcagggataacatcctgcatgatattattatcatttaaatcaggtgcttcatcagaattagtcccgaacccaatcgtcttgtcacctaagcgactcttaacaataccctcaataccatcaaacgcaccaccaacaataaagagaatgttggttgtatcaatttgaatgaattcttgttggggatgctttcgtccgccctgaggtggcacattagcaatcgtgccttcaagaatctttagcagtgcttgttgaacaccctcaccagaaacatctcgagtaattgaaacgttttcggactttttggcaattttatcaatttcatcaatatagataattcccttttcagccttttcaacgtcataatcagcgttttgcaaaagctttaaaagaatattctcaacatcttcaccaacataaccagcttcagttaaggttgttgcatctgcaatcgcaaatggcacattaagaattcgagctaaagtctgggccaggtatgttttccctgaaccagttggaccaatgatacaaatgttactcttttgaagctctaactcatcattaggttcgctaatcatttcattaactcgcttataatggttataaacagcaacagaaagtgtccgttttgcattatcttggccaataacaaaggcattcaacttatctaaaatttgagctggtgttaaaaccttcaacaagtcttgagaagtcttttcaggtgcaagttcttcatcaataatttctttgcatagatcaatacattcgttacaaatgtatacgcctgggccggctacgatcttcttcacttggtcttgggttttcccacaaaacgaacaagtaatgggcccgcttgattcgttatcttcaaacaatttattcactcctccataagagttggaagttaatgtatgcttcaaacagagacaacgcttgtctcacattttttcttacataaaactaacttgtttaactatgtcaaaagtatcttccaacatggtttaatcaactatacgtactttatcatataacattaaaaatgcaattagaaggctttcgcccgaaaaaaaagacccgtcaaaataacggatctttcaaaggaaaagaactatttttctgaactatcttctttttctttatctgaatcgttttcttttgctttagcatcttgctttgaagcatcaacaattaagtcaattgctttcttaatggcaatatcatgttttagcatatcatcagttaaagctttacgaacagcgtcttccttcatgccatattggccagcaagatccttaacttcagccttaacatcgtcttcacttggttgaatcttttctgcatcaacaattgcttcaagaaccaagttcgttttaactcgacgatcagccccgtcagagaactgtttcttcaagtcttctggtttagtaccagttaactggaagtacatctgttggttgattccttgttgttgcatgccagcaagatattgatccatttgacgttggatatcttcatccagcattggttgaggaatgtccttaacttcggaattgtcaacagcttgactaatggcagcatcctcaattgcatcgcgggcatcgctcttcttcttatctttaagatcatccttgatcttttctttcaattcatcaagactgtcaacatcttcgtcaacatcctttgcaaagtcattatctaacttaggtaattcctttgtcttaacttcatgaatcttagtttcaaagacagcatccttaccagctaattccttagcttggtaatccttagggaaggtaactttaacttcgacatcgtcaccagccttgtgaccaattaattgatcctcaaatcctggaataaacgagtttgaacctaattctagggaatggttctcagccttgccgccctcaaatggcttaccgtcaacttttccttcaaagtcgataacaactgtgtcacccttttcagcagctttaccttctttaagtacaagttcagcttggctttcacgcttcttttcaagttcagcgtcaacatctttttggtaaacacgagtgttttgctttggcacacttaatcccttgtaattgccaagtttaacttccggcttaacggttacattagctttaatgacccatggtttacccttttccatagattcaacgtcaatttttggttgatcaactggttcaatatcagcatccttaactgcctttgaatattcatctggtaacaggatgttcaaagcatcttcataaagcgcttcttcgccgtacattttgttaaaaattgcacggggaacttttcctttacggaatcctggtactcgaatattctttttattctttttaaaagcttgatctaatcccttactaattgaatcggtatcaatttcgaaagttaattcaccatcgttggtacctttcttttcccattttgcagacattctttttcctccgagacgaaaagattattttaatacaattcataattgcataacattgttattttaacgtattattcacaaaatgtaaaatatatttcaacattatatgctgaatcaacaaaaaaagccatggggaataaatcctcacagcttggcttattactggcgtaaaaagactagtccttaacgtcactaacaataccggcaccaacagtatggccaccttcacggatggtaaacttagtacctttttcaatggcaactggcttagttaaatcaacgttaaatgtaacgttatcaccaggcataaccatttcaacgcccttttctagttcaataacacccgtaacatcggtagtatggaagtagaattgtggacgatagtttgagaagaatggcgtatgacggccaccttcttctttagtcaagatataaacttgaccttcaaacttcttatgggtttgaattgaaccaggtgcagcaagtacttggccacgaacaacttggtcacgatcgatacctcgaagaagaacaccaacgttatcgccggcttgaccttcatcaagagtcttacggaacatttccaaaccagtaaccgttgacttcaatgcttcatcattcaaaccaacgatttcaacttcgtcgccgactttgatagtaccacgatcgatacgacctgaagcaacagtaccacgaccagtgatcgtaaatacatcttcaacaggcattaagaatggtttactatcgtcacgttctggagttggaatatattcatcaacgatatccattaagtcaaggataacttgttcttgttccttgtcaccttcaagagctttaagagctgatccacggacaacaggaatatcatcaccaggataatcgtactctgaaagtaattctcttacttccatttcaaccaagtcaattaattcgtcatcatcaactaaatcagtcttgtttaagaatacaacaatataatcaacaccaacttggtgagcaagtaaaatatgttcacgagtttgtggcattggaccatcagttgcggcaacaactaaaatcgcaccatccatttgagcggcaccggtaatcatgttcttaatgtaatcagcatgtcctggggcatcaatatgtgcgtaatgacgcttttcagtttcgtattcaacgtgcgcagtgttgatggtaataccacgttcacgttcctctggagctgcatcaatatcagcatagtcttcagccttagcaagaccttttgaagctaataccttagtgatcgcagcagtcaaagtagttttcccatgatcaatatggccaatagtaccaatgtttacatggggttttgttctttcataatgttcttttgccattaatgaaacctcctgttgttttcaagaattacatcaattcgcatcaatgcatttctaattgttattatactacatcttctggaaaagacaaagcagtcaattttcgaagaatccttaagtattatatcggtacttaaatcgtttgtaaacagattcttccttttttcgcaaaataatttattcaaatcattttcattttgctttcctgctcatgaatctgatcaatccatgccaacatatcccgttcagacgaactgtttgcttgaagccgttcgccaaacaattccgttacaaccgccctaacccaataatgcggatctaaaattatcttatcgaagaacggataaatataattactttgagtaataatttctcgttccaaaagttgtaacttaattggatctgttgcggcatatttacgatcaataatatcaagcatcgttgttaatgatgggtagcgatcgatcgttcttaattgtgtcagatcaattttataaatttgttgatccaaccaacttaactgaactgtcccgccaatcctcagtttcattaactgaactaaaatttgagtttttgagacttgccaagtaaatggatctgccagcatcgcttttgatgcaatcaaatattccttcaaaggcaggtacaaagaatcattaattgtatgaacttgattataagccgggaggacaccgatatgagccaattttctagttttggcatttagggtaattgggttcttcaatcgatatgcctgttcaactttatcaatttgtttgagccacaagttttgatcttttaaagctgccttagctgcaatttccctagcaaaaataaacgcattgttttttaatgaaattgccaacatcgcctgataattacgttggtttgataatagttcttcttgaaattcaatcataattttttgagcttcagcatatctgccaacccagtacaatgccttggcccttaaaaaattagctgaaattgaatccggatatttttctaacaatttttcggttttattaataacctgcttgaagcgatgatcatcaaagtcttctcgtgcactcatcaatataatttgatcgtttcttttgaagttcatcatggcccccttgatcccactcattactattttaacagctcacaaaccatattaagcagttgccaataatgcgaaaaggctaaggcaaaagattaactttgccccagcctttcaatatcgtcagaaagaaaccagcataccattatttttaactaacttataagcaacagttgcgctttaactgatttcgatgacgctatccttatttatttgctgaatctttctgatgtttcttagccgaacgtcgatgatgttggttaacttccataataaccggcaaaatgactggacgtcgcttagtttgcttatacaaatagtcacttaagctatcccgaacatcctgtttaagattactccaatcaaactctttatgttcaagattattagtaaccgttttttcaataattccggcagcttcttgcatcaaatctttattagcttttacataaacaaacccacgagatgttaatttaggctttgaaacaattcgttttttcttacggtcaattgtaacaaccgcaacaaaaataccatcttctgaaagcacttttcgatcacgaagaacaatattaccaatatcaccaattccgattccatcaatcatggtatccgcaagtgacacactcccactcaaccacatttcatctttattaatcgaaataatgtcacccttatccggtaacgcaatttccttgtcagtgtatccaatttgtttagctaattgggcatgagactccatcaatcgatattcaccctgaacaggaatgataaatttaggccgcaataaatttattaagagttggagatctgcttgactagcgtcaccagacgaattcatttcgtcagaaatcatcttaacttcaccgtctgcacgataaaccatatcgcgggtcttggcaacttgagtctccatcgccgttgaaggtgtcgtcgtaataaagactaagtcattaggctcaatattaatatcgctctgctctttgttggccattctttggattgctttaattggctcacccattttaccagtctgaataataacgactttatctggcgccattttattaagctcatcaatcgaatcgatcaataaatcgtcttttggtaatttaagggtgtttagccgcatcgccgtcttaacaatccgctcaaggtcgtgccccgtcaaataaacccgtctaccacatctggcagcggcattaaaaacctgctgcatccttaaaatattagatgcgacactggcaacaatgatccggctatcatgatagttaaatgtatcataaatatattcaccaatcttcttttcagaagcacttggattcggattttcagcattccctgaatcacttaaaagggctaagacgccctcatcacctaactgagttaaggcagaataattagtttgatacatgggtgctgctgtttgatcaaacttaaaatcacccgtataaacaatcgcaccatcagctgtatgaatggcgactcccaatgatccgggaatcgaatgggttgttttaaaaaatgttactttaatatcatcaaaatcaatttcactacgatcgctaaccacgtggaagtcatcaaaactctttggtttttcagagtcagcaacattcaacttggcaagttcaatcgtcatttcagaaccaaagaccgggacatcaaattcacttaagaagtacgatatcgccccaattgaatcagcgtgaccgtgggttaggaaaacaccaacaattcgatccttattttctttcaaataactgaaatcaggaattacaacatcaattcccaatagttcattttcagggtattttagaccgcaatctaaaatatagattcctccgttgatgtcaaccgcgtacatgtctttaccattctcacggacaccaccaatgggcattacctttatttcgtttttcatgtttcacctcaaaaaataatttagatctttttaaacgttcggattcagctgttattagtttaccatatttttaatgaatacccgaacttttaaacaaatattacttttcgggtggtcaaatgtataaaaaaagaaccggatttctccagttcttaaaaattttaacgacgtaatcctaattcagagataagatcacggtaacgtgcaacatctttattacgtaaatatgcaatcaagttacgacgatgaccaatcttcttcatcaagccacgttgtgaatgataatctttacgatgagttcgcatatgctcgttaatttcattaatatcagctgtcaaaattgcaatttgaacttcggttgatccagtgtcgccttcgtgacgaccaaacttcttaataagttcatctttttgtgcttgtgtaactgccataattaaataaccaccttttctaaattaatccaacaactgagttagcggcaagtggtatccgacaaactaagttgaaggtctatcaacacacaaaaaatagtataacggatttcagcaactaatacaagtgattcctcgcagatccttaccagttttgcttgcaatcaggtcatcagttttgtataatgatgcttgttgaaatttattatttttacttagaaaattactcggaggtgaatcaaatgccagtcattaaatctgctatcgaacgtgttaaaactaatgaaaaagctcaacgccgtaacgctgcccaactaagtacttatcgaactgctgttaagaagttcgaaaaggcacaagttgctggttcagacgacgcaaaggatttatacattaacgcaatcagtgcaattgatcgcgcaaagtcaaagggattaatcaaagctaataaagctgcccgtgacaagtcacgattaactaaaagattagccaattaaagttcttccagttgttagttcttctaacaactttttttatacccttatatgacaatttccaactaaaaatgattgctgacctttgccgataaataatcggttaaaagatcagcaatcatttttttgtgagattaagtttcttctagaaaaacatattttccctatccactggtatcacgtttgaatagtcctgtaggatttcaatagcagttacccttgctttttcatgaactttaagataaaaagttcaaataataattctggtgaacgactagtcgacttcatttcccgttcagtatctacaagcccaacaaaagcttctcgtaattgaacataattaaatttacgaatcgtttgcaatgccaatttaacacggtatggatgaacttttaaggttgatgctaaacttccttgagaataaccgtgtttttgaagaatcataacctgtagcaataatcgaaactgttgaatcaagacagcattaatttgaattggttgactattttctaaaatcagctgttgatagatatccatagattctttaggctttttcttcaaaacactgttgaccaagtcaaacacattttgttccagcgaccgactgaccaggccgttaacggcagctacatcaataaccttagtatcatttttatataataatagctttggcagatcattcatcatagcagtcagttttccaccggtcaattgcaccattcgttctagggcatcctcatcaattttaaattccttttcactcactcgttgacgaatcaattgtttaatttcattttcacgcaaccggccaatttcaacaatcgttgccacccttttcaaagccttagtaactttttttcgagcatcgagcttctcgtatggcgcaaagaataccatgattgttgaatcctctggatgatttaaataagccagcaagtcatccatatgatgctcaaccttggttttaactcgcattccggtcaaaaaataaggtcggttcacaataaccagccttttttcaccaaaaaacggcacagaaatagcgtcttcaagtgcagttgaaatggaaacgtcctccatatcatagctaccaatattcatggctctttcaccatctggaattaactgaacaaaagcgtttctaatttgatcagctaagtaggcttgatcgcccagaattaagtaaactcgatcaggattacccgatgttaactgctttgttagttgttcgaaattcatttcattttcccttcattaccaccttgaactgactcgaagtgacctttattaccacagtatatatatcttaccatacccattgtttgagtattagcaacactaatatgtgcttgcgcaagggttaccagtgtttcttgatttggatgatgatagcgattatttctcccggcagaaatcaaagcaattttggggtgaagctgagaaataaaccgtgggtcagatgctgtccgactaccatgatggccaacttttaaaacatccgtcgacagaccaggatgccgattaagtgtgtccagttctccctgtcgatcaagatctccagtaaatagccaccttaaaccgccaagttgacaacttaaaaccatcgaatcatgattttcacctctcccagaactgtaaggatgtaagatcaaaaatggtaattctcggaccttcatttcatcattgaccggaattactttggtgctggcatctcgatcagaaattctggccataaaactggtgtttttatccatccccaacggaatgataatccgcttgattttcatttctgaaatgtatgccggcaaatctccacaatggtcagcgtcctgatgactcacacagagattatcaattcgtgaaataccaatacttttgagataattaatggcaattcgtgtggcttgataatttaacgttcctctttgccagtcttcttgaccaaactgaacccgcccgcctgtatcaatcaatgtaactgaacgattaaagggtttgcggattaaaaagctgtcgccctggccaacatcaaacattgtcacttcaccgttaattggaaaatggatccaccaaaacgcagccagataaacagaaatcaaggctgttaaaataattgctttcactcgaccagttttgagaataagtaaaagtgttagcaggagcataatcaaaattaccaacaaacacggttttccaaaaacaatcatcccaggaagggctccgataagattcagggcatcgttgaacagccttaaaacaaactcaattggtgcggcaaaatcaggattgagcaaccccaatccaagaccaacaaataccaacggaaaaatagcctttccaaataacggtagcacaataagattgacaacgacacttaagaagtgccactcatagatatgaaaaagtaagattggcaccgttaacagattcaacagaactgtctgtttcacgtatgataagttagttgatacgatcaatccaaatgatagcgcatagctcaactgaacccccatcaataacattgcctccggatacagcaacaaattgatgattagcgtcaaactccataaatcaagttgcgtcaagtgacatttaaacaatttgttgacgatgccaatggccgccatcatgactgcccgtaacacgcctgccgacgcacccgcgaacacaaaatagcccacgagacaaattaattcaatgaatgcctgcttaaacttccccaatccaactaagttcattaattgattaataatgatcaagaaataagtcacatgcatccctgaaatactaaatgcatgtaacaggccaagttgcttaaccccagtcatttcattaaagaaatcgttttgcctggtaccactaattaatcccattgcatacattcgcaaaacattaggcagcttttggcaatacctattgaacgaacttcgaacaacgtgaattcggtcaaccatcgataactgtgttttcggaatgattgaaacaatgttgctagctgtaaatacttggacgatcttttggtgatgataataatgaccgacgtcaaattgattaacattggttgccacggaaaaagaaccaaaatcaccaatcattttgaccaacaccggctttgttgaggccaataactgttgcttttgatcgctcgacttaaattgaccatagtaaacagccttgcgatgagttgctgacgaaattgcaaccaaattaaaccgatcaccatttgtatttaacatatctggataaactttgaccacttcagtccgggatcctttaacggtggcggtcgttaattgattttcagttattccaacagccataaagaaaccgatcattgtcaaaccacaaacaatcaaaatccgatgataatccaagaggaagacccttaggatcaaaattgccaacagtataccaaatatgatgcgattactataaataatgccacttaggagcaatatcgttaatgctggaaaaatcagccaatttttaatgattaatcagataaataggaatcaaacggaacctgctgcatgtccgtctgagttaatgtgattttattgagttcaatattctttaatttgatgagcttttgagcataatcatcgttatgataatttcgcaagtaattaattttacgaataccggcttgtaatagcatcttggtacattgcagacatggaaaatcagtgacataaatctctgcattatcagtgctttcaccaaattttgcgcactgcagaattgcgttcatttcagcatgaattgttcggacgcaatgaccatcgaccaaataacagccaacatcaatacagtgatcatcaccagcaaccgacccattgtaaccaccagcgataattcgcttatccctaacaataacggcccccactgataatcgctcacatgtgcttctcgacgctaataagaccgcttggagcataaagtactgatcccatttgattcgcttatccatatatttcaccttccatgatgtaaatcatatctcaaaatcgtcaattcagctacacacaaattgatgattttaggttatcgaatgttttgtcaccaaacccaggaacatcctttaattcttcgatccgtttaaattgtccatgggcttgtcgataggcaataatttgatctgcctttttctcaccaataccatttaactcttgcagttttgttttgtcagctgtgtttaaattgatctgctgctcgtttccagaagatgcagtcgtaacgtcttgggaatcaccggtttgactttccgacgtcgctgaagctgccgaagcctgtgggccgggattggttgaagtaacaggattgcctttcacttctcccctaattggaacgtaaactacctgctgatcagataacttttgggccaggttaatgtgcttacgatcagccgaatgattataaccgccagctagattaatcgcgtcaacgacccgcatattagcattgatttgataaacgccaggatttttaacggctcctttcacatcaacatacatttgctgattggccgtactactacttggctcaggtgagcgggagccttcctcagttgaggcaaccgaagtcgaagacgattcgctagacgagattgaattagcaaaaccattctgatcatctagtgtcgccgctgactgtcgatgaaaagtcatcactccaataataatgatgaaaataacaattactgatattaagccaataagaacctgattaagatgctcatcaatatattcccgaatcctattcatactgttcctcccttctaaagtataggtacgcaaaaaaaggttaaaactctttggatagttttaacccttttcgctaatttcgtgttttaaattgatgatccgattactggcttaagtaaaacatcttaactaccacttagtttggacgactaacaattaactttgattacttcaaattaatccttactttgtctggatttgctgcagtgaagaaacagcctgagaaaagctcttaacaggaataactttcattgaaggtgcatattttttggcagtggctttggctaattggtaattggtctgatgaccgggttccaacttcaaaatcgattttgtaggtttaatgtaaggggcaaggaaaatttttgcgccattctttttagcggcaatgattttcttatcaattcccccgatttcaccaacgttgccttgagcatcaaccgttccagttccagcaactttttgaccatgacgtaaattggaattagtcagctgactgtaaatctgaagtgagaacatcagaccacccgaaggtccacccacctgtccgggattcaccttaattggaaccccggttgtcactttgacatcatctgttagcgttataccaatacccgctcgatgcttggcaatcttaattaacggtgcagttacttgatgatccttgccatttcgtcgatactcaacggtgactcgttgccccaatttttgtttcttaacataattgacaaacccattcgaactattaaatttatgatcattaatcctaacaaccacgtcgccaacttttaaccgatgataaaacttggacttcttctgaatatcaagcacgtatatgccgttatacgtccgcttaactgattggtgagcatgcttgtatgctgtataaattgcttcgccaatcgagctttccatataaaaatgttgaaccttatcatattctttcatgtcctgaccagccgtaatactctcgtctgactcaacagaataatatggacttaatttagcatatagatatgtaaccggtcttgcctgcataatactaaccgaggtcagcataaacattcccttatgcttgtcagggtgattcttaattgcaacaattttacttaaatcagaggcatcgccaggtccttcaatataattaggcaatggccaaaaaagccccgctaggaaaacaacaagcgcaattcccaggagtacatattttttatatccagtttttcgcataatccaccaactctattattgaaatttagattgtaacgctatcgcaacctgttcagggacaaaatgactcacatcaccatgaaattttgcgatttctttaatcatgctggatgaaaagtcacgataatttgccgctgttgggataaaaatggtttgaattctggcatccaattgctcgtttaatccggcaattgcaagttcagagtcaatgtccgagctgccacgtaccccacgaattaaaacgtcggcccccatttgttcggctaaattaacggttaattcatgcgaagaaataacggtcacatttttaaaagcctgcaacgcttcttttgcaaaacgagtccgttccttgattgaaaagagcgcgtgtttacttgtattaatgctaattgcgacaattacacgatcaaaaattcgacttgcacgtctaataacatcaacatgtcccaaagtaatggggtcaaaacttcccgcatataatccacttgtcattgcatattctccatttgatagttataaataaccagattagttaatccataattttttctttttatggccttgaactgtccatcttcagtcggtagatcggtttgattgtccgtttcacagatcactacggcttgatcagatagtaactttaattctgctaataacgataacgtatcaataatccgttgtttcttatatggggggtctaagaataccatatcgaaggtcatctgatgatcagctaactgttttaaaaccgtatcagcatttcctttaataacttcaaactggtcttgagcatgaattttatcaatattttctttaattgccttgatggcttgaaattgacgatcaactaatacggccttactcattcctcgggaaactgcttcaatcccaaccgcgccagatcctgcaaataaatcgagaaagacaccaccattaaagtatggccctgtcatactaaataaagactcttttactttatcagttgttggccgtgttttatcactcttaaccggacttaatcgaataccgccatattcaccagatacaattcgcatcattcacctcgttaattttcaaaatcttcatcaaatcggtcatcatcatcttgcccgttagagtcattatcagctaccttacttaaaagctcattcagatgggagggcacaacctgtttaacgtaattttgagctgttaactttttaattacctcatcctcttgggttaaattgacatatagcagcgcataccgcattctcttggaaacatagtatagccgaccaaatgatcttagatttcgagaatgtttcaaggaatgtaaataaacaatcaatccttcagttggttgaatttcaaatgccaatggcccttcatctcctttaacttctatcttacagcggctattttcaattcgtggcgtgcctgcttttgccgaccactaatgtttaatacaagacctaagcaaagggaaagtgttaaaatgctagatcccccatagctaataaatggaaaagtcacaccggtaattggcaagatgcctaagacaccgcccatattgaacaatgcttggatggtcaaataagttgcagtaccatagcagatcaagctttgatacgtatcattgctccgaacaccaattaaaacaattcgggtgacaatcagagccagcatcgccaaaacacaaactgctgcaacggctcctaattcttccgtcaaaattgccattataaaatcagtattcggttctggtaaataacccgttttttgaatactgtttccgagccctaccccaaacaaaccaccgttactaatcgcataatatgaattaaccaattgttggccagcaccagttgcatgaccaaatggattggtaaacgcgattattcgctgtagctggtaagaatcacttacttttgataatggcaccaaaacaaacttgatgattgcagcaatcagtgcaatacagccaaaaatacctgccaatccctttttccacgaaataccactggtcatcaaaatgatgaaagcaatcgcaaaattgatcgcagctccaccagcatctggttgcatgaatattagtaaaagtaaaattgttgttctcaccatagtgggccagagctcatgccaccaattttgtgaagataatgaaataatatcctgcttttggtcgataacattagctaatcgaataatcagaaagaacttcacaaattctgcgggctgaatgctaagaggtcccagtcgaatccaaccagcggccccattgattgtttcgccaactaataataaatagcacaaaataacaaacaaggcaatttcaaatcccaataaaagcgttttgtcacgtaacttattgatatttaaagccgtcatcatacaaacgatcacaaaaccgattccagtaaaaattagctgtttaattaaatatccaaacggactaccaccattttgaacaccaatgttggcactggccgaatagaccataattactccaatagtactcataatgagataaggaataaaaattaaataatcaatatttcttaagcggttcattgattccactccaatttatgcgcaatatgtaaatgcattggtttacattatagcataaagtaagttatcgtccttgtacgccttaaagaattaatcgagtcttaaaaagaagtctggttagctataccatttgacaaaatctttgtttctaaagctcacctttatcgataaattattaacataacagcaaaaaagccaaccacaaatgtagttagccccttgttaatgttcttatttattttaccagtcatcagttgttgaaaaagagtttgccgataatcaagaaaggataactaacgtcagtactaactaacaagtcagtcatgttttagttatgcttctttcgcttggcatccttttcacgtgaattagtgttaagaatctttttacgaagacgaatgaaatgaggtgttacttcacacaactcatccgtattcaaaaattcaagtgactcttcaagtgataaatgagtaggtgtcttaattcgtgccatatcatcagaaccagcagcacgaacgttggttaagttcttaccttttgtaatattaaccgtaatgtcattttcacggttattttcgccaacgatcattccttcataaacttcggtacctggatcaatcaataaggtaccacgactttcaattcccatcatggcataggtggttgccttaccatcattcattgaaaccaaagttcccttggttcgaccaggattccagcctttgataactggtaggtacttctcgaaagtatggttcataatcccgtagccacgcgttaatgataagaattcagttgaatatccgatcaacccacgggaaggtgccaagaaggttaaacgagtctgaccattatcggtcgtttccatattttgcatttctgcttttcgttgtgaaagcgtatcaataattgaacctgtatattcatcaggtgtatcaatctgaacagattcaaatggttcactcatttgaccgtcaatttcacgataaataacttccggacgtgatgcttgtaattcaaatccttcacggcgtaatgtctcaattaaaattgacaaatgcaattccccacgaccagatacagtccatgcacctggttggtcagtatcctcaacccgtaatgaaacatcagtatgaagttcacgctttagacgatcacccaactgacgggcagtaacaaacttaccatcctgaccggcaaatggtgacgtattggttccaaaagtcatttgcagtgttggggcatcaattcgtaaaattggcaaagcttcaggagtatgaggatcaaccactgtttcaccgacattgatttcttccataccagaaaccgcaatcaaatcgccggcctttgcttcattaatgtcaactttcttaagaccgatgaatcccattaacttagtaactcgaaaattcttcttcgatccatccaatttcataaccgtaacgttgtcgccaactttaatccgaccacggaaaattcggccaattccgatacggccaacaaaatcgttgtaatcgagtaaggcaacttggaattgaagtggttcttcagagttatcaattggcgctggaatatccttaataatcgtatcaaagattggcttcattgtatgcgcttgggtactaatatcagaatcataacttgaagtcccgttcattgctgaagcataaacaactgggaagtccaattgttcctcatcagcacctaattcaataaacaagtccagcacttcatcaacaacttcttcaggacgagcgccttcacggtcaaccttattaataaccacgattggtgttaaatgttgttccaaagcctttttcaaaacaaatcgggtttgaggcattgtcccttcaaaagcatcaacgaccagcaaaacaccatcgaccattcgcatgattcgctcaacttcaccaccgaagtccgcatgtccaggggtatccaaaatgttaatttgtttgtccccatatttaacagccgtattctttgaaagaatggtgatacctcgttctctttcaattgcgttcgagtcaagagcccgatcctcaatttgagtatgtgcggccaaagtgtctgattgtttcaataattcattaaccaaagttgtcttaccgtggtcaacgtgggcgataattgcaatattgcgaatgtcgttacgtgtttttaattttgtatccaagtcgtttgcttcccttcattaataagttcttaccgaagataacacatcttaatgtattttcatatctatttgcataaaaaaactgtgacaaccgtcacagtatgactattgacttacaattgtaagaatgtctcgatgtgcatttcgtgttgctaacaataccggttctgatgataacacacctaactgctttccgtcaatagttgtcatttcaagtccagcaacatcgcatagaattctgccggccccaaaatcccacggtttcagataagaaatataaccaaccaattctcctctgagcaccgaaataatgtcgatccctgcactgccataaatcctcattcccagcgacttttgagcaatatcaaccatattaaacgtattatgcagcaccaacggtccgctaagcccaatcaacccattagaaagtggcatatcaaccacctctgccaacgggtgaccattgtcaaacacaccaagtgccggcccaccagataacagtcgatttccgatcacgtctaaaatatagccgagaacaccttcaccatcaacgtaaagcgcaatcataattgcaaaatgattgcgctgctttacaaaattcattgtgccgtcaattgggtcaacaatccaaacctgaccttcagtggacacaaccttgtccccaaaaccttcctcaccaagaatacgagattcaggatcaaaatcccgaatctttgaaactaagaactgttcattttgcttatcaatgttggtcactagatccttacgactagtcttagtatttaccgtcaatcgcgtatcaattttccgtaaaacattgtcacgagattctcgcaaccaactcttaaccgttttatcaatcttttttatttcatcaatttccattttttgccccatacaccttaattattttattatcattccggtcagcagtcttgataacttgaaaagcatcgtaaccagactgctctttaaactcacgctccagctgtctttgttccatcttcgaaggaatgattcgtttaaaagcgttataagccgtcataaattttggccgcggaattccagaagaattttcatatgcttcttcaatactctgataaaaatcagtcaaaatcacaatttcatcaacactcaacccgtctattaatgggtactcatattcttgactcatttaaccaactccaatcagttaagtaaacatccatcatttcatagcccgataaattcatgcatagcttaattatagaatagattctgactttgtgaaataaaaattgtcgtgttcaataaataaagccgtgacacctcaaaagagtttttagatatccgtttatatcttgtaagtctgataaaacaaagtcagaaaacagcaagcactcaaatctggtaaataaacgcagcgatcattatagttgtcaaaaaccagagcgggccagcaagcggttagcccccagaatataggccccctgacttgatattcccggttttggaatattaagtcagggggcttatatggccgggggctgcttgctggtccacgttttagctaaataacaaatttcagcaagatattctgaatttaactatttggataatccgattacacgactggaagttgccttctatcccgcgtttttgcctggtaacaatcgtgattacacaaaacgggaccagacaaaattactttagtctcagcctcgatatttctatgaattgctatcctttgaacatcatcctcaacatgacacaaaaaagacccagttagtgaaactgaataaaatcagttttctaaccaggtctaattttaacttatttaaccagcaagctattgataaatcagtagccaacgtattgttatctaaatatgagttgggaagccaagtgcaacatcagcggcttcttgaattggttcgctcaaggttggatgtggatgaattgttaaagcaatatcttcaacgttcattcggccgttaactgccagactaagttcagcaattaaatcactggcacctgggccaacaacttcgccgccaagaattgtcttatcatccttagtgtaaattaaacgaacaaacccttcagcttcatccaatgaaactgctcgagcatttcctgcaaatgggaatttagcagttgcaacttcaacgcctttatccttagcttgtgcctgggtcatcccaacaacggccatctctgggtcagtgaaacaaactcctggaacgccaatataatcattagcagtgttcttgccggcaattgcaccagcagcaacttttccttggaagaatgccttatgagctagagcaggtcctgaagcaatgtcaccaattgcaaagatatgcggtgaatcggtccgaccttgttcatcagtttgaacaatgccatgatcgtctagtttaaccttggtgtattccaaaccaagatcatccgtatttggacgacggccaaccgttaccatgcagtaatcagccttaaccgttgtttccttaccatcaacttcataggtaacactgactgattgatcgtcttgaaccgctttcttagcagttgcgctggtgacaacatcaacgcccttcttcttcaagctcttcaaaacaactgaaaccatgtctttactgaacccagcaaggattgatggtaaaccttcaataatcgtgacatgggaacccaagtttgcatacgcaccggctaattcggttccaacatagccaccaccaatcacaacaaactcttttggaatttccggtaggttcaagccgccggttgagtcaaccactcgaccttcgaacttaaatccaggaatttcgattggatgagaaccagaggcaataattaaattatcaaattgaattgttgtcccggtgtttgttgacataaattgttgtggtccaaccggcattacccgtaattgagtatcactatccaaaacagcttcgccttggataatttcaaccttgtgcttatttaaaagcatcttgacaccacttgtcattcggtcaacaacttttttctgtttccaatcctgcgtctttttgaaatcgatcgttgcgggttgcgtggtaattccgtatgtcgacgcatcatttgcttcttgaaaacgatgtccggcttgaattagtgccttggaaggaacacaaccaacgtttaagcaaacaccaccaagggtatctgatttttcaatcaaggttaccttttgtcctaattcggatgctcggattgcggcaacgtacccaccagggccagctccgatgataactgtttctttcttttcaacatcagccattattcgatcatccctccatcaaaagcatatctggatcatgaagcaacttgttcatcaaattcaaggcgttttgagcaagcgcaccatcaatcaatctgtgatcataacttaacgaaagcttcaacatattgccaactttaatttcaccatcttcaggatcaacatatggttccttagcaattttaccaacaccaagaatagcaacttcaggttggttgataactggtgtgaaccagccaccaccaattgagccgacattactaatggtaattgaaccaccactcatcttatctgcagataacttgttatcataagctgcttgagtattttcagtgatttccttggcaatctcaaacataccctttgcatcagcattcttgatatttggtacatacaagccatcatcagtgttggtagcaatcccaatattgtaataatgcttgtaaacaatttcttgcgtgctgtcatcaattgatgcattaaactcaggatattgtttcataacagcaaccaaagctttaacaatatatggcaggaatgtcaaatgaatgtcacggtctttggcaatttccttgtatctctttcggttagccattaaagcagtcacttcaacgtcatcaaatgacgtaacgtgaggtgcaatatctttagagcttcgcattgacttggcaatgatctttctcatcatcgacattggttcacgagtttcaagttctggctgacttgacttgtatggcttaattgggccaccggttgcttttgcagctgctggtgctggaccggcagctggtgcagctggtgctgcagcgggcgcagcagcagggttaaagttatcaacatcagctttagttacctgaccatgattaccagttgcaggaactgcggtgatatcgacaccttcatcacgagcatattgacgaacagatggcatcgccttaactaatttatccggattagcagcagctggtgttccgccagttggtgcagcagcaaccggtgcggcagctggtgcaggtgctgcctcttttgcgggttcaggcgctgcttcttcttttgccggagcagcagctggtgcagtaccgccggtatctggagaaccatcatcaatgacaactaacacatcaccgacttcggcagtctctccttcttgtttttcaattgatttaacagttccggccactggagaaggtaattcttgaacggacttgtcgttttgaatttcaacaacaggatcgtcttccttaattttgtcgcctggttttaccaaccatgatgcaacttcaccttcggccattccttctccaagctctgggagtttaaattcataagccatggggtctaacttcctttctataccaattagaattttagtagtttaaaatttcgcgaacctttgcttcaatatcatcagcatttggtagccaatcattttcagccattgcaaatgggaagatactgtcaggtgcggcaactcggccaattggtgcatccaatgacataatgtcgttttcagcaattgctgatgcaacttgagcaccaacaccggccatcttttgagcttcttgggcgataactactttatgagtcttatcaattgaagcaaaaattgtagcagtatcaattggtgataatgatcgtaaatcaatcacttcaactgaaatgttctctttttctaatttatcagctactttgagtgcttcatttacttcagcactgtaagcaacaattgtgatgtcagatccctcacgagctacctttgctttatctagcggtactgtatagtgaccttctggaacttcatctttcattgaacgatagagtttcaagttttccatgaacagaaccgggtcattattttcaacggctgagataaccatgcctttagcatcgtatggattagcaggtgtaaccactctcaatcctggaataccaacaaacatgttctcaagtgaatcaccgtgaagttcagcagtatgcgtaccaccaccaaatggtgttctaattgtaattggcatcgaaacgtcgcctgacattctgaaacggttacgtgacatttggccgccaattgagtcaacagcttccattgtgaatcccataaattgaatttctggaattggacgccaaccggttaaagctaatccaattgataatcctaaaattcctgattcagctaatggtgtatcgaatacacggtcggttccgaatttatcttgaaggccttgagtggttcggaacacaccaccatttttaccaacatcttcaccgaaaatcagcgtcttagggtcttcttgtaacacttgatctaatccatcagtgattgccttaatatacgttaatttagccatgattacttcgactcctttgcttgaaatttctcaatgtcggctgctacatctggggttggtacttcaaatgtgtgcttcaagaagtcactaaccttctgcttaggagcagcttcagcatctttcattgcttgcttaaattcatctttatattgagccactaacttgtcttctttgtcttgatcccaaagtttcttgtcagtgagcacttttcgtaatcgaataagtggatctttgtcgaaccatggcttttcttcttccttagttcggtaacggcttggatcatcacccgcagaactgtgggcaccgaaacgatatgtcaaagtttcaactaagactggtccattacctgcaactgcgaagtcacgagcatcctttgcaaccaagtatgttgctaaaatatccattccatcaacttgaacacccggaacaccagaagcaacacccttttgagctaacgtttcagcagcagtttgtgtcttacgtggtactgaaattgcccagccattattttgaacaaagaatacagcaggtgcttggaatgaacttgcaaagttgattccttcataaaagtcaccctgtgacgtcccgccatcaccagtaaatgcataggcaaccgtatctttttcaccgttcttcttgataccaagagcggcaccagccatttgaacatattgagcaccaataataatttgtgggatccatgcacgtacaccacgtcttacatagtcatagcattgatagtgacctttggaccacagataaccctctttaacggttgcaccgtgttggattaattgtggtaaatcacgatatgcagggaatagataatcctgtttcttcattgcgtgagcaattcccatttcggaagcttcctcaccgtaagtaggagcatagaaacctaaacggccttgacgtgaaaagttcattgtttgttcgtgcaatgcacgttcccaaaccatcttttccatcaaattaactaaatcgtcatcgctgaaacggtcaaacaattctttatttacaattttcccgctttcatcaattacttgaaccggtttcttgtatggatcgctcatcgtcgatttgatgtgtccaaaatcaacaacatgcttactgtttgctgccatagataacactttcctttccttgaagctagacttgtgatgtacaaatagatctcttctaaaccacaactcaaatttagcatttttctccgacgtttgcaagcccttacattgttgtgaaaccaagtttttctattgttcatgaaatcgatggaaaatgagagtgaaaccgcgtgggagagtagtgtttgtgaatttcttaatcaatcattaatccagaaccgattcgtttgtaaaacacgctggtttgcaagaaaaatgtcaactcccttttaacgtaaaaatatcattcctaagtttttttgttcctgacgtccttattcaaaagaacaaaaaatctagctactttatcaacatcctaatggaaacaaaaactattaaagatttagtcccaaaaaacactatatttaataggtaacactttaaataaaactttttcaattcacggtatcattgcccatcagctttttccaagcatgcccggtaagatcgctaattaacccaacctcaaccaagatcattgagactaatccgttaaataaaatcaagtccccctttggtcagtttagaaatctttagaatactaagaaacagttcatcaaatttttgtctgacccatcttggaaatctaagccatcagcaaatttttcaaaagtgattcaaagctaggtaagatcgatcattttttcacatgacttttatgacgaattgatgagaagttgttgaaaatactttctgtgattctcattaacaagcaacctacaatcgccaagtttacacagcgaacatagttttttttcgaaaattaggataaaatagtccttagcagaaatttctaaatttattcggaggtacttgaattgtttttaatgaaagatattgttcgagatggtgatccggttcttcgacaacaagcgaagaaagtcgcctttccactcagtaacgaagatcgacaattagctcatgacttaatggaataccttgaagtcagtcaaaatccagaattatgtgaaaaatacaagctgcgagctggcgttggtttagctgcaccacaggttggtgtttcagaaatgatggcttccgttcttgttcccagtgatgatgataatcaaaaagataaaccactttttaaagatgtcattattaatcctttaattgtctccaactctgttcaacgaggcgcactaacagaaggtgaaggctgcctctcagttgataaggatattcaaggttatgttcatcgtgccgcacgaatcacattaaaatatcaagatattagtggtaaggaacataaagttcggttaaaaaattatcccgctatcgtttgccaacatgaaattgatcatttacatggcactttattttatgatcatatcaacaaaaataatccatttgagcgcgaagatgacgaaatttttgtttactagattcatgatttgttgtcattgacaactggcgttaaagagcttgaaaaaggcgcttaactttcagagtaaaaccaaattgtccgaatatacttcaggtagatggtgggatgaatcggttatacgacaggaagttgccttttatctcatgtttccactcggcaatagtcgtgattacacaaataggggctgagacaaaatcaattttgtggctgtacaatatctgttgttggtaatagatttaatctattattaatgacagatttttttgtatattattattgaacaaaaaacgggcatttcctgtccgttcatcaaaaccaactaccacgaaga

SEQ ID NO: 694 - DNA, 4980 bp, Unknown
  Metagenome-assembled genome
ctgaaattcagcttggcaagcctcgtgggcataccaaaccatgtaactgtgaccttcggaaacatctaaagcgatcacatcagacaatttatcgcttcctagcaatttatttatttttgaagttatttgctcacctagacaactaaactcatttcctgtacacggcctcgtaggtcctcaatcttaaaccagcttaaagctgtggagatggcgacgacccttttttattacggactcgaagtccctcagagcatgaacggtctttagcttcatctccagtgtaacgaaaaagatccagttagaagctgatttttatcggcttctaactggatctaatcttagattgtttcgcaaaattctattctgacatgtcaccaatatcttcaagacttgtcttttttaaaactgtcagcatcgcttcttcagcctggtttaacacttttgagctattttcaagccatcggttcacccgatcttgatgcacaaaagcactggtatcaaaatctttatgaacctcaaacaattggccggtgccttcaattgccatcaaaacgtcataaaccgtaatctctttaggttgtttggccaatcgtaaaccaccataaatcccggttttggatcttaaaatgccgtttttggtaagcaacgatgaaatctttttaatgcttggaatcggaatgttcagcttttcagatattttttgaattgataaataatcatactgctcttcttgagacttgataccaacataagccgtcatttcaagagcttgtgaaaatgcgatagaaaaggacatcataggcctccaattatttctttaagtataggctattataccaaatctatcgttaaaattatttcctttccaatggcacaatcaaggttaacactaacagcaatccaacaaacgttaaccctacgccaatcaacatggactgactaaagacagctgatattttcgttatgtttgccgtaaaagcagcaaagattgccagccccaaggcaccgccaaattgccgcgccgtattgtaaacaccggatgctgctcctgacacttcatggcgaaccctggctaatccggaagtcgcaagtgttgcaaaagcgagtgcaaaaccaatcgcatagcccaatgttccaattagtagaagcacatagttggctgaatgggcaacaaccgataactctatcattgacaacaaaacaatcacaaaaccaatcaccattactcgtgaatttccccagcgagcaatcaaatttctcgcccgaacagcggcaataaagagcaggacggccatcggtaccatgccaagagcagtaacaaacgggctaagtccaagggtcccctgtaaaagctgcggtgtataaaaccaaaacccaatcccggctgagctaaacaaaagtgaactaacataagatgccaatctttcccggtccttaaagatttcaaggggcatcgtgggtcgggccacttttccttggctaataatgaatccaatccaaagaaacagtgacaaaatcaatgtcggtatcggccatggactgccatcaaggccataagaaaccgacgtcatggcaaggatggacagaatcgtcccgacccaatcaatttttccattttgggtctctgatttagctaggacttttgcggcaatgatcaccatgataaaggcaatgggtccattcatataaaagccaactcgccaagatgcaaatgtcgcgaaaaagccgccaatgacaagcccaatcgctgcacctgcgccaataaccgacgcatagtacccaattgccttttgtcttgcctgaccctcaaacgtatcagttagaagtgctaaacaatttggtgccagaattgctgccccaattccttgaaatgctcgaaaactgatcatcatcacagcgttagtggctgcgccaacagccaaactaccgattccaaagatcatcaaacttgaaataaacagcgattttcgaccatagatatctcccaacttaccaccaatcagcataaatcctgcataagttaatgcataagaaacttgaacccaagacagagcgctggcgtttaaatgaagctgagcagccatcttaacagttcctgtaaacacaattgaagtatcaagaacccccaaaaaggcaccaattaaagctagtgagagaacgatcctttgaactctggtcattctttgtcttccaaattctttcattgaattagtattatccattattttttctcctttttgaattggtttgtttagtatattctttatatactaatactgcaatactagatttatcgaatttttcacagactgatcatcagaacacattcattcttaaagcgaatatgacagctatcacccaaaatactgcatccttgataatggatagcggtataatcaatcatatattattaattctgaggggattttcatgaaaaaaataattgcaatcgttatcacctgtctcgcgttatcggcaatcttaactgctggtttgacatataagcaaaccgtattggcatcccaacaatcggatcccacggttgccaccaaccagtcagcaaagtccaagcaccactacttactggttatgggtcatggtgctggtgatcccggtgctcatggtaacggaaccaccgaagcccattttttacgggcaaaatttttacctaaactacggaaatacgccaaagaagtcaagaatagccgggtcaccttttacaatcccaaacacgatattgtccgagacactttggttttccataaaggctcgtataagattaacaagaaaacaactgtcattatgtttcatttagacgctggtggcggtgcttatgctcatggcggccacgtcattattcatcgaccgacccctacgaaacgtgatcggcgattggcccacgtcatcaaaaaatacgttggccttaaccctgcttaccatggttatagttatcgaactaatttgcgtaactgcaacgtattacgtcgccgtggtattgactacagcctcgttgaaatgggattcattaccaataaacatgattttaaaaagattaaccaccatctcgatcagattgctaagaacgatattgaggcaatcacccatgaaacaattaagtaactggtaactatcggttatttagtcctaccaaaactgttattaaacacaaaaacagacatttccggccatataagataagcctcctaacttaatattccaaaaaatcgggaatatcaagttaggaggcttatattctgggatctagccgcttgctggccaaatctggtttttaagctttgcttttagcaagatatatttggtaaatcaaccgggttgtctggtcatcatgctgcggatatggcgaattagtcgccgttccataaagagcaccatccaccacattgaccccgattgaatagttacccatcgaagctcgtttgctggcactgtagccattagcattaaggatctcagcgacccgtttaacccgtggtgtaattgcttgaccataactatagtagagataactatcaatactaccgtcttgatgacgattgggattattaggatccttaagatcactaattgcaacaaaatcggtgaaattacgattttggataggtacagttgcagtaatattctcaactgaacgagataagctgatatcaatgggactatttggaaataacttaattaaagccttggttaaacgttggctagaattggaattaatgtagtttaaatactgctgattgctggttattttatctaatggcgtggcaattgcctttgtcaggtagccactccaaacaagccctttgatcttcttattggcagaatagattcgatagtaaattgctcttttacccttaatagtcttggtgaaagcgttagtaacgagccaactggtataacgatagtttttaacgttatgcaattttttggtatgactataattccaaatatcccctttggcatttggcttggtatagtacattaatggaccgtccattaccgaccaactgtaaggtttctttgcttgcgcaactgaagcaatagtgaatatgccacagaatactagcccgaatagaaggatttttaacagttgctttttcataaaatgagcctccagaataaagataaattggttgctttgttaacttccattgtaacgaatgttttgaataagatgtcgttttagaatcaatggtacacccccaactgattatttccagatcaaaatcgggctgttaaatatcgagaaaattgtgattaacagaatcgattttgggtcaatggaacatcctgtggaaagtagcggcaaagttatcaatgcccaatctatccccattgtaatggagatgaagccggcacaagtcccacttattttaattagcaatgcaatgcaccaagttggaccacggaactagtctcggttcaaaagaatctttcacaaaatgtgtctcaaatattgacctcgttccaatttggctcactttagtttggcagttacaagagctacaaacttgttgttcattgaagtgatcacagacaagccataggttttacttccgagaatgaagttagctttaacatgaagaactccctttcatcatgagactgggacaatagtcatttatcccagcctctgttcgtgtaaacacgattgttaccgagcgaaaacgcgggacaaaagacaacttccggccgtgtaaccgaattatccaaatattcaaattcagaatattcggataattcaattacactgttatgaagtgaccattgtcaagtcacaaatttaaatcaggctcatcctccatcaggggcatggataaaccaaggaacataagtctaatcgacagttaaccattctgttattcgtggattggttacctcaggttaatggtccgtcaaaggccttataatctctggacgtggatcataaatttagtgattagctcatacggccaaatatcagct

SEQ ID NO: 695 - DNA, 297313 bp, Unknown
  Metagenome-assembled genome
ggattagtgtggtgatgatggcttgaaggatacacctgttcccatgccgaacacagaagttaagcttcaacgcgccgaaagtagttgggggatcgctccctgcgaggatagggcattgccatgcacatctaaacgaactttggcacctggcattgtgtgtcagggttcggatattggagagttgtccgagaggccgaaggagcagcattggaaatgctgtatacgggttaaagcctgtatcaagggttcgaatcccttactctccgtttcttatgacccattagtcaagcggttaagacaccagcctttcacgctggtatcgtgggttcgaatcccgcatgggtcacttatggaggattagctcagttgggagagcatctgccttacaagcagagggtcacaggttcgagccctgtatcctccattgcaactgaatagttgcatccacaaggatggctcggtagctcagttggtagagcaacggattgaagctccgtgtgtcggcggttcgattccgtcccgcgccactttatggaggagtagcgaagtggttaaacgcgacggtctgtaaaaccgttccttcgggttcggcggttcgaatccaccctcctccattattatagggatatagttaaacggtataactacggtctccaaaaccgtcattgtgggttcgattcctactatccctgctcaactgaatattttggcggtattggtgaagtttggttaacacatcggtttgtgggtccgacatgcgtgggttcgaatcccacataccgcccttttatccaatagtctactaaatgttggatagtttgaacgaaacgttcaggcactatttggtggtatagccaagtggtaaggcacaggtctgcaaaacctcgatcaccggttcaaatccggttaccaccttttagtaaagacttatgcctctgtggcggaattggcagacgcgctggactcaaaatccagttcccgttgagggagtgtgggttcgacccccaccggaggcattaaatattcggttatatatctttactaagcagtcatcagtttttactgatgactgtttttttaatttttagggtctttgtcaaaaatctagggagtttgaggctggtgaatcaatcatcccgcccgaaatgaatgctgcctatgaccacgatgaacacgcgctgccatcagttctccaccgtcaacgagccaaggagcatggagaatgggtcgggttcaattcaaggccttaccactggatttgcgagaacaggatgcacgcgttttaaatcatggtgtgccagtgccagcttctccagcaattgcggatcgtattgttactcgtctcaacaaaatcagtgcgccatttaatactcggcttgtttttaatccagtaacctatgctttgataattgaagaagcatgatcacgcatttcacgtaattaagtcaactgaattagccccagagtcgtgaaaagtgattctggggtcttttgatgtcctattgtaatcagcataatatccgagataaattctgttgtcgctcctcagatctgatccttgctattttgggctttaccgataattggaaaggcctttgttgcttgcagcgaagagtgattaatcagtaatcatccgtggcgcagcaattatttgggcaatccgatatggcgaaaattcttttctctacaaattgggctggctgatcatcgaaaaagtcgtggctaggcttgcttagactgaattatgcaaaaaattctgcataataacatatgacgaaaatcccattacctacttttttcaaaaaagcgatgtatagtaggtaaaaatcaatgtatatcaagggagtgtaaaattgtttgtgtaaatttaaaggaggaattgaaaaagggaaagccctccccgtatgattgaactgctaaaaccaaacagaatacggaggctttccccatggaagcttctatcaaatcacaaagccaagccgtttatcaggcagatggcgcaaatacatttactggcttggataaggtttatggcttaatgtagcaggctcgatgctgccgagaaatcggtcagaatataatcgctcccaatcaagcgagttggtaactagggtaattttatcaaggttttcaaccgcatcctaaaaaggaactagtcaatcgtcagcctgcttttgattgaaattaccaaaaatcggcaataaaaactggcaattttgagaaaataaaaattctagcttttgaaaacgattagctgccttataatcaatgctaaaacttaaaaggcgatgaattgatatggaagaaaacgaaaagaaaattcaggatgtattagccaagctggatgaaaagcagatcaactatgaaatgcagcgacatccggcagttgatcgcattgaccagattgcagatttgaatctgatccatccagaaacggcagccaaaaatcttttcccgcgcgatgataagcatcaacactattacttggtgtcaatcatgccgcaaaagcgtgtggatctgaaagcctttcgtaaagaaatcggagcgcggcatctgagttttgcttcagctgaagacatggagaaatatttggctttacgtccaggatcagtgacgccgatgggagcgctgaatgatacttgaacatcaagtgcaagtttacttggaccaagattttcaaggcggcttgattggggttcatgccaatgccaatacggcgaccgtctggctggatgcggacgtattgagcgcatttttaaccgagtatggctgtcgggtcgcttatgctgccatctaacaatgcaaaataatcaagaagcatcataactgagtctggtatgaatgaattagcgtctgcggcaagctcgttttgggcatctagatttagcaatgataagacggtattggttaacgattcggcttggtatgtttggtcttattcaaataaccaggtttagtgcggtaatctgagccattatgattaggcatgacgcggatgaacatagcggcttggcaattactgtcaattatttaccgaaatgtcagacagccaaacgcgatggcgatcagcagtttgagagattaggggattttttgcttgaattacggtatcattagactaaagccttttacgaaagaaggttgtcgttatgccgcataaagctgctgatccagaaatcattaaagttctgttgaagcaagaaatcatccgtttgggtattcaaaataatcccagccgtaccgtttatcaagatcgctatcatcgtggcgaggcgccttcgccaaacagtgctatgcagatcaccaaaatgtcttggagcgatttgatgcatgacctgggatttagttacgatgccaagaaaaacattgcgcaaaatggtaaaaagggagccagcaagcatctaggtgccaagcagtccattcgtttagcagacccgcagacatgtgagcaggtcgtaaatggagccttagaacttatgcgtcgcgaaaagctctataatgtaaaggattttcgtctgcgctgccgaccggttctgggcgtcagctatgattcgctgatgcgctatggcttttcttttgaggaactcaagaaacgctatgctgccaaatacggtgaaagcattcgcaaaaccagtcgttggagccggtattccaatgccgatctgacgtttttggtaatcgactatatgaaggcgcacgaactgaatggacttcatcaatactcgacttatctaaacctgcataatgatgccatgcccgcgacggaaaccttaaaaaaacgtctgcagctgtcttattccgagttgaatcgacttttgaagattctgctgcagtaacgctgcctgatataaattgcggatactatgcattggctgcataaatcgtaaatatgttcagcagtcttcatgttgatgaatcatgaggattgtttttatttttaaaagcggatatctgaataaaaagcttgccaaaaccgcaacttgaaattctatgattgcagcagcataataatagcttttatgaaaatcaacgcgtctgcaaaatcgttcacgaatttcaatagggtgaaaatctaaaatagcaaacgattgcacaattgctgactgatccgctgtaaacagatttggttcgggaaaccttgctcataatttaacttttttgttggttaagccaaaaatcgttttcattgtgtttacattagtgaaattaatttacttttcgatgatgttcgtttagaattatctcaacaatttgatggttaattcacaatctttaggaggcaataattatgacaaaagttgcattagttaccggtgcaggtcaagggattggtaaggcaatcgctgaacgtttggctaaagatggtttttcagtcgtcgttgttgctcgccacatggacgcactgcaaaaagtagttgaaggcatcaaggcaaatggcggtgaagcttttgccgttacggccgatgttgccaagcgcgatgaagtctttgctgccgttgaccaagctgttgaacactacggcgacttcaatgttatggttaacaatgccggggttgctccaacgacgccaattgacactgtaacgcctgaagatctgcaaaaggtttacagcatcaacgttggtggtacgatctggggcgttcaggctgctcatgccgcatttaagaagcttggccacccaggcaagatcatcaacgctacttcccaagccggggtcgttggtaaccctaacctgaccgtatactccagctccaagtttgccattcgtgggatcacgcaggttacggctcgtgaactggctgaagaaggcacgacggttaacgcatacgcacctgggattgtgaagacgccaatgatgatggacattgctcaccaagtcggcaagaatgcaggcaagagcgatgaatggggcatgcagacgtttgctaaggacatcgcgctgaaacgcctgtctgaacctgaagacgttgctaatgccgttgccttcctggctggtccagactctgactacattactggtcaaactctggaagtcgatggcgggatgcagttccactaaaataagttcatataagttcatataaaaaagatctcatcgcgagtttcggtgagatcttttttatttagcgcggtttcggctttggactgcggggtgtgtctttgattaaggattttggggattatggtcgtttgcaatcgttccttggcgttaggcgattgtggcttccttaattattgattcattgatttggtctgaattgcgccctttcctgccgattcatgctttggcttgcaatcaatgtggcgcttttgtttgcaatcaccgtctcgtcgcggttggtgctgctctttgcaatcaacgccctccaattgcagcagagctaatttgcgtgcggtgccgccagcatagccagtcaggcgaccgtcactgccaataacgcgatgacagggcaccaaaatcaaaatcgggttgtgggcaacggcgccaccgactgcccgcgcggttccttttgaaatattttgatttggcgcggctttttgtcccagttcctgataggtgatggtactgccagcggggacctcctgcaatccgcttagaatgcgctgtcgataaggggtagtttctaaggcgagcggaatggcatgcgggtcgggatcctgttttgcgaaatactgatcgagccaggccgttgtgcgtttaatgattgaattttcaccaacggcaatttcgtctaatgcgtagtcggcaccaaagtatttttggtcgttgaaccagagaccatgcaaggctgcgtcatcggccagcatcgtcatggtacctaatggggaatgatattcgtgtttcagcattttagagtgctcctttcaaaattggtagcggcagccgtaaatttatggatatttataaatttttgttgaaagcggttttaacgtcaattaattagaaaaaataacatcagacttaattatctttaacaatcagcgcagcaaaaacaattaaataataagtatcaactaggatagaatgttctcttcttaaaattaaaagtttattaaaattgaactgtgcggtatactatattttaatatttaatgttttaagaggaaagaggagaacaagatgtgtggatttttagccgctggttccagtgagtttgcacccaaggcttttgcggatgccttggctaagctgaacgatcgtggacctgatatgacccggacgatttcaatggatgacaaggtctttggctttaatcgcctggccatcatggacctgtctgagcgggggatgcagcctttcgtaagtaatgactgcatcttgatctgcaatggcgaaatatacaactattatgcattggaaaagaacttggccccagagtatgagtttgtcagcaacagtgactgcgaagtcttgattccactctataagaaatatggcctggatacaatgtgcaagatgctggacgcggaatttgcctttgtcttatacgaccaaaccactaagcgcgttgttgctgcccgcgacccagttggtattcgaccaatgttttatggttataccaaaggcgagcataagatgtcatttgcctcaactgccaaggcgctgatggatctttgcgatgagatctatccattcccgccaggatactactatgatggcgaaaagttcgtctgctaccatgacgctacgacggttcagaagatgcggaccgacgattttgccacggcagccagcacgctgcgcgaaaaattggttgaagccgttcgtaagcgcctaaactctgatgcgccagttggctacctgctgtctggtggcctggactcatccttggtctgctcgattgctaccaagcttttgggcaagccgattcggacctttgcaattgggatggaccgcaacccgatcgacctcaagtacgcgcgtgaagttgccgactatctgggaactgaccataccgaatttatcatgacgcgagaagacgtgctcaacgctttgcatgaggttatctaccagctggaaacctgggacattacaacgattcgggcctcaatcgggatgtacctgctttgcaagaacattcatgaaaacactgatttgaaggtaatcttaaccggtgaatgttctgatgagctgtttggctacaagtatacggactttgctcccaacgcggaagaattccaaaaagaatcattgaagcgggtgcacgagctgtatatgtacgatgttttgcgggctgaccgctgcatttcttccaactctttggaaggccgggtaccatttgcggaccttgactttgtcgaatatgcgctgtcaactgatccagaactgaagatgaaccactatcacaagggcaagtatctgctgcggcaagcatttgctgggcaaggatatctgccagacgacatcatcatgcgggaaaaggcggcctttagcgatgcggttggtcactcattggttgacgacttgaaggactacgccgaaacgctctacactgatgaagacgtggccaacgccaaggaaaagtatccatactgcacgccatttaccaaagagtcgttgctgtatcgtgatatttttgaggaatatttcccgggaaaagcaaaatggatcaaggacttctggatgccaaacaaggaatgggagaactgtgacgttgacgatccaagcgcacgggtcctcaagaactatggtgccagtggtgaataaagcagattgccgtaattgataaaagcgtcatctcagacggggcttgtcataacagccttgtatcttgaggtggcgcttttagcttacgattaagattttggttggactgacttgggaaatttagctgttgaagcagggaaattcctccatcgattaagcattaatagcggaatgcctaggatttaaaactgttctttttggacgtctgtttatggggcaattggacgggtggtaatatcttcccgattgtttttgccgcgctgctgaatggtttcgcgattgcccagctgctgccagcaaatgacactaccttgatcgtgatgctggtggggatttcttctgggatcggcttgttggggaatatctggttggccggaatcttcatgatgctgttcttcccaatgaatctgtggctggttgccattctgctcatgctgatttggctggctggacaacagatcagcaaccgttttgaaaaaatacgccagccaatgaaagcaggtagggtgactgatgatcgtgattagtaattggctgttggtgcgtcagctctgagaataatatatgaaaatagcgctatagcagatgtaagacctgctatagcgctatttgtcttattttacttatcttggtcaagcagctcgaatgaatacttttccttaccgatctgcttccagatatcaacgatcaaaacgtccataatcaaggcgccaatgataaacaaaacatatgaatacttggtcccaatggcagtctgaacaacggtgctttggtgaggcatctgcgcagcagtaattgccagaatcgtggagacacaggcggttccgattgagccggcatactgctgcagtgtactgaacaaggcattgccgtcaccaaccagctgcggttttagatgctgcagtccataggtcatgacgttattgaataagaagccgaaaccgaccatgtagaccgcgtaaaagatcgtcagcgaccacattgagagatggctgctgaatgcatacatcaagatcacggccaggttggtaaaaagtgcgccaaagatcagtggcttcttgattcctgattgatccagcaggcggccagtcagcggcagcaggacagctgagatcagtgccccgagcaagagcatcagaccagcgacaaaagaattctggtgcagcgttaattgagcacagtttggcaaaaggaacgtcatgccgatttgaatgaattgaaccatgaaatacagcaatagacacggcagatagatcgggtcagcaaagacattggtattgaccagcgggtgtttgcgatgtgaggtcagatatccgaacataatcaaggcagccagtgcgacaatgacgtttccgtaaaagaccggtgagccaaagccgctggtaccaacgctgtttagccccatttccaggcagatgaagccaatggcaaccagcagatactgcagaaactggaaatggatggcaattggctgattgatctgctgaatgttggcaatcccgatcaggccaaaaatgatcccaattggcaggacgatccaaaaaatcacgcgccagttgatgaattgattaaccaggccgccataagttggtcctaaagaaggtgccagcccgattaccattccacccaggccggcgtaggttccctgcatggcaaatggaatctgctgcataatgacgaaaaacagcagcggcattgccagcccagtgctgatcccttgaatcaaacggcctaacaacagcatccacagctgaggcgccagggcacaaagcagaccgccagtgataaatgccagactagatgcaacaatcaagccgtgcagtttaaagcgacgctgcagaaaggctgccaggacaacggttagggcgacggtcagcagatagccggtcgtgacccattgaacggcatttagactttggtgaaaatcacgcatcaaagttggaaacgtaacattcattgaggtttcaaccaagacaccgcaaaatgccagaccagcaatgccaataattgacagattggttttcttggtaacctgatgttcgttcgtttgctccataaaaatcaaattcccctttctcaaataaaaaaactgacactgggaaggcaaaaatgcttttcctagtgtcagtctgacttacggatatacaagcgaaagttatatcttaactataccactttcgaaaatttttcgtaaattaaaaaaacatgataattaggattcaaaccggtcaaatgtcttgcctaagcaagttatgagcgaatgggacataacgcctggctggattgacaataacctcgtaaagatttgctagacgtgtcgctcaaacacgctgatcggatcttgaacggcaaatattgtgggacgatttcaaacagtcgttgcctagacgcgttgggaggctccggttgtcgcgtccagtcttgagccatcattcggggtaaagtgcatcaatgggccatcaatctgcgcgtcatagtcgatcgcgacgtccaaaccattgaaaaaccaatagtcaaaggcctgaatatagtaatgaatgccatcgatgacttgatcaacgacggggtcaacgggatgatcacagcggccgatgccttgtgaaaaaccttgatgggcattggtttcaccatagcccttgccaaatagtttgatgccgttgccaggcttaagatgcatttcgttttgaaaccattcgctggcttgcggggtcatagtaatcttggttaatttctttttagtcataagaaagcgccttccttaaaatgtttgcctttagcctaacatgataccggcagtttgtcgcctggcttgcttgataaatcgtaaatttggttaaaaagttggttgcttggattttacagcagcaattttttaataaccgaccccatttttttaaagttttgctaaaatagggtgttgaagaaacaaccatcgagatctgcattcctaaaaaggcggctgatcttttttgattgcgtgctgtttaagcttgattaactgacagtccgcgatcgatgtctaagcgatgaaccagcagcaagacattggttgaagggggaaaaactatggctgaaaagcaagccaaactattgaaaatgctgagtgagggctcattaaacgagcggatgtttaatgccagctttggtctgcgcctggaagagcaccggattttaacgaatggccgggccagtcgctacgaatatcccaagaacctcagctcacgcaaaaccaatccatatcttttgagtggcttttctgataatctgatggaatttaccacgccaatcgtcagagggagcaaggccacttgtcagcagttaaaggtcttagaacagatcgttgacagtcagctgcatgaagacgaacggatctggccattgagtctggcaccagcgccggagtatcagcacgatctggaatttgtcggcaacaattgctcacagccatggaacaaggaatacaccaactacctgcgcgaaaaatatggcattaagcggatgatactagggggcgcgcacattggctttaacctggaccaggagctgcttgacgcattatacgatcaaagctttaaggatgattttgctactcgggctgatttccaaaacgcggtctacttcaagatggcccagtgcttctgtctatggcggtggctgtttacctatttatacggtgccagtccggtttcagaagccgttgaacacgatatgccagaacacattaacctgccagtgcgcagtttccgtaacagcacctatggctatgacaatctgccagatgagcggcctagttatgaaagcctggacagttttgttgatcaggtctcgaaatttttggaagatggcacttattatggtccgcaagaattctttggcccagttcggctgcatggtaagcatgatgatgacagcctgcgccagatcgtcaaagatgggattcaatttatcagttttcgttcatttgatctggatccatttgctaaaggcgggatcagtgaagatacgctgaatttcttagagctgtttatgatttacacgttggtttcgccaatgccggaaaaccttagtgaaaaactaaaccaggcaattgagcgcaataatgaggtcgctttgcaggcaccagatgaacaaaccgactggatgcgcaatgaggctatggatttgattgagcgcttgagtcaattctgcgatcaatttaatgcaccgcgcgaatacaagttggccttgagtttcgttaagcggcgggtagaagatccaacgctgacgatcggtggccaggtagcggaaaaactggcgaagggcgacctgttgagttttggcctcaagattgccaatgaccgctataccagtttcgtacgctcgccacatccattgcaggcgctggctggccagtattccgacagtgttcagcaattgattaagattgccatcatgagcggggtccacgttgattttgaaaatcccctaaagctcagtgtcggtactcgggttgagacttttgacgcgcaggctgatcttgatctttctcgcggtgctttggattacttgttgaacctgttcccagaattagaaggcaatttggctgaatagcaaaaaacagttgggaggcgcgccctgtatgggaagcgcctttttacgtcatggtggctgtattgatttttaacgacgaaaggacgatggattttgcgtaagcttggaattattggacttggcaatgttggcgcgctgctggccaatttgctggtggcacggcagattgttgatgagctggttttgattgataccaacagtgatctggcagtcgggctgcaaaatgatctgcttgatggtatgtcggcactggcagttcagccaacgatcaaagtacaggattacgcggcactcaaggatgcagatgccgttgtcttggcaattggcaaggcggaattgttaaaagagcagcggtttgctgaattgaccgatgtcgggaagatgatgcgccagattgcaccattgatcaaacaaagcggctttagcggcgtgctgattaatctggccaaccccaacgaggcagccacggcctatctgcaatatctaacggaactgccgcggccaaaggtaatcgggatgggaacggttctggatactgcacgcctgcaccgggccattgccgatcaggtccacgtcgcgcccagtgcggtgactggttttgtttatggtcagcatgatggcgaggccgtgccaatctggtcaacgtttcgcatcaatggccaaccgttggaaaagccggtaatggggcaaaaaatcgacccacaccaaagcgagattcaagctaagctgaatggctggtatgcgatcaaaggtcaaggacaagacgtcagcgggatggcattatggacgatgcggattctgcaggcagtcttgtcagatgaacaggtcagttttcccgtggcgctttatcagccacagtaccaaagttatctgagttttgccgcgcagcttggtcgacagggcgttggcaactatacgcttttgccattgcggccattggaggaagatcagctcaaagtcgcggcccaaaacattcaagatcagttaaacatcttgcttgaactgccaactgaggactaggttagggcgtttcattaatacgggcataaagtcagaccgtcgcctttgctgataaaagtcgatccggtattttagctgatcgcatcaatcaaaaagatcatcacggtcgcgttaggctcgggatgatctttttagtcacagacagaatttaagctgagcacggacagtaaatatgcatactggcgtggttgtttgaggtgagtttgccagagtgattcccaagctggtctaatttagcggtactgtcggcgggctggcgcatggtaatggttcataaacttcatcaagtcgtcaaatgaatgggcgaaatggatcgcgtccaggtatgactgttccaaaaagccagtgtcgtgcatgcgtcgcaacatattacgtagggggtcataaaaaccgttgacgttataaagcgcggttggtttagcgttattgcctaaggacatccatgaaaaggcctcgctgatttcttccaacgtgccgattccaccgggcagcgccaccagtccgtccgcgagatccatcatcaaatctttgcgcacgtccatgttagaaacgattttaagatcctcaacgcggtccagtgcggtttggcgttcgtatagctgtctggtgatgacgccatggactttgccgccgttatcaagcacagcattggcaatcacgcccatggttccgtatttgccaccgccatagatcagttcaatgccattttgcgccatctttttgccaaacgccgcggcccttgcttggtagatgggatcattgcctagatgcgcgccacagtaaacggctaaactcttaatcatcaaatcgcttctttccatttggttttaccttaattgtaaaccgattgatcctttgcggcttatgttttatcaaggatgagaatcggtcagcagttttaactgcatcgcaccggttgtcgacgaacagacactggtggaaacaactgctttgaggactccttatcatgtgtcgaacactcgtcagccacatttgccattaaaatcgccacagcctttggaaaatcaggaggcccaccgaactcatctgtaccatcaaactagcttaagttaaatcgttccaaacttatttcaatggcgacccgcaaaacaatctcaattaatcaaaccagtgccatcgctaagactgaaggcaataaaaaaacggcgtccgtcgcggaacgtcgtgaatgtgaatgagtcataacgtaattaaattaattattgcacggttgaatatagtatacttggtcatcggcttcatcgatcagcttggcggggcgctgttcattggcttggatcgtaatgtggtagccaaacttgtccaagtagacgagttgctcagtgctgacctgctgaacggtggccggaatcaattggttgtcgattcccagcttgagttctggtgagatcgtaataatgtgtgaacggtcacgctcttcatcatagtatttccaggtaccggcatagaaaacgggcaaggccgcgacgggatgattctgtttcttagatcggctgaaaccaaacgaactggtgattccagccattagtcccgcaccgaaaagcaacattccttttttcttcattctgctcaatccccttcaatttaacttgatttttcatttgatcataaatttacgattttaattatacacagctttgtgttatagaaagatttcatttctgttaaaaactgaaaataattgttagaatgaaacgtagcaattgtaaaggagtgatcgaattgctaaaattggggattattggaactaacattattactgatcaaatgcttgacgcggctaaaaccacgggcaagtacgaactgacggcggtttactcgcgaactgaggaacatgctgaaaagttcggcaagccatatggagccacgcagttttttgacagtttggaagatttctttgatgaaggcgactttgacgtggtctacgttgcctcaccaaacagcctgcactatgaacaggttcgcttagcaatcgaaaatgacaaattcgtaattgttgaaaagcctgcctttgtcaacccaaacgaatttgagggcattgaatcgcttttggcagcccacccaaaggcccgtgtcgttgaagctgctcgtcatattcacacgggtcttttccatgcggctgaagaacagctcaagcagatgccggttattcaaggtgccaacattacggtaatgaagtattcttctcgctatgacaaggtaattgccggcgacaagccatatccaaacatcttcacggctgaatttgccggtggggcattgatggacctgggtgtttacgctgtttatggtgccgttactctgtttggcgttccggacagtgtcgtgctgttcccaacgatggtcgcaagcggtgttgatgggatggacaccgccattttgaagtatgacaagtttgccgtaacgctgaactttggtaagacggccaactcgcatctggtttctgaagtgtacggtcttaaggatacgctggtctttgactcaatctttgacacgaccaaagtaacctactatgacagtgaaaagcaggcccacccactggaagccaaattttatgaaaactcaatggttgatgagcttaacgattttgctgatctgttcaatgatccggaaaatccagaacaacaggctaaatatcgtcgctggttcgatctggcgcgcaaggtcaacacggtaatgtatgatctgcgtcgctcggctgaattgactttcccagctgacgataatcgctagacatcaactgactaaattaaaggatggatatctgttgatcgaacaatttcaacaactttttgatgaaaaaggtttccagcagccaacgcagattcagaccgcggttgctgaaaccctagcttctggaaaatcagtcttaggaatcgcgccaactggttctggtaagacgctggcctttgcctggccgcttttgcctaaagttgagcccggtgccggcgttcagattttgattttggaaccatcacaggaactggcaattcaaacgacggcagttttacgcgaatgggccaatctgatcggggtcaaggtgcgctcgctgactggtggtgccaatctgcggcggcaagtggccatgcttaaaaaacagcacccagatgtcgtagtcgggacgccgggacgcgtgctgcatatgctggacaatcgcgatttgaagcttgaccggctgaagacgctggtgattgatgaagccgatgatctgttgcgcgatgatacgcaggcggtggtcgaagatattgaacgcgccacaccgctcaacgcgcaattggcctttttctcggcaacaagttcggcagcctttgatcagctcagcgtcatgtttggccgcgacatcattacttatgacgttcgtgaaacggatcaaagccgtggaccggttcggcatggcttggtctatgcacgaacgatgagtcaaaaaacggcaatgcttaatcggttgagtcacaccaaggattttcgggcgttggtcttctttgacagtatcaagacgctgcactacgcggccagtcgcttgaagcatgagcacgtcgcttcggcaactctaggcggcaagcagcggcaaacagaacgtgaaacggcactgcgtcaattccgcaagcgtcagttaaagctgcttttgaccactgatgtcgccgcgcgggggttggatattcccaaactgccagccgtgatcaatttcgaactgcctaccactgtcgatcagtacgtgcatcgaactggccgaacgggacggcaaggtgagcccggcttggtaatcaacctgggcagtgatcatgattttcgtgatctgaaaaagctgctggccgataccgactatcagtttacggaattgacggttggtgaaaaagccgtcaccgatgaaaaaccggccgatggagcagccaaaatgccggtgcgtaaagaagctagccgtgcgattcaaaaggaacagcgtgaaagcaagcgtgaggttaaaaagagcattcacaatacgctggatggcttttcgatgccggctaagcgcaaaaaccgcaagaagaatcgcaaaaacaaggggattcgtctcaagcaccgtcgcatggcggaaaaacaatctgatcaatagtcttggcgctgatggatattgattaagtaagtgaaatctcggttccgcctggctatctctgtctgataggggtggcatcgtttcaaatacaaggcatgcctgattcagattcaatattaaagagatattgttgactttacgattgaacataaatgtgcgacaatatttcttgttgcggtcccatagcataattggatagtgcatccgcctcctaagcggtcgattccggttcgaatccggatgggatcatttaatttaacttaatgcaggtcttcagcaagtcgccatccttaattgggtagcggcttgttttggtagtaggctaaattttttgttaaagccaaccagtgccagccattcgcttagtcaatcttgtcttcggtaaactgagcggccacgcgacatggctgctggcaatatctggcgtcattataatggccaaagcctggggaatgacttgtttgctgcctgctcctgtactgaaactggtaatggaatttaccagtcgctgctcgttgcccaatttggaaagtgccgccgatgatatttgacagggactttgatcacgccaggccatggctcgctgacatttgactgaggtcgatgatacttggcggcaattgagtgacggctaactatgattcggtggtgtctgatcagcggattgtgaagggaatcaggcgttgacccgttgcgccctttgaaattacctagctgtcgagtagatgcccgcattcatggagaagattgcttttggaatgttgcaaacttttcgattacaacgtttgcttcattttcggcgcaaggcagataaatgaccgcagcaatttttgaggtcttatctatttaaacaatatttccgttaaatgcagataatggacgagctggataggggccgcgtcataaatgaatggacaaaaaagcgtgatagcagatctggtaaaatctggaatcacgcgatactgtttggtttaggagccgaatcttctctttggaattcggaatcctggcttcaaagtcagtaaatttaagttttagagcttatctttcgagtcagcgctccgacaatcaggctcagcttgcggttgccagtcagattaatctcgtaagtctggcaatacctagcgattggcaattttgtcgttggacttaaagatcagccacttggaaaagatatagttggcaatcacgacgacgacattgtccaaaatcttaacgaccagctgttgaattgcggagtcaaagcctaaaagcgtcaccccgacgtacatgaagacgatatcgatcaaaagcgtcaaggcacgatagaagtagaacttgataaactccacgataaaagcgcggaacgtcgtatagtgcgagccaaagacccagaccttgttcgttaaataagcgaccagaacggaaacaaaccaggcaataatgttggcaagctgatagttccagtgaatgccggaactgagccattggaacacgccaatattgacgatggttgtcaccacgccccaaaacaggtaggcaatgacgcttttatatttattccataattcagtcattagtcttgagctgccttttctaccagctgcttggcaaacgcgtccagcttggcgatgtcgtcttgatctggttccaggttgatgtgaacgttgtcagcacccttaacggcaccggtttgttcaaaggcctcgccaaacttgtcaacagccaggcagaagaagtcttcataaaaagtatcgcctgagccggccacgccataaaccttgccactcagatcttcttcctttaagtcatcgaaaaagtccagaccttcatcaggcagggcaccttcgtcataagtgtatgggcagacgacgcagatgtcgacgtcttcaaaatcagcagcgtcggccatcgtcatttcggtttcttcaacttcaacgccttggttttccaaagcttcggtaataatatcggcaacgtcttcattgttgccagtaatcgtggcatatacgaccaatgcttttgccattgtttttccctccacgtaaatagattcgtaaataaattcgcaacggatagtataacacagaattattttgcggccttgagtgatatactaaataagatattaaaatttataaactaaggagactttctggatgattagtttaaagtcaccacgcgaaattgaagcgatggaaaagtccggtgccgttttagccgggatgcacattggggtgcgcgaaatcattcggcctggcatttccagctgggtaattgaagaatttgcccgtgaatatttcaaaaaggcgcatgcaattgccgctcagattggttttgaaggctaccagtacgcaacctgcatcagcgttaacgatgagatctgccacggtttcccccgcaagaagctgatttttaaggacaatgatctggtcaaggttgatacggtcgtgaacctggatggcgcctacagtgattcctgctggtcatacgtagtcggcaaggccagtgacgaggtcaagcgcttgatggacgttacctacaagtcattatatctggggattgatcaatgtaaggtcggcaaccggattggggacattggcgcggccattcagcactacacggaagatgagaacggctatggcgatgtgcgcgaatttgtcggccacggtattggaccaacgatgcacgaagatccaatggtgcctcactatggcaaggcgggacagggaacgcggctgcgcaatggaatgaccattaccgtagagcccatgatcaacactggtacctgggaagctgataccagtgatccaagcggctggctggctaaaacggcagatggtggcctgagctgtcaatacgaacactcgctggtagttaccgacaaaggccctaagatcttgacttcccaagatcccgaagccgatgccgcttacctgtacgatgacaactacgctgaatacttggcacactacgctaagctggctaaagaagttgccaaaaagtacatgaagtagtccataagataattacgcgttactaaagacgtgatgccttggtttgctgccaagatccaccacgtcttttatttatgatgggtgaacgcacgctcctcaatataagaggggcgtttttatttcgtgatataatgtcttttgatattgcattgtcgctctgtgctgataatctgataaaattaaaaacattatttctgaataaggcaggttaaccatggacaaaaagccgaataaaataaaaaatttcgtgctgctttttattaagcatttcaccatggcacaggtttcagcgtcagcggcggtcttggcctactactcgctgctgtcggtttttccggcgatcatcgtggtcggtaacctgctgccaatgatgggattgaatgccaaaaccgtcttggactatctgcagacggcaattccggaatcagtttatgacttcttaagaccgattatctatgactttctgcagcatgggaacggcggcacgttgactttgggtgcgatcgtggcattatggtccaccagcctaggaattgcggcttttcagcgcagcgtcaatcatgcctatggggtcgcagaaaaccaaaatccaatcattaatcgcgccgtatcgtttctttggatgctggtcatcttacttatcgtgacgacgctggtgattttatatgggcttggtgaacagaccttgagcagcctgcagccgatcttgggctttagtaccaaatacgtcacgttcttcaggtcgatcaagtggccggttactttctgggcgctgtttgtgctcttgacgctgctgtactactttgttcccaatgctttggtcaaactgcgctacgtgattccgggcgccttgattgcggatcttttatggatgggactttcccgggtcttttcctattacacgatgatttttgcccataacattacgtcttataaaacgattggggcgtttatcgtgctgatgatctggctggatctgtccgggatggtgatcatgatcggggccaccatcaatgccacgctgcaggatgcccatgacggcgagatcaaggaaaaaaagcacctttggcagtacgtgcgcaagatgcggcatcgcgagtttaacgaccgctaccattatgatgagcataaataaaagcaaaaacgccggcaggaaggacctgctggcgctttgaacagttggaattatatttggttaaagtgaggaagtttttaagaaatggcgaaaatttcaaaaattgaagcacaaaaacgtcctggccgctataatatctatcttgatggcaattatgcgtttgccgtagctgaaagcgtcttgatcaagtaccggctcatgaaagggatggaactagatcaagcacagctggcccagatttctaatgatgatgagattgccaagacctataataaaatgctggactatctggctcaccagttgcgaacggaacatgacgtctatgagaagatgcgtcagctcaagaccccggctgaagatattgaaccggtgatgcaaaagctgcgcgggctccatcttttagatgatcatgagtacgcggccagctacgtacgtacggtaatgaatactgaactgaaagggccccaggtgattcggcagaaactgcggcaaaagcagatcggtgagttggatatcgacagtgccctggcgcagtttacccccgagcggcagctggagaactcgaccaagctggccaaaaagctgtttaaacgctataacaagctgccggcgcgtcgccaggctgaaaaggtgcggcagggattggtaacgaatggctatgcggctgatctgttcaatgagatcaaggacactgtgacgccgcagcctgatcttgagcaggaagacgaactattggccaaagaagcggcaaaggcttggcggcgctatgagaaacgcgcgccgacggattatgaaagacggcttaaagttaagcaggctctgtatcgaaagggttttgaccttgatgaggttgagcattggctgaatgagcatgagaacgcttgaaaacggcagtagttttaaaatgtctttttaaattcataatttactggtattatgtagaaagtattgttttgataaggaattgctttcaaaaatcttaactagagttttaagtgatattatgcaaaatcaaattgaagaaacagagtcaacggaaatcatggaaaaaagtcaaataaaaaaacaatcactgacctatcttttctttaagcgattgaccgacatcgttttgtcgctgctcgctttgatttgttttagtccagtgtttttaggcgtttggattgccaaccgctttggcgacaataagggaccgctgttttttaagcagactcggattggtaaaaacggcaagccttttaaaatgtacaagtttcgctcaatgatcgttaatgctgacgagatcctgcattccaacatcgagctttatgaaaaatacgttgaaaacaactataagctcgagccggatgaggacccacgcattaccaagctgggacgctggctgcggcgaacttcgattgacgagatcccacagttcatcaacatcttaaagggtgacatgagcattgtcggaccacggccagtcgttaaagaagaactcaaggaatatggcgatcgcgtcgataagttcctgtcggtcaaaccgggtgccatgggactttggcaggctagcggccgcagcaatatcggctatcccgagcgttgtgatctggaattaagctatgttgatcatgcgtcatattggtatgatgtaaagattatgtttaagaatattatcagcatctttaaaaatacgggtgcttactgagtcggagggaaagattagtgaacattaaagtcttagtagcggtgcacaaaaactacgcaatgcctagtgatccaatgtatctgccggtatttgtcggcaaggatctgcatccagacgttaacgatactttccaaggcgacaatactggtgacaatatctctaagaagaacgcgcactataacgaactgaccgcgctttactggggctggaaaaacctgccagatgttgatgcactgggcctggttcactatcgtcgctacttctctttgcatcatgacaaggatttaagcaaggtcttgagtacggctgaagcggagaatctgttaaaggattatgacgttattttgccaaagcagcgcaactactttattgaaaccaacgaatcgcactacctgcacgttcatgaacatgagccgttggaagttacgcgcgaggttatcaacaaaaagtatcctgcttatgccaaatcatttgaaaccgtaatgaagcggaccaaggcacactatttcaacatgatgattatgaaaaaacagccgctcgatgggtactgcacctggctgtttgacgtcttaggcgaagtagaaaagcgtatcgactattccaattacacgccatatgagcagcgggtctttggatttttgagtgaattgctgttggacacctggctgggatgccatccagagtatcggacggttgacgttaactatgtctttatggagaagcagaactggctgctaaaaggcggtaagttcttgaaacgtaaaatcatgggacatggtgaacactaataatcaggagagagagcatggccaatttagtcggtaaaaaatttcatgaaattggcaattggcgaattgatgggcagattatctatgaaattgcatttgcttttgaatttgtagttgcgtttttaattacttcaacctataccgattacttttcaaaccatttgctgcatacattaatgtttgctggtctagcattggttttattaaagatttttttattcgatgacttagatttaaaatggctggcaatcgatgcaattgtcttaatattgctattgataacttggcgaacgtcaaaagaattttcgcttttttcaatggggatttttgttttaggtgcaagaaatgttgattttaagcgaattatcaagatttacttttatgttggaatgctgcttctagcctttgtagtgatttcagctatgggtggcttgataagaaatctagtctatcgtcgagacatgaccaatatcgttaggcagtcatttgggattgcatacccaactgactttgctgcccatgttctatatttgattctggcatatgcctatttgaaatttggcaagataaaatggtatgactatgtggtattcttagccgctgccggatttttggtgaagttttcggatgcgcggctcagtgcttatgcaatcattttggcaattccagtactatggattggtcagcgggcacaaaaggatcatctgttgagtcgctttattgcatcgttttactgggcagtaccaatcgtatcggcatacttagtaatcattgcttcttatttctttaggccatcaaatcatttcttaaataagatcaacaatgccagctcaggtcgtctttatttagggcatgaggcaatttcaaaatatggcttctccatgtttggtaaacaaattgtcgagcatggttggggtggtgccaatgggttgaaaatgtcgcaaaatgcccctgctaattatttttttgttgattcttcatttttacgaatgacgattttatatggaataatcatggcaattataatattattggctatgactaaaatttcatgggaatcattccaaaaaggaagcttcgcattagcaagcattattgtcattgtatcggtgagtgcaatggtggagcagcggctattggatctggcatacgatccctttttaattgcattactggccaatgtttatacaaaacataaagcggaggatatatcttgaaaaactactcagcaaaagaactcattcaaatgttttggaagagtgtaattttgattttggtactggcagttcttggcggcggagcaatgggttaccgtgccaaaaagcagcagcacactacttatagtgccagtcaggaaatcgtaatctcacataatcttaatgaaaatcagtcatcagataatggtcaggattcgattacgaatgctgatatgaatatgatgccaacttacgcggctattgcggaaaatgaggcgatctcggaaacggcacacaaaatgttgccaaagtcgattaagaagcactactcagttaaaaatgtaaatgattctgttaaagccgttgcgcatcagcagtcgttggtattaacgattaaggctaaagctggttcagccaaggccgctgtcgaaattgccaatgcaactgcaaaggcggttaagaaagatctgcctaaactacaaccaggtgcaggtacggtaacgcttttggctaagcctactactaagtcgactacaagcgagactttgccacatgccaagaaatatgccatggttggcgctgcaatgggtggcctgatcggtatcttgatttcctttgttgtaattaccttgaaggatcttgttaagaaacgtaaataaagttattttagagattaattggtaatgctgattgatctcttattttgtatttaggagtgaaaaaatgagtaaacgagttttgttgacggttgttgatcccaatccgaataatgcagggccaaaagctaagaatgacattgaagagatcctggctcaagaaggctatcaagacatgcggttgccatataactgggaatcaaaaatagctaaatttaaatataaatattggagcattccaagactgtttaagaacaaagaaattgacgaattggtaatgcagtttccaatctactcacgggcgctgatggatgcttttattgaaaattttcgtaagtattcaaatggtaagctgttttttatcattcatgatatcgaatcgttgcgtttctttaaggatgaccctagctatgtagaaaaagaagtgcaatggctcaaagaagccgacggaatcatctctcataatcagagcatggaaaaatggattcgcagtcaaggagtagaaacgccaatcgtaaatctgggattgtttgactacttaaacccacagccaattgatgaggaaactgaatataataagtcggtatgtctagccggtaacctaagaaagtctaatttcttgcaaaagattgatatgaaggatgccaaattaaatgtctttggtcccaatgctcctaagttgtttggaaaaggcgttgaatacaaaggacagttttctccagaagagctgcctaaacatttgaagtcaaactttggcttgatctgggatggtgacagtctggaaacttgtactgggcagtttggcgactacatgaaatataactgcccgcataaggcatcattatatttaagtactggtattccagtgattgtctggaaggaagctgcggtcgctcaatatttggttgaccatcagttgggaattgctatcgacagtctgaagacgctgcccgaaatcctgaatcagattagttctgatgaatataaggtaatgaagcaaaatgcaattgaagcagctcatgcattgcgtaatggggaacatatcaagactgccttaaacgaactggaaaaagaaatgtagatttggaggcgaagtaaatgatacctaaaaagatccattatatttggcttggtcatggtaaaaaatcaccgaaaatgaaacgatgcttggcttcatggcagcaggttctagttccagctggttatgagattattgaatggaacgaagataattgggatgttacgcagaataaatttgcctatgaaaactatcaggctggcaagtatgcttacccatccgacgttatgaggcttgacgtactttatcgatatggtggaatctatattgatactgacattttagtgaagaagccctttgatgagtttttaaatctgccagcattttgggcgatgcagtttgataatacgattagtacttcgatctttggggctgaggctggtaattcttttattaagtcattattgactaagtatgatggatttgatcgtcaaatgatgctggacggcagattgccggagaccaacaatgaaattatcaccaaggccttacttgattactatccagaatttgttttggaagataaaaaacaaattttaaatgatggaacggtaatttttcctaaagagtattttatgtttccaacatttaataaatcgatgggctattcagaacatctctttaccaagacttggggccatgatgactattcaaaggcgcactatgttattaaagacattgtgcatcgattagttggggatgttgtctttggtaagatcagctcagcacgtgggcgtaagctctttttacaaaatgaagaatatcaaagagaacgggataataaaaagcaaggatcgtaagctagcatgaaaacagatattaccataattattccaacctataatgctgagcacacgattgaaaagtgtgtagaaagtctgcttaagcaggttggtaatttttcatatcaaatcataatcttggatgacggttccagtgatggtacgttagctaggcttgaaaaataccaggataatcagttggttgaggtagttgccaaacaaaatactggcgcttcagcaactcggaatgtcgggattgaaatggcagaaatggattccgaatacttaatttttgtcgatgctgatgactttgttgaagcagactatttaaagctgctattcgatcaatttaaagataatagtaactgtgatctggctatctgcggttatcgtaaggaagatgaaaatggcgagttgcgttttaaggctgctggtcaaaagcaaatgatggatcggcgccaggctttggaacaaatttttgtaagtactggctatgaaggctatccttggaataagctatttaaaactagtatcattaaagataatcagattcgctttaataccgatttagtattagctgaagatttatatttctgctgcgagtacttgctgcattgctctaaggtgagttatgatccgaagccggtttatcattacgtggttcaagagaatagtcaaatcaattcgaatcgttatggtgcgccatataatcctaagtctttaaacatcattaccacttatacaagactgcaaagcttgattcctgctaagtaccaaaaagtacaccaatcgattaatacacagctttgttggagctctacgacgattttacgtaacatcatgctggcgcccaatcgagacgaggtgccagctgacacgattgccaaactgaaaggaatagttaagcaaaatcgtcatgatttcatgcagaatacaatcttgccaaagcgggataaaattatttttatgttgaacctttatgcaccgggattactagcgtggatctggaaaaaatttagtttacggggaaatggattttaaatttaagaaagcttaaaattgaaattttattattcaaaaaataatctccgtagtaaaatagtacagttaatatgattcaagataaatcaaattctaatttataaataaagaggaccgttatgaataattacgattatttagtagtaggtgccggcttatttggagccacttttgcctacgaagcagctaagcgtggcaagcgcgttaaggtaattgaaaagcgcagccatattgctggcaacatctacactaagaaagttgatggtatccaggtacatgaatatggtgctcatattttccatacttctgataaggcaatttgggaatacgttaatcagtttgcggaattcaaccgctacacgaattctccagtagccaactacaaaggggaaatgtacaacctgccgttcaacatgaacacctttaataagatgtggggagttcgaacgcctaaagaagcaatggctaagatcaatgagcagcgagctgaaatgaatggcaaagagcctcagaacttagaagaacaggctatttctctgatcggtcgcgatatctatgaaaaactgatcaagggctataccgaaaaacaatgggggcaaaaggcaactgaactgccggcctttatcattcggcggctaccagttcgattgacttacgacaataactacttcaatgatctgtaccaaggcattccaatgggcggctacacgcagatcggtgaaaagatgctggccagtgatttgatcgatgttgaactgggtgttgacttctttgatcaacaagatgaatatctggcaaacttccctaagatcgtctttactgggatgatcgatcaattcttcaactatgaattgggtgagttggaataccgcagcttacactttgagactgaagagcttgacgaagacaactaccaaggcaatgccgtggttaattataccgatgccgaaacgccatatacgcggattattgagcacaagcactttgaattcggtaagggcgatgaaggcaagactatcattacgcgcgaatatccagctgactggaaacgaggcgatgaaccatactatccggttaacaaccaacgtaataatgctctttaccaacaatacacggaattggccggacaaaaggcgccaaacgttatttttggtggtcgtctgggtcagtacaagtactacaacatggatcaagtaatcaaggcggccttaacgaccgtggctgaggagtttgacaagtagatcatgaaggttatcaaaaactatctgtataatgcgggctaccaaattttattgatgtttgctcctttgattacgacaccatatgtttcacgggttttgggagcacatgcatatggtatcaacacttatacaaatggttgggttactttcttttatttgatgggtcaaatggggataaccctctacggtaaccgtgaagtagcctatcatcgtgatgataaatataagcgttcgcaaactttctggggcattgagattcttcaattaggtacgattactattgccttgatagcctatttggcagctgtttttctctttagtacgacgtttaaggaatactacctgttgcaaacactatggattgtggctgcaggacttgatgtttcctggtactttatgggaatggaagactttaaaaagacggttacgagaaatacgatcgtcaagctgatttcaattgcgttgatctttatgcttgtccgaacggaagctgatctttggaagtacgtgctgcttttgggattggcgcaggttggtggcaacgttactttatggccttacctgcgtaacagtattcaatgggtaccaatcaaagaatggcatccgcttaagcatttctacccatcgctgttgctgtttatcccaacaattaccacgcagatctatttagttgtcaacaaattaatgcttggtaagattgggcagccaacggctttaggacagttcgattttgctgataaaatcgttaagttggtcttagcagtcgtaacggctacggggacggttatgttgccccacgtcgccaataaatatgctaatggcgacgttaaaggaattcgaacaagtttatattcttcatttgattttgtaacggcaatgtccgttccaatgatgtttggcttaatggcaatttcatctaaatttgctccctggttcttaggagcggaatatgttgatactggccgaatcattttcttggaggcgccggtaattctgtttattgcctggagtaacgtcacgggaacgcaatacctaatgccggttaatcgagtcaaagaatatacgctttcggtaacggcaggtgcagtggtcaacattattggaaatctgtttttgattgaaccttattctgcaaatggggcagcgatagcaaccgttatttctgagtttgcggtaacagcagtgcagctgtactttgttcgaaccactatcagtcggcgaatgttgtttaaagatctctggcggtacttattgagcggtcttatcatgtacttcgtagttttacgtctagatgaaattatgaagatgaacattattaatttagcagctcaagtaattattggggcggtagtttatctgctttgcattcttgtatttagagccccaatcgttgaacgggccaagcagattttgacagatagataaattttacaaaatcccttaaaataattacctgaattaggagaatgttttgagggattttttgtatctagaaataaagagtaaccaagggagagattttgtgaaaaaaaggatcgaatggattgatattgcacgtgggatagcgattatagcggtaattattggacattctttgggaaattattttcccggaaaatttgctaattttatttacgcatttcatatgccgatattctttatattaagcggttatttatatcatcaacaagattcaaaaaagttgatgaaaaaatcctttttaaatttaatagttccttatattgcaactgtcagtctggaattatgtattattatctttaaccgaattgtaccaaacccggttttagcaccaagtcgagcccattcgattaaggagtttatggtttcaatcgtatatgcggctggtgcggatactcagattggaagccatcatattcaagcaattggagcactttggtttttaatagcaatgttttttggaattcagcttttcaatcagataatgaagctaaatattcaaaaacacagcttaatagtcaaaggggtattgacgatgctgtgttcacttgtcggtatcttttcggctagatatgtaacgttaccatttgcattacaaccgtccttgctatctcaaattttctttttctttggcttcgtagttaaaaagtaccagcttattgataagtttgggacagtgctgatcattataagtatggctctttggcttattgattcacaatttaacctgtttggttttgttaatgcagcggctaaaaatacatggttggcagtacttgttggtatgctttcaagcatggtagtaataaaattcagtatttttcttgatagagtattgagtttttctatgacactgtggatgaagagaatcttagaattttggggatcgcagtcattattgattttatgttttcatctaattgatttggatatggttcaaatttggccagttgtggttggaaaactttcagttgtttcctacacgtttgctataatttgcggaattttatatagaatagcttttgcctcattttttgctataagtatgcctaaaattcctttactgcgaaatctatacatgaatcgccaatatcctttgaaaaatcttttgaaaaagtaggtactataccctgtcaaggtaacacttaaaaaaataaaaaattagtctatacggcctcattgcggaagtcctccgcggtgaggttgtttcgtttgctggaaatctcgactgtgttgaagtattcaacaccctgcttaaccaaatctttcagttctgccaaagtttgcggatgtgaatgatgcgccatccatatgtacttaaaatcgccccaatagtgctcaattactgcgttatcagccggagtgccaggcgcagagagactgtgcttactattgttgctggttaaatagttattgaagtcttttgaggtataggcagcgccacgatcggtatgaatcattggtgcgaaggtcccagcttgcttagcggcgcgtttaaaggcttcaattgcaccttctgccgtctcagttggtgaaatatgataactgagcgcataacgaccgtacaaatccaaaactacgtgcaagcgaactttgttgttgcgaccataggttagttctgtcgtatcggacacccacaccagattaggcgctatctgaataaatttccgttccaataaattatcctcttggtactgttgttgttctttcttgcggctgcgctttttctgacggacatcagctttaatgccgtgtttccgcatgattcgacgcacacgcttaatattgatacgaaagtcaaacgaaaaggtgtattctggaatttcttgatttttcccattctcattgtttaaaatcgcggttacttttttatgaccagcacagttctgatggcgtttttcaatctgatagattgcttccaaaattgccttgttctcaatttctctttgtgttggctgtcttttgagccactgatagtatgatttgcgtgaaactttggcaattttagtcagttcgctaacggaacctgcggtttcgttgattaattcttgaaccgcttgatatcgtccggtcgcttcaccccccgattgcgtatttcgactaatttttttgcgaatgcgatctcaagctccatttctcgattgattttctttagtcttttaatttcagcttcaagtcgctctttttcggtcatctcttctaaagctttttgtggcttgcgatgcccacgattatctttcaaggcttcccaactgtcagctgcctcatggtatttgcgaacccatgagtagacacgctgatagcttacattaaactgaattgttgctccttggtagtcattgtcatggtccaagacccactgtacgattttgcatttctcttcaaaactaacttttcgacccatttttctgactcgctttcttgacttagtctttagttcatcattattgtactggatcgaccactgttttagttgagagaggctacgaatatcatacttttcaatgattttttcacctgggaaaccggcttgatactctttgacggcttcaatcttagtatttagcgaatagcgatgattgaatgaatgatggcgaactcccgccaaaccatgcaagagaaactgccgaatccatcttgtcatcgtatcctgattgacatgatgcatatcggcatatactttgaggccggattctgtcttttgatagccgtaaagcaactctagtctattcattgtcgaataacttgaaatgcaaaaacccccttaaggaaataacacttttattatttcaagtgtcacccttaaggggattatagccatagtaccgatggaaaaatgcgttacttccaagccaatggggtaatggcaaaggattatttctatcaaaattggggtcatacttattattttcaaaaggattgctctcgattagatgatggattctataataactggggaaatgcctattactttggtgatggtggcgttttacaaaagaatcgaaaagtcactgttaacctaacaagttattgggctgataacaatggcgttttaaccccacaatttgataatggtgtaaatcgatacattatcaataaccatatcggtcatgctaacattacgtattacaatgcaattcccgaaaatattacggggacttactccggaactgatgatggtaagcctaatatgattgttgtgcatgaaactgccaaccctaatgacagtatctggggcgaaatcaattatgaaaaatcaaattataatagtgcctttgttcatgcttttgtagatagcaacagtattattcaaatttccaatactgatcatgaagcatggggagctgcttatccggctaacggtcgtgcggttcagtttgaacaagttgaggtctatggtggctggaattttgcagccgaattggtaaatgctgcttactacacggcatataagatgaagcaatatgggatgtatccacgaattgctgatggttatttaggtgctacactatggtcgcatcatgatgtaagtcgctatttgggtggtactgaccatactgacccagatagttactggtcaaatcgtgcttggactaactttggaactggttatggtatgtgggactttaccatgctggttaattatgaatatgcattattgcaataattgaaatgactcatatctctaaagctgaactatccttagaggtatgagtttatttttgaatttatgaagaaaattagaagataaggttacaaggttattgcaaaaattatcattttttaacaatcaatgtgatcacaaatacgttacataattatgtgttaacatgaacaatgttagtaattaagttaaaacatttaagatttatcaaaattcagcaatgaaagagtgggaatgattagatatggacgtacgaaaacattttaagatgtttaagaaaggcaaaaagtggtgctgcatggccttaaccacggttgctgttgcagcagggacgttaatggcaacacaaacggccaatgcggatactgtttctgctatggataacgtttccttatctacaacttctgaagctgcatcaactagtagtgagagtttttcaatttctagtgtagctagcgataaaacaactgcagcagatgaaaatgttgcaagtcaagctagtgattccagtactgaaagtgccaccagtgcagtaaatcaatcaaaaactactgccagtcaatcaacagcggaaaataccaacagccaagcaagtaccgttaatgacagtgcatcagcagctaatgctttagcaccggctaaaagtgctgagtcttcttcagctcagagtgcagtttctaatgtagtagaaccttccgaaacatcaagtgatactaattcggcagccagctcagctgaagccgatgcagaagttgcaacaatgacttcattggctgcaactacgcaaaaaaacggtctgatgactgaaaatggcaatacctattactatcaaaatggtcagcaggtaaaagataactttgtagccattaacggaaagacgtattattttaaagctaatggtatgatggccaaagattacttctatcaaaattggggcaatacgtattatttccaaaaagacggttctcgtttagacgatggtttctatactaactggggtcatacgtattactttggcgatggtggagttcgtttagatgatggcttttatcaaaattggggtcatacgtactactttggtgatggtggtgttcgcctggataatggtttctataccaactggggtcatacgtactactttggtgatggtggtgttcgtctagatgatggtttttacaccaactggggacatacgtactattttggtgatggtggtgttcgtctagacagtagtttttatttcaactggggaaacttatattatttcaatagcgatggatcattagctcaaaatcagagcgtatgggaaaatggtaatgagtattgggcaggtagtgatggtgctattactacgggtgattcagcggtagagacggcaattagtgctgcaaaaacccagattggtttagcaccttatacatggggcggtgggcgaactgcagcaacgattgcggctcaccaatttgactgctctagttttgttcgttgggcttatgcacaagctggagtttcccttaatggcggactctgggcaactacttatacagaaatctattcagggacaggggtaccagttagccagatgaagcgtggagatctgttctttatggatgataatggtcatgttggcttataccttggtggtggttggtttattcatgattcaccatcatcacctacgcaaggtgttggaatcaataacttagacgatcacttaccagcctatcctaaccttacttggcgtaatattattacagcaacgtggaatggtgtctatggtgttcgtcgagtagcatagacttaagatatggtaaataaaaggcctttttgtaaggccttttattgtgaagaaaattcgaagataagattacagacctattgcaaaaattattgttgtttaacaaaaacaatgattggttatattacgtaaaattctgtgttagtatgaacagtgttatcaattaaattaaaaattaagaccattaaaatttattaaactttagcaatggaagggtaggaatatttagattatggatgtacggaaacactacaagatgtttaagaaaggcaaaaagtggtgctgcatggccttaactacggttgctgttgcggcagggacgttaatggcaacacaaacggccaatgcggatactgtttctgatgcggataacgtttccttatcaacaacttctgaagctgcatcaactagtagtgaaagtttttcaatttctagtgttgctagtgatagcacaaccgcagcagacgaaaatgttgcaagtcaagctagtgattccagtactgaaagtgccaccagtgcagtaaatcaatcaacagcagaaaatgccaacagccaggcagctatcgcaagtaccgttaatgatagtgcatcagcagctaatgctctagaaccggctaaaagtgctgagtcttcttcagctcagagtgcagtttctaatgtagtagaaccttccaaaacatcaagtgatactaattcggcagccagctcagctgaagccgatgcagaagttgcaacaatgacttcattggctgcaactacgcaaaaaaatggtctggtaactgaaaatggcaatacctattactatcaaaatggtcagcaattaaagaatggttttacgactattaatgggaagacatattactttaaagctgatggtacgatggtcaaggattatttctatcaaaattggggtcatacgtactatttccaaaaagatggctctcgtttagatgatggtttctatactaactggggtcatacgtattactttggcgatggtggtgttcgtttagatgatggcttttatcaaaattggggtcatacgtattactttggtgatggtggtgttcgcctggataatggtttctataccaactggggtcatacgtactacttcggcgatggtggtgttcgcttagatgatggcttctacactaattggggacatacctactacttccaaaaagatggatctcgtttagacaatggtttttatactaattggggtaatgtttattactttggcaatgatggagttcgtttagataatagcttctatactagctggggcaaggtttactactttggtgccgacggagcacgtgtaaccaatgctactattaacctaggatttggtgatctgacatttgatggcaatggtgttctttccgattctaattcatttattggtagtattgtaaatggagcaattcgaggctggactcaatataagattctgccatcattaacgcttgcacaagctattcttgaaagtggttggggcaagtcgaccctggcttctcagtatcataacttgttcggtattaagggatcttataatggacagtcagtaacaatggcaacggctgaatatattaatggcagctacattaccgtaaacgcggcattccgggcttacccagataatgatgcaagtgttgctgatcatagcttattcttcattcaaaactcccgttacagtaacttaattggggttactgattccaatactgcaacgtatctggttcgagcagatggctatgcaaccgatccatcgtacacgacttcattgagaaatatgatcagtacttataacttgacacgttttgatcaagtagcttttcgtctataatttaagaagacgacttttaccaaatggtcgaagtcgtctttatttttacaattattacagaagcattgcaaagattattgttgattaacaatcaactgaaaaccatcgattataggcttttttatggtaaggtagtaaacgttaataaatattagtaaaaattaaacttttgaaaataaatttatgaaaggacttttgtttgatgatggaagcaaaaaaacactttaaattgtttaagaagggtaaacaatggtgttgtatggcaattgccacaatgaccgtagctttaggcgttgctgcttttaatgctcaaaacgttaatgcggatacggttaatgaagcacaaaccacggctgttgcttccacaagcacggaagttcaaagtgagaatgtggccgaacaatctaccgcaagtgaggtagattgttcggccactgatactactgctgttagcgaagtaagtggagcagattcagcagctaccagttcagttgctgaaagcagcagtgagaatgctcaaagtaatacccaagcagcttctcagagtgcatcgtctaatagtagtgcagctttacctgctgcaagtgcagaagcctcttcagctgctgaaaatgtagcgtctgtttcttcctctgtaaatgaagaagttgctgacagtgatgtagcaatgactacgttgtctgctcaagctgttaagaatggtttagttaccgaaaatggcaacacttactattatcaaaatggtcaagcggttaaggattattttttgacgcaaaacggtaatacctattattttaccgctgatggtacaatggccaagaactacttctacagtaactggggtcatatgtactacttccaaggcgatggtgcacgtttagataatggattctacaacaattggggccacacatactacttccaaggcgatggtgcacgtttagataatggattctacaacaattggggccacacatactacttccaaggcgatggtgcacgtttagataatggattctacaacaattggggtcacacgtactacttccaaggcgatggtgcacgtttagataacggattctacaacaactggggcaatacgtattacttccaaagtgatggtgcacgtttagataacagtctttatagtaactgggggaaccagtattactttgatggtaatggtgccttagtaaagaacgctaatgttactgtcaatggagttgcatataaagcagccagcgatggtgttttgacctctgttaacgatgcaatcgtacaattggctttgaaacttaccacaatgaatattccttatgtttggggtggtgattcattgcaatgcatggattgttctggtttggttaaatatgtgatgtcacaggtacgaggcttaaaccttcctcataacacaattgctcaagagggctacttaactgcccgtaaggcggtaagccaagcacagcctggcgatctgcttttctggggtaatgcgggtgcatcataccatgtcgcaatctacattggcaatggaaaatacgttcacgcaccgcaacctggtgaatacgtaaaagttggctacattaactcatactttatgccatcgtttgctggtacgcttcgttaaatttattaggcattggcatgacggaagagtctgccagtgcttttttattgttgattgccattatcaatactagtataattcgattatgaaattgtccgttaaattaaaggagattataaaaatgcattttaagaaagtattggccactattgcaacttttgggttaatgctatccttaactgcgtgtggaagtaaacaaaccgtttctactagcagttcaagtaaatcagctaacgtatcagcaaaaacatctggatcatcatctgttaaatctcaagacaaaaaatattcagaagctcaatatgcaatgatggcatatctcaagagcgcaaaaaaagagggtactaatactggaaatcaatcagtacagataactactaataataatttaaggcgaagaataagtgacaatcaagaacaatatacggttactaatactgcaaagaaggtaactgttaagtcttcagaagcttcccatgtcttttcaaaagatcaactaactaagtctttacagaaaaatgttgaaaatgtgaacgaattactggataaaaatagtgattcatccgacaacttaagttcttcaatttcatcatcaaaagaaagcaacgttactgaatcttctagtagcagttcaccatccagctcttcgagtgcatcttcatcatcaagtagtcaaagtaccgcaaagatgacagctactgatgcaaaggctatgcttaaagaacacgtcagcgttgaaagagaaaaagctggtttaagtggtcaatcagtatccgggatgccaactgctgatgatgttgacagttttactatgaatcaaaactctgatggaaattggacggcaacaggcatgattaatggacagactgttacctacaacattactccatcacaagtatcctcaaataactaataataaaaggatagtacatcatggattattagaaattcatgatgtactattttattaatgtgtatttttattatagaaagaagttttaaaaccatatgagtaaaaagaaacaattttctcaattttttattgctctattattgataacaaattttttgataatgctggtttggaatttaaaaacaccattaatggatgatgatttatggtttagatatcaagcagttcaagggcatataataagagatggtatacaagattatatgacttggaatggtagattttggggtcagacattttgtcgagtttctttgttgggcggtcaaaagggatcgagcattttaaatgcatttttatttgcaattttgatttttttaatcctaaaaataacagatgcactgcaagatgaaaatttttctctattaagagtagttactgttatatctgccatatatctctttactcctggatttgccagtgtatttatttggcgcgcaggagttggaaattacatggatacaatgattatctatattagttatcttttattattcgtaaatgccactaataaaaaactagcctgcctatatctacctatgttagggttctttgcaggatggggaaatgaaaatacctctggtggtgtgatcctaatatcaatacttgtaatttgtatccaatatgtttttacaaaaaggttttatttaagtcaaatgttaggattagtgtttagcctaattggattggcaatattggtaatgtcgccaggaggacataatcgattagtaacaactcatccaaacttcttacaagaatctatcattagaagaactttaagcaattttaaacaattggttgcttttatactatcacaaaagcagatggttttattttttgtattattggttttagtaataatagttgctactctttataataaaaatcgttatcaatatcttataggactttcatttgtaattggaggtgttgcctcaattctagtgttggcatttgcgcctgaaggatttaatgaatctcgcgctttctctggtggatttatattaatgattgtaggaatatttaaactactttcttttaatgcggaaaatagaatttctttaattataaacattataagcgttttgattattatgttgtcgttttaccgagttgtagttggatataaagatgcaatggtatttaaccataatttgtcagcacgttattcaataataattaattcaaaaaataaagagaatgtgtatgttgaacctatttcatataatagtaataatgattattcaattgaaaactccttttttgaattaacaaatgatcctaatgcttttccaaataatgtgtatgaaccttattttaaggtgaaaaaaatctatttaaaataaacatttatgttctgtaaattacatttattaaggttggaatttaaaatgtcaaaattatcgattgtagttccttgttataacgaagaagaatcaattccattattctacccagctgtggaaaaagtcgttcgtcaaatgaacgatttacaaattgaatattggtttgtcaatgatggttcgtcagataactcactagctgaaatgcgcaaactacacgaacaaaatcctgagcgcgtccattacgtttctttttcgcgcaactttggtaaagaagccggattatacgctggattacaagcagccactggcgattacgtcgtggtaatggacgttgatctacaggacccgccagaatttttgccacaaatgtatgaattgctccaaacgggtgaatatgactgtatcggaacgcgtcgtgtcgatcgtactggcgaagccaaattcaagtcgtttttaagcgatcagttttaccacgtcattaaccgtatctcacaaaccaacattgttcccggtgcacgtgactaccggatgatgacacggcaaatggttgatgccgttctatcattaaaagaatataatcgtttttcaaaaggcatcttcagttgggtcggatttaagaccaaatatctggactaccataacgttgaacgagtggccggtgaaactgactggtcaacttggaaattgttcaaatatgcaatggatggaatcactgatttttcacaagcgccgctttcgattgcagtgtggttaggaacgacttcattcgtgctttcaattattggtctgttgtttgttattattcggcggattgttgaaccaggcagcagtgtctttggttgggcttcattgatctgtatcatcctattattcgggggacttcaattgttatgcattgggatcgttggcaagtacattggacgtatctacatgcaggtcaagcagcgaccaatctatattattaaggaaaagaaataatgataaaacgaaaaagcctgctgttttggtcagcagaactattaattgtcgctactttaatttgggtttgcactaaactggactttctgtttcatcccatcatcgtcttcatatcagtaatctttgtaccactaatcgtttcaatctttttatattacatgacgagtccggcctttcgtttgttaattaagattcgcttaggtaaatggcagatgaaacgtgggatcgccagcatggtgatcatcttgggactcttgctgctgatagttggtagtctcgcagtcttgattccaccaatgattaaagaacttaatcaaatgattcactggctgccaagtgctaccaacgatatgcagcattggctcgcacaagcttctcaaaaacatgaatggattcgcaagatcgacctggcagattattatcaacaattcaacaagcagattaccaaatacgctgaaaagctgttggcgggtctaaccagcagcgttggctcaatcatcggtacgattaccagtgcagttgtcgtggtcgtaaccgtaccagtcatgcttttttatatgctgaaagatggcgatcgttttgtaccaaacattcagcggttcttttctgaaaaacatgccaaagaggttacggaactgctacatcagatgaataagacactttcttcatacatctctggacaaatgatcgaatgtatctgtgttggaattggtacctgcattggctatctgattattggcgaaccaatggcaatcgttttaggcctggtagctgggatcaccaatatcattccttacattgggccatatattggtattgcaccagccttaatcgttgctttggcagttgacccgcagaaaatcatctgggttattgtggtagtgattgtcgttcaacaaattgatggtaatatcatctacccaaatattattggcaagagcctgcaaattcatccattgacgattatcattctgctgttggccgctggcaacatcgctggtttgctagggatgatcttatgcgtgccactgtacgcggtagttaaaacgatagttgattactgcatgacgatttatcgcctggaaaaaaatgacgcaaaataatttactataatatgggggaatagtaagttgaatgaaacatatataaagttacagaaaagaaatataaaaaaagatggactagtaatgttactatttttaacattcagttttttaatgattaaaaatggtattcaatctggaaaaattactactgggactgattggttattccacgtttcaagagttgagcaaatctatcaaaatttaaagcaaggttctttttttacctttatagcaactgatgtttttaatcaatctggagtaggaacctttcttttttacccggatgtattcttatatccctgggcattctttcgttttttcttaaatccaatcaattctttttatgcttggtattttttattaacgtttttgtcatttacaataagttattttacaatgaaggaattttccaatgataaccttgtaatggcagtttcattttcatttctatatgtctgcaataattatagattatttgttggaactgcggtttttggtgaattcattgcatcaacgttcttaccattatgttttttgggattctatgaattattctttcgtaatgaaaaaaaatggtatttactaagtatcggactttcattgctaatttattcccatgtattaagtgtcgttataagcattcaattatttatttttattctgctaattgggataatttgtggcaaattttatgatttttttaaacgttggaaggaattagttaaggctatcatattaacgattgtattgactggttttattattttcccatttgtttcagattatattggaaaaaacattcatgcaccatatagcttaataaatattgattttactcctagtgtttcaatgcttttattaaattcactagataataaaatatggcaatcagtcggtatttttattattgtggctttgcttattggatggtattttgttagaaaaaataatacctatacgtctatatatattttgggaataatatgtttagtgctttctacaaaaatttttccatgggctagtgttaaaatctttttctttaaagttattcaacttccatatcgttatttagagtctgcttgcttgtttttagcaataattggatcattaataattcatactatttttatttcattatctatcaacacaataaaaagacagatagtagggcttatggcaattacaacaatttttttaatggcttttgagggaacctatgctaataatcctggattttatccaagtgaaaaaaataatactgtaacggtactacaaaagccatcccaaaagtatacaatgtttccaaccacaacattgataaataaatataattaccagtatatatttgattataggtgtccaattggcgatactgattattacactgaaaaaagttttaaacaccaaaaatctatcttatctcaaataacatacattaataataaaggtgaacatatcaaacctattactgctcctaataagttcatcttcaatgcgaatctaaataagaagtcagatattgatttcccagttattgcatattcaaatacacgggtgaaactggacgatattaaaaagaactatactttgagtaaaaggggaactccattgctcaaaaatgttaatcccggtaagcattcgtttgtaatagaatacatccctaataaaatcttttatttgtgtgtaataagtgcaatagctggttggattttgatactaattaagagcctttataatatgtataattctcgaaaggaacataaaaatgactgattcaaaaaaattggcagaagccgttaataagcgccggacgtttgcgattatctcgcaccccgatgctggtaaaacgacgattactgaacagctgcttttatttgggggcgtcgtccgcgaagctgggactgttaaaggacgcggcagcagcaattttgccaagtctgactggatggaaattgaaaaaaagcgtggaatttccgttaccagttctgtaatgcagtttgactaccagggcaagcggattaatattctagatacgccagggcacgaagacttctctgaagatacttaccgaactttgatggccgttgactctgccgtcatggtaattgatggtgccaagggtatcgaaccacaaaccaaaaaactgtttcaaatctgtaagatgcggggaattccaattttcacgtttatcaacaagtttgaccgtgatgcccgtgaaccgctggatctgttaaatgaaatcgaggacgtgctgggaatcgaaacttacccaatggactggccaattgggatgggacggcaatttatgggtgtttatgatcgttataatcatcgagttgccctttcccacccacaggatcccgctaacccttacctgccattagatgaagacgggcaggtgattggcgaaaacccattggctggtgaaggtgaatggaaagatgccttagatggaatggaactgattgaaatggctggcagcgagcttgatgaagaaaagatcgctaaaggtgaccaaacacctgtcttctttggttcagcactgaccaactttggggttaagactttcctggagacctacttgaaatttgctccagccccttcagcacacaagacagaagacggtaaatcaatcgatccactggcacctgagttttctggctttatctttaagattcaagccaacatgaatcctaagcaccgtgaccggattgctttcgtacggatttgttctggtgaatttacacggggcatggacgttaccttggagcggactaaaaagccaattcgtctgtcaaatgtgaccgagtttatggccaatacgcgtgaaaacgttgagaatgctgttgccggtgatattatcgggctttacgataccggaaacttccaaattggtgattcaatctacactggtaaacaagacatcaagtttgagaagctgcctcaatttacgccagaactgtttgtgcgcgtaacgccaaagaacgttatgaagcaaaaatcattccacaaagggatcaaccaattggtacaagaaggggctgtccagctctatactggctataactccaacgactacattttgggtgccgttggtcaattgcagttcgaagtgttcaagttccggatgcaaaacgaatataattccgaagttattatggaaccactgggtagtaagacagcacgctgggttgatccagaacagcttgatcctaagatggcttcttcacggaatatgctggttaaagatcgttatggtgctccactattcttgtttgaaaaccaatttgcggaaaattggttcaagcagaagtatccagatgttaaactgacggctaaactgtaagaaaaataattacaatccataataagatttgtgcctattagttagtaagcatactataaccaaccgcatatgattaaattccaagttctcctatacttgaagatatatttaaagaggaggacttttttatgaagcaagattttgtctaagttgatagtaagcacaccgtaacaacatgtataaccgccgtacggaccttctatacttgaggaaactcatataggaggtctttttgatggctcaaaatgaaatcgttgaagtcagcacaacttcgtaagcacactataaccaacgtaagcacactataaccaaccgcatatgattaaattccaagttctcctatacttgaagacatattcaaggaggaggacttttttatgaagcaagattttgtcgaagttgatataccgcgaacaaagaagcggttgctaagcactcacgcttggcagcatcgtttcactgcaccaagtaaaaattaatgtctaccaagaagcagatcccgctttggttagtgagatcattaaagcagtagccgcttatgctggttaactggagtgctcctcagcacgtctacatagttgtggcaagaccgatctgcggaagggcattgacggtttggccatggtgatcgcagagaattacggctttggaattagataatgattcgcttttcctgtttgtggcaatcgtaatgaccgcttcaaaggcttatactgggacggtgaaggattcatcttactctataaacgctttgaaaatggtgggattacgatggccgcgacatcgagaagacgcagtggcattaaaccaagagtcagattaaggcattgttagaaggtatctcgccactgcctcagaaacgaatcaggccagctataagggaccagggtattaacaagttcctcttttatttgcctcattatctgataacctaatggtcatcagataatagaggaggtgattggtaatggctgagaagatcactctagaagaagctttgcgtgagaacaaagaactaaaggctaagatcgcggaactgacacgagatggtaaactatctgcaaaagcaacttttggaaaaaaaaaactgaaaaattaagtgctggccagctggatctgtttgatgataaagaacaggaaaccgcgccaacgaatgattcaacagtcgaaaagttgaccactaccgttaccagtcatcagagaaaatgcaaatcaaaggaatcacgtaaagaatggcttgattgcttagaacaagttgaagaacttcatcagctgagtaagcaagaactaacttgtgatcaatgcggtcaaatgatgacggttatcggcaaacatgaacagtatcgtgaagttaaactggttcctgccccttgtgctgcaaaatcgtgatgtactgaaacggctagatgcgaacactgtcaagatccggaaaactggcaatgatgtacttgttcaggcaaagacgccacagcctttgtttccacacagttacctttcaagctcggtaatcgccgaagtactttttgaaaagtttggctggcagtaccgtttacccgccagacgcagtattgggagcgcctcgggcttccaatcaccagtaaacatatggctcgtggggtaattgaagctggcgaaaggtttgggcaaaagattatgaaagtctgcgtcaagaaatcaaggcagcacctgtggtgcagcttgatgagacgccatttcaagttctggatcttgatcaatcacatggctacttctggtcagcctgttctacggaagaattcagtccgcatcaggtatcttatttccactatgccccttcacgatcaggaaaggttattacagaaatcttaggtgatgacttttctggcggtattatgtgcgatgggtttagtggatattctgataatcgcttaccagaagcatattgggggacctgtctggtcatatcaatcgccaatttaagagctgcttgatccaaagattacccctttcaagggcaaagtattgcgagtgacgctgtgcggatcctcgccaaagtatttcacatcgaaaaacggttgaaatattcatcagcaagggagaaggcagcccaaagggtcagcatttaaaagcgatgattgatgatttctatcagctgatgaaaaggccttgacgaaatcgccactcaaaccgctacgcaatgcgattaagaatgccctcaaattgagaagaaacgggtttaccagatgttcaggcatggagagctgccattgcataataatcacaatgagcaaatgattcgtcccaccacgctggtcagaaagaacagtctgttgcgaagtccacggctggggccaaagccaatgcgatctggtatagcatcgtgcaaaccgcaaaactaaatcatttggatgtctttaaatattagagaccctgcttagcgcctttacaaaacgcgaaacgccagaaatagaggctatttgccatgggctcgtgaaattcaagaaagctgcaaagcctaattgataaacgaacagcggtcgaccacgcagaaatgcgctggtcgaccgctgcttttttattctttaatttttgaaattgtccaccgcttagtaggcaacacggttcaatatggtgtgcttacactttttcacgtaaataggcctccaaaatttaatacagttccaatatataattggtctgtggtcccctgtcaataaaatagacaatttaaatagagtttttggggagtgtaaaattgtttgtgtaaatttaaaggagatattgaaaaagggaaagccctccccgtatgattgaaatcgtcaaaaaccaatcagaatacggaggctttccccatggaagattctatcaaaaatatcattaccgcgctactggcagatgtcgattctgctttaaaagagctgtttcgggcccaggtcgaagatgccgtcaatcagttcctgcaaaatgagatgacggccgtactgggctatgagccttacgcgcgaactggtcaggatgggcaacgaaactatcgcaatggctactataaccggtcctttgactcaacgctgggcgacctcaccgtcaaaacgccacgcgatcgactggggctgtttaagaatgccctgtttgagccctacgcccgccgtacctcaacgcttgaagaaacgatcatcatgatgtactccaaaggcattacgacgcgagaaatcgccgaactgatcgagaagatgtatggccagtactattcgccagcgacggtgtccaacattaccaaacagacagcgagcctggtcgaagagttccacaaccggaagttcaagcagtcgcagtatgtctgtgtcttcctggacgcgacctacattccgctgcgccgcgataccgttgagcgagaggcagtcaatattgcgatcggtatttgcagtgacgggaccaaagaggtgttggactactgtattgccccaacggaaaacggggtcgtctggtcggagctgcttagcggactgcgccagcggggaatcaccgacattcagctgtttatcgccgatggtatggttggacttcaaggcgccattgagcgaaactaccctcaggccaagtttcagcggtgctgggttcatcttgagcgcaatctttacggctacgttcgcaaggcagaccgcagtgatgtcgtcggtgagtttaaagagattcgcaaggctaaggatctccccgcggctcgtcaaaagctgaatgacttcatcgagcactggaagaagcgttataagcgggttgagcagctggctgagttaagcgggctctttacgttctacgacttccccgaggcaatccgctccacgatctacaccacgaacgtaatcgagtcgtttaacaagcagctcaagcgtcagatcgacaagaaagagcggttccccaatgaagatgccctggattgcttcgtcatgacgcaggtagcgacctacaacgatcagaacgtgtccagaatacgccgaacccgcactggatttaccagctgtaaggacacgcttgacgcaatgttttaaaaaccaggcttcatcatacgcagaggaagatccctttttacataaaattattgacacacccttatggcttacgattctttaaatcttttaacaaaatttgacgatagcgctttacatctgctaaagttagagggttagttatgataaaaaattggtttattggagtatagcaagacaatgaatggcgactatcaaacacgtgccgaatatcgacacgatcataatcaaaataatcagtcacaaaacagtcctaaaaagccgcgtaacaagctgcgctgggtctatcgctttattggtttgatcatcgtattgctttgcctcggtggtgcttatgagtatcataagattcatagtactgctcaaggcgtcttttctgacggttcaggcaagatcagcaagaaactgaaagaaggcaagccggtatcagttctggcaatggggactgatgttggtgctctggatcgtgggaataaaggtggtaataccgatacgcttgaattggttactattaatcccaagaaagaaacggttactatgaccagtattccacgcgatatcttgatcaaggttgatactgacgaaggtgcggactatgttaagctgaacgccgcttaccagatcggtggcgctaagcagactgtcaagcaggttaaagagctcttgggcgtgccaattgattactatgccgttgtcaacatgggtgttttgaagaaagtcgttaatgcggttggcggggtcgatgtcaacaacccatttgcctttgattatgaaggccagcattttgccaagggtaagctgcatttaaatggtcatgacgccttgcagtattcccgaatgcgctatgatgatcctaaaggtgactatggccgtcaaaaccggcagcagcaggttatgaagagtgttatgaagaaattcaaggagtcgggttccatttcggctgccaacaagattatggacgctgtcaaggatggggttaagaccaatattccaattgacaacgtggcaactttatacaccaactatcatgttgcgctaaagaatattaagactgaacatttccaaggcttggatgcgacaattgagggcgtttctttccagatcgcctcgccaaaggaaatcaaccgagtttcgaagctaattcggaatcaattaggtttgaaggctaagaaagtcgttaacaatgaaaccaagatgtacaatctgcagacgacttatgatggctacaccaacaccaattttgtcttgccaaacggcgcttcttacaatacgcctggcagcggtaccagcaatacgatcagctcatcctctaaaaaatcgagctcttcgctaagcggcagttcaacttatggaacgacgtatagtgctgatacgacttatggttcgtactccactaataactctactagctatagtgctggatactaagtaaaagcattactgtgacattgtcagagtaatgcttttttattatcgatattctataaatagagagttcggaaggtgaagtattatattctgaaaacttgattagtcctttatttatagagatgctttttaatatatttattttttgtggataacaatagggagtatagtatgttacattctcgttacttgcgatgctcctttttagtaagcgctaaccttactgatatatagcagataaataaggagatgtcaaattaaagatctcttatttcgtaatgtttttgaaatatttgttacattattgtttgaaatgaagtataataagaatgtaaagaaataaggaaattcattcaggaaattctaatttgatcgggggtaaggatcatgatgaagctgcaacacaaaattttaacaagttcaattattttaatggctgcactgggactgacgggttgcgccaccagttccaacacctcaacaactactggtcaagaaacaagtagtgcaaaggtaactaagagtgccaagagcactaagagagcaaagaaggcagcaagttcttcaagtcaagctcaaagtagttctgttgattcaagcagttcagcacagaacgagaactcaactgtatctactccagcaacttccagtagtgagacggctgtttctaaagcaactcaaactagtacggctccagtaactaccactacaacggtaacccaaccaacaaatgttaatactgacaaggtagctgaatccagcagtgttgtaaataacaatgaaaatgccaatattgaatcacaagtagtagcacaacacgttgatactgaagaagctggcatcattaatggattagtacaggctgccggtctgcaacaagaaaatggtgatcaatacactgttacgaaaggcgaagatggctactaccaagtagatgtacgcaattcaaatggtgacccagatgttgctcacttgaagggaatctaccaatacaacccaaccactaatcaatacaagacaatggatccaacaaccggtgaattcaactagttaacgagtaggctttcatcctaaacgatgagagctttttctatttataatgaagtattatatttaatatagggaaattaaatgtacttttggagatgatgtttttgcggctattggtaactggtggggccggctttattggcagccattttattgattatgaacttgcacacgatcaaagtattgagatcgtaaacctggatgctttgacctatgccggcaacgttgccaacaacgcgcaggcagccgataatccccgctattatttcgttcatggcagcatcaacaatcgggagctggttgactggctgctgcaggaatttgccattgatcatatcgttaatttcgcggctgagtcacatgttgacaattcattaaaaaatccagagctctttaccaaaaccaacgtcttaggcacgcaggttttattggatgctgcctatcaggccaatattcaaaaattcattcagatttcaactgatgaggtctatggtacgatggcgcctgggcaagcggctaaggaaaccgatccgctgcgtcccagttcgccatacgctgccagcaaagcgggggcagatatgttggcgatggcgatggtgcgcacgtttggcatgccaatctgcattacgcgcagcacgaacaactttggcccgcgtcagcatcatgaaaaactgttgcccatgctgattcaaaacgcgctgcgcaatcgaccgcttaccatttacggtcaaggtaccgaccggcgtgactggttgtacgtcaaagacaactgcgcggccattgatttggttttgcgtcatggtcagttgggccagatctttaatatcggtgcgcatcaagaaaagagcaacaatgaggttacgaaaatggtgcagacggaattgggcttttccgatcagttgattcgtcacgttactgaacggcctggccatgatctgcgctattcgcttgataccagccagattgaaacccagctgcattggaagagtcagacagattttgcgcttggtctgcaggagacgattgcctggtatcgcaagtatcagcgttaagtggcagcgcaaaaagtcccgagttaattgattggccaaagtgcagcctagtttcagcgcagaaattcccgtgttaattgactgacggcggccttggttttgcggtcgttgccagccgagtttgccagcgtcagcgcggaagtccttgtattaatcgattagtcaaagtacggcccagtttcagcgcggaaattcccgtgttaattgactgatggtagccttaaatctgttttgtggtcgtcattatgatggttgccagccgagtttgccagcgtcagcgcggaaatcttcgtgttgatcgattggccaaagtgcagcccaaattcagcgtgaaaggttcccgtattaattgactaacaacggccttaaatctgttttgcggtcgttattatgatagttgctggttgagtttgtgaaaaaatcaggcacatctggacggcgctctttaaaattacctactttgcgatgcttttttgaaaaaagtaggtaagtgcatatgcgatttcgagaaatttacctactatggggcgcattttgccgaatagtaggtaaacttgcatatttaaagggtgatcggaccagaccgtttttgtgatttacctactattggggaatttttgatcaatagtaggtaatgttaggataccctaacttgatatacaatattttttacctactatacatcgcttttttgcgaaaagtaggtaatgatgttttcgtcatatgatttatacaggattttttgcataataacgattttgatgagcttatcgttagcattactgactgatgattccctactttcgataagttaattgttggtcatcaagactgttagcggttcggggatctggctgttgcaaataaagtcaggctatgctgaaaatatgattgttccaagacaataatttcaagtactaaagcgccggaccacctttacaatcgttcgacgtttttataatgtaatgatttctcatcgggaattattgcagtgcattttagcgaattagatgaccgcctggcttttatgctagacggttttttgattattaggaagttgctgctgaacaatcttcttatgatgaagttctaaaagaaaaagcaacttctaagagcttctaaaaagatctaaaagcggttcaagatccaaattctgtttattatgactatctcgagttttagaggattggtttcgtttgtcggcgttgaaaaattaaaatagctcgatcgtaatggtcgggctgttatttatatagtagaaaaaatttaaaaaatcgtggcggcagctggatcgcaaaaaattttttaaagcttgatccaatcataactgtcacgttttactcggtgcaaaattcttgtcaagccttgatatatcaatgattagcaactaagatagtctttggctctttttggaagtgatgggatttttatcatatatccagaaaaaattagggcgatttttgagcgtatcaaacgataaattagcgttaaattatacattgaattcagttcgatatgcgattcatgccaaaacaagaattgagttttaacatgcttttgatcgccttaacgtacgattatgaaatctattttataaccttgatctgcaataacaaatcgccgactacaacatatagtgatgcaaaagtcaagggttaactagatgttgtgttttgcgttaatatagatcatgttaattaagagggggacgatggctatgaaactgcagacggaaaaaaacaccgggctaaagagtctggctgatttgaaagttatcaaacgcgatgggactgaaacgcccttttatgcctataagctgaacttgatctttaagtcacttgacgcggattgggcaacgcaacaatccgtctgccaagctttgtcacaggcctttaaggatcaggcaagcgccacgaccgttgagatcgctgaaacttttgttgatggactgcgccaggcgggtcatgatgatctggccacgcgctacattgaataccgcaaacaggatgaagaagcctttgccgaggccactaatccgatgaacaagctccatcagctgtttggccgcgattcccatatcgtgcacgaaaatgccaacaaggattcgcgcgtctttaacacgcagcgggacctggaagccggcgtggtcagtcgggcactgggcttgaagatgctgccggaagtcgttgccaaggctcatctgcgcggcgacatccactggcacgaccttgactactcgccagtaatgccagaaaccaactgctgtctgatcgactttgacgaaatgtttaaaaacggcttcaaaatcggcaatgcctgggtttcatcgccacgttccattcaaacggcgacggctcagatgtcacagatcattgccaacgtggcctcactgcagtatggcggctgttcggccaaccggattgaccagctgttggagccatatgccaagcttaactatgaaaagcacatgaaagatgccaaggaatgggttgcaccagacaagcaggaagcctacgccaaggccaagaccaaaaaagacatctatgacgcgatgcaggctctggaatatgagatcaacacgctctactccagtcaagggcagacgccatttacgacaatcaactttggtttgggaacttcctggatctgccgtgagattcaaaaagcaattttacagattcgcatcaaagggctgggcaaggaacatcggacagcgatcttcccaaagctgatttttactttaaagcgcggtctgaacctcaagccaggcgatcccaactacgatatcaagcagttggcgctggaatgctcgactaagcgaatgtaccctgacctgctgatgtatgacaagatcaaggagattacgggctcatttaagacgccaatgggttgccggtcgtttttgcagggctggaaagatgaaaatggcaaagaagtcaactctggccggatgaatctgggcgtggttacggtcaacctgccccggatcgccttggaggctcatggtgacaagcagctgttctggcagatctttgatgaaaagatgaacattgctaaaatcgcgttggattaccggatcaagcggaccaaagaagccaagccggaaaacgcgccgctgctttacatgtatggtgcgtttggcaagcggctgaagaaagacgacagcgttgatgaagtcttcaagaacagccgcgcaaccgtatcattgggctacattggtctgtatgaagtctgctcaacgttctacggtccaaaatgggaacacaacaaagaagctcacgactttgcggtttcaatcgtcaaacagatgcatgacctttgtgcgcaatgggaaaaagaagaaggctaccacttcagcgtctactccacgccagccgaatctttgacggacacgttctgccgggatgatgaaaagaagtttggcctggttgaagacgtcactgacaaggaatactacaccaacagcttccactatgacgttcgcaagcatccgacgccatttgaaaagctgacgtttgaagaggacttccctaagtatgcggcgggtggtttcatccactactgtgagtacccaaacctgcgtcagaatcctaaggcgctggaagccgtttgggactgggcctatgatcatgtcggctatctgggaaccaacacctcaatcgatcaatgcttcaagtgcggctttaaaggcgagttcaaggccacggcgcgcggctttaagtgtccacagtgcggcaacaccgaccctgcaacctgtgacgtggttaagcggacttgcggctaccttggtaatcctcaggcacggccaatggttcatggtcgtcacgaagaaattattcaccgggccaagcacatggatccaggcatgatcaagacagccgctgaatttcaacggagccggcagctggatgacaaggcgcatgccaacatcaccggcgatcagatctagcaggctgccagcgtctggctcagcatcttaagcagccggcaaaatgctcagctcggttttagacaaggtgctgcgtctgcattttagaaaatcaaagtgctgaatccgtgtcttggaaaattcaacgcctgcaatttaaagaccacgcgatgactggttcaatgatcagcatggctggaaagaatcgctgacttaaaatgacgccacattaagcctcagtgcttcaatcaaaattaaacaactcgtgaataccgctaagggtccgcattcggctagaccgaacgtcgggcctttattgctttagaaaggaagatatacatggcaaaagaacgtccaatcagactccccaagaatcctaaacccaaggaatggctggccgaggatcattccttacaatacattgctgactacaagccatttaactttgtcgatggtgaaggggtgcgctgcagtctttacgtcagcggctgcctgttcaactgtcctggctgctacaacaaggctgcgcaaaactttcactatggccagccctattcacaggaactcgaagatcagatcattgaagacttggatcatgactatgttcaaggactgacgctgttgggcggggaaccattcttgaacacccaggtctgcttaaagatcatcaagcgcgtgcgcaaggagtttggccataccaaagacatctggtcatggtcgggctacacttgggaagagctgcagcaggaatcatatgacaagctggaaatgctgagcctgatcgatattttggttgacggccgctttttagaagggcaaaaggatttgacgctgcagtttcggggcagtgccaaccagcgcatcattgacgtgcagaaatcattaaaagccaaccaagtcgttatctgggataagctggttcactagaaaagaggccatcatgacattaaaaatcaatcatctgcatgccattatcaaagataccggcgaagaaatcttaaaaggcgttgatctaacggtgccaaccggtgagattcatgccatcatgggtcccaatggcacgggaaagtcgacgctgtcagaaacgatcatgggctatccggcctatgaggttacgcagggtacggtagcgtttgatggtcaagacgtcttgagcctgccagtcaacgaacgcgccagattgggaatgtttttggggatgcagtatccagccgagattcaaggagtcaacaatgctgattttatccgtacggcaatcaatgcccagcgccctgaagatgatccattgccagtgctgcagtttattcaacgcctgaaagaaaacatggccctgctggaaatgcccgctgatattactgatcggtatttaaatgtgggcttttccggtggggagaagaagcgcaatgaagtactacagatgctgatgctgcagcctaaactggcgattttagatgagattgattcaggactggatattgacgcgctgcgaatcgtggccaaaggaatcaatcatctgcgcggtcctgaattcagtgcgttattgatcactcattatgagcggctgctggagtacgttacgccagacaagattcacgtcatggtggatggtcagatcgtcaagacggcgggaccggaactggctgacgagctggaagcagacggctatgccaagtatgaaaaaatcagaagaaatggcgtgagcgaatcaactaccccagaataaattctgaggtttgcagtctcatctattgctagatagtggtcatagcgtcttgcgactcccacctgtgagaccgcatcgtcggacagttgacggtgcccgtttatctgccaagtattactcagcagatgcctgtttgttaaattgtggggcttcttcaccactgcggtaaagcgtccccaaaagctggatgttcatcgcacctagtctgtcatcgtttgacttgtagccacaacgatcacaaacgtacaaatgctgcttgtgatctcggttttccttgcggattcgcccacatttcgggcaacgctgactggtatatttagccggaactttgaccactattgaggagttcagattggctttataagtcaaaaactgttcaaactgatagaacgcccatgataccatctcatagcgcttgtctttagcggtctgttcagttgcaaaacgcacgtcggttaagtcttccaaggcaaaaacagtatttgccccgtaatggtcaatgagtgtcttagttaagcaatgatttacatcactcatccagcggttctctcgttgaccaatttgcttaagacgacgcttggcggacttagtaccttttgactgaagctctgctctaagctttttatacttacgtctagttcgcaagaccttctcaccactataaagcagagttttgcctgcttcatcatagcaagctgctaagaagtgcaatcctcggtcaatcccgacgacatgttctgcctcttctggagaatattccggtaatgaggtagtagcgctaatgtgaacgtaccaattctgctttgactgaagaagcttgattgatccaaacttccatttgtcagcatcaagatactgatcaaagcctttgcatacaaatgagaccttctttctgccttgcagagtgtttaaagacagctgctgggcagaagacaggtaagaccagtcacggccacgttgcaagtcaagttgcggacgcttgaattcaatcggtttccaaagccaatcaagatcacggggaatttgagaccaaatagcatgacctttgctgtcttttttgccagtatcaaaacgatatggcttttgactaagttgcgttctgacagtcttataacgtgcaataacatttctgattgccgactgtgccatctgacttttaaggccgaactgatctctgatttcatgatagagagctttgttcaattttgattgtgacaattcaaaattgttatcaaagacatactgtgagataaagttgcaagcgtctttgtatttctccatagattggacaaaggcctgtgcagtttcattatcaatattgagtaattttgctttgatggtaattgattgctctaatggtttcacctcctatctttcaattactattatataatctttaatttagtgaatacagtagaaaggaaaaggggctgaaagtgcaattcctccccagattgaaatcatggggtatccttgcttaatcagccctaggtatatcaatgaatcaacaacttttaagtcaagtgatggccagctgtgtgaatgcaccagactggctgatgaaaaaaagacagttggcggttttgcttcaagaacggttcaaaagcacgccagccacggaaaagatcatagctgcctggctggaaaatcccagtctcgcccagcttgagcaatcagttggtgagcaggcaaatgctgatcaggttaaagctgccgtcccacacacgactgtctgggttaatctgcccttgtttgccgctgcaaacgtctatcccgaattgctgcaggaaaatctgatggaaaaggcgatctcatggcaggacagtcagctcaatgccatgcacctggccttgctgaatggcggccgcttcatctatattccagatggcacgatcgtcaaagagcccattgaactgaccgttgactgtccattgcctaactatcataatctggtgatcgtcggtgccggtgcccaggcaaccattgtcgagcatcaaaccgccacaagcagacagccggcctattttggtacggaactgcttttaggcgatggcgcgcgggtcgactactaccagtccaaccgcttttcggctgtgcagaatcatcaggcagtcagggcctatcaagcacagcattcagttttgaatatgtatctggccttgtttgatgagcatgatttgacgactgatttttatgctaatctggatggtcaaggtggagcagccgagatcaaaatggttacgattgccagtggtcggcaggtgcaagacgttcagacgcagattcttaatcatggtccgcatacggtcggtaatatcgtccaaaacggcgtggctaaggacaaggcggttttaaattttcatgcagttggcaaaaccgagcgtggggcatatggcgccaactcgcaacagcagagtcgcattctgacgctttctgatgagtgcaaaggcgaggcggatcccgtgctgctgattgaagaaaatgacgttaatgccgggcacgctgccagtatcggcaaggttgacgcggatgatctctattatctggaatcgcgcggtctcagtgagcatgacgcgcaggtactgctgacgcgaggctttttactgccggttttaaatcagttccctgatcaaaagctgcgggaaaatctggttgatgaactggcgcaaagattggaggaaaagcatgagtgatcaagcaagccaacaggcagcagacaaggcagcaattcatgaatttgccagccagcactatcagtttggctttcatgataacgtcaagccaatcttttcaactggagtcgggctgacggaagaaacggttcgggaaatctcgcgccgcaagcatgagccggactggatgctaaagattcgtctggatgcctaccatcaatatcgtcaaatgaagctgccggcttttggacctgatctgagtcagctgaatctggatgagctgcgctatttccaacggccaaccgatcacgtagcgcgcagttgggatgacgtgccccaagcgatgaaaacgacttttgaaaagatgggcgttcccgaagccgagcgtaaatatctggcgggggcaacggcacaatatgaatcagaggttgtttatgccaatctaaagcgggatctttcccgtcaaggaatcattttcatggatacggatacggcggttcaaaaacatcccgaaattgtcaaacagtatttcgcgacgctggttcatcccgatgataatatttttgcggcactaaatacggcggtctggtcgggcggcacgtttatctatgtaccaaagggcgtgcatgcagacgcgccgctgcagagcttttttagaatcaatgccgaaaatacggggcagtttgagcggacgctgatcgtggttgaggatggcgcgagcgttaactatgtcgaaggctgcacggcaccagtctattctgaagacagtctgcacgcggccgtggttgaggtgtttgtacatcccaatgccttttgccgctatacaacgattcaaaactggtccagcaacgtctacagcctggaaaccaaacgtgctgaagctgaagccggggctacgatggaatgggttgacggcaatctgggttccaaagtcacgatgaagtatcccagcatctatctgcgggggcgtgaagctaagggaaccatgctgtcgattgcatttgccaatggtccgattgatcaggataccggtgcccgcatgattcatcaggctccgcacacgcattcaacgataatttccaaatcactgtgtcgggcaggcggcatctgtgactatcgcggcgaggtcaagatgaatgaaaacgcgcacggttcaagctcgcatgttgaatgtgacacgattatcatggatgacgactcaagttcagatacgattccatataataaagtagcagtcggcgacgtaacgatggagcacgaggccaaggtatccaaagtttctgaagaagaactctactatttaatgtcgcgtggactgagcgaagaagaagcaaccaaaatgatcgtcatgggttttattgaaccgttcaccaagcagctgccgatggaatacgcggtggaattgaatcgtttgattgattttcaaatggaaggctcggtcggctgatttttggaacggaagcattttgcgtagtcgaaatttcaacctggcttgccaagttatgctgcatcagcaaaaaacgcgaagcttggtcacccaggttctaagattgaagcgataatttgagcttggcgaggtagtctttgaattatcagttaggctgtttgatgggaaataacagtgaattagcaccaaaaatgccgatcaaagattacaaaattgtcacaaaaagggtcataaattcctaaattttaggatttatgccctttttttatgaaaaataaaaatttttttactctaaaatattacaaaatcagctatttttcggtcgcaatgaaaacagaacgatacaagactattataatgcgatttataacaagtttaggccagcctaaaacactaaatgaaagcggattacattacacgcttttacagaattcacgatttttgagatattccggtaattgcacggtaaagctgaggggttatagtattcatcgttgataaagataaagagcaaaaaacttgaactacagataaaaaaggatgaatctattttatgaaaatttcaaagaaagctgttaaaatctctgctgccgttgctggtgccgtagctttgggcacggttggcacggcaatcactgccaatgccgacacggtttacacggttcagtccggcgacacgctgtctggaatttccgctaagcttggtcacaacttagactttgtagaccaattggcatccaagaataacattgctaacaagaacctgatctatgttggtcaaaaactggttatcactgacgatggtgaagtatcttcagcaacttcagaacaagctgctacgttgccaagtgctacggctgaaaacacggctacggcacaagacagcacggcgcaatctgctgacagtgccgctcaatcaacggttgctgataccagtgctgaacaagctgccagtgatgctgccgctgctcaggctgacagtgccgctgctgcttctcaagctgccgcatcccaagccgctgctgcccaggcccaagctgctcaacaacaaagtgcgcaagttcaagcaactacttacagtgccaacacttacagcaccaacacgacgactacgacctacacttctacggtcagtggcgacgaagcaactgctaaggcttggattgccaacaaagaatctggcggcagctacaccgcacaaaatggtcaatactacggtaagtaccaactgagttcttcttacttgcatggcgactactcagctgaaaaccaggaaaaagttgctgacagttacgttgccaatcgttacggttcatggacggctgcccaacaattctggcagactcatggctggtactaaaaatcagcttaactaaattagataaaatgaaaagcaatggcgattttcggccattgacccgtacccccaaagttggaaacacaactttgggggtatttttatgatatatgagagaaatgggacggtttgatagattagggcgacagatgacagtgagttgggcgctgctgcaaaaagatagggaattgatctaggggtggatgccgctttgaagcgaattgatttgacataggactgggcactgttttgaattggcaaaacggttcagctttgaaatggcaagcgggtttgattttgaatctacaggcgggttagctaggacagatttagatagtcgaaatgtttgaatggtttgttacattataaggaagcacgttagttgctagtttgtaacattcccatgacttctaaattatgggtcagcataattgcctcaatgttcatttgcagaccacccagactacgagtaagtgtatgttcaatgccctgtcgcgttagatcagcaaagcagctctcaattcggcgccgaatttttttgagttgccggctgttgtgttgtttggcgaatcgcatattggaacggtatggcgtccatagctgatagcccatttgcgaaaaaatatgctggagctttttaccaacataacccacatcggcaatgacaaaaggacatggacaattctcgataacttctggagcagccttagcgtcatgaattgaggctggagtaagttcatagttaagaatcagtccttgcgtatccgtaaccacgtgtaccttgaagccgtaataatacttttgtttggtagcgttgtatccaatatccgcaaagcattggaacaaaatcgcccgaaacttgcggtgatcttgacacagcggcaatgggaagctgtcaataatggcgatatcaccatagctggacatctcgattaggccagagcgaattgactggaaaataggaatcagatttttacagcgacgcataaaccgagaatactccaacattggcagagaaggcattacgtcactgaccaactggcagaatttccgccaagttgcgacctggtactgaaccttcaagcacattaatgccagcaaagcagcatcagacagcttggagttttcaatatttcgacgctccaggtattttctggatgcatagcgcttaagcaaatgactcatcattaagcgacagcgactgaatttgatttgaaaatcatgacgataaagcttaaactgaaagtggttcaacatagctaagactcctttttgtttttgtcacttatgagtctaactatgttgggctttttttgttaaatattacgaactagcaattcgcataaggaagcaattattcaaagcagatgtgcgggcaatttctagtagtgctagaataaaacgcagataataattgagaagagggatttgtgatgactgcaatcaactgtcaacaaacacgaattgaaacaacgcaccggattttgaatggcgatttgaatgagcatgggacgctgtttggtggtcgcttgctggaagccgtggatgcggaggcttcggtcgcggcaatgcgggttgctagagccactttggtcacggcggccatggatcacgttcaattcgtcaagccgtttcacttgcaggatgccatgattgtcagagcagtggttactgggctgggacatcggtcggttgaggtattcgtaaaggttttgggcgagcacttgatgactggtgagcgttttgttggctttacctgctttttgacctatgtagtgccaggagcagagtcggggttggcctacgatgaattgattgctgataatgatgaaacaaaatatctgttggcaggctatcaggatcgtcgtgcgcagcgggccacggttcggcagcaagagcgcgatttgttggctcatttgagttgcgaatagacaggtacgtttactagcagtctgggaatcgttaggatgttggcgggggttgtcggtaaaacatcatagctgaggtgtgatattgtcgtgcgatcgattacggtaatggacggtcgctcattaatgatgatagatgcccaagatgcgacttttatgcaaaaaaacttgtataaaacgcccaacgaaaaactcattacctacttttagcaaaaaatgatgtataaatatgtaaaaactgatgtatattgagttagggatccctaacattacctgctatttagaaaaaaactgccataagtaggtaaagttgacgcgatcgaatatgcagctacctactattggcaaaaaacagcgaatagtaggtagtcttagagcccagagccagattaagcccgattttcttcacaaagtcagctgcttagcggtgaaaagatggtcgccgactaatttatgacagctgggagtgggatgcttgttctgtcagctcggaatattgagtgctaaccttaattgacttattaacgctcctgacgcagatctaaatcagctgcatccacttgtttagcgattcaaaagggcagtacgcggattgggtaagtgtagcgaactgagtgtaaaggaggccagctgctgaattgactggggatataagattcagtcggtcttgccggtattaacgcacttgatgatcagttgagcgatggtggtgttgcgtcgcttgactaagacgatatcggctgccaattatgacatcaataatggtgccgttcagcaataaatcaatcaaaaattcaagaaaaaaccgtaatttgagggctgaaatcttcaaatttacggcttttttattacagattgagggacgcctaactttttgaatgaaacattgatgaaaacaaaaccagacgctgacgataacgttttcgacacacattgtttagaattgatgaaaccggcttacattacgaaacattacgaaaatggcagaatttgatatttgcgattaacccacgtgtaacgttgaacctgtatagtagtcaccgttgataaataagcaagatcaaaacaaacgaaaaaggatggatttaacaaatatgaattttaacaagaaagctatgaagattaccgcagccgttgctggtgccgttgcattgggcacggtgggagcagcaactacggccaacgccaacacgacctacacggtacaagccggcgacacgctttccagcatttcatacaagttgggtcacaacctggactttgttgaccagcttgcccaaaacaacaacatcgccgacaagaacctgatctttgttggtcaacagctgacgatcaaggacgatggtgaagtcgtagtcagcgatcaaaatggtcaacagactacggttgcccaagttcaaactcagccagctgctcaaacgactgctgctgcgcaatcaacaacgcaatcagctgccagccaagcatctgcaggtacgcaatcaacgtatacttccactgcttctggtagcgatgccgctgctaaggcttggattgctgctcgtgaatctggtggcagctacaccgcgcaaaacggtcagtactacggtaagtaccaactgagttcttcttacctgaatggcgactactcagctgccaaccaagaacgcgtggctgataattacgttgccagtcgttacggttcttggacggctgctcaacaattctggcaaagtcacggctggtactaaaatccagcttggcaatgccaaatcatccctgatcatttgatttcccaaaaaacgatctcaatcaataaacatatttccttaccaaaagaagcggccgcattttgcgcgtcgctttttttgtggcgagagcgaatgcctaaatgaatttatcgaagactggggcttttagaaggtgccttaagatactaaccgccaaacccaaccttgcttaattttggtacaatctaagaaaacgattattaatgaggaaaccatgctaaccatttatgaactaaaaaacaaaccatgctgacacagccgaattctttgatctgacgatggcttatgataccttaagcggcgtatcgtttgtcggttcgtttaagattattgaacaagagctgttgccgcgctttaagcagattaagcagatcttgggaatggaggatcaaaatgataaaactaatcgcggttgatattgatggcacgctgcttaatgatcaaggccagattctgccggcgacgattcaagccgtccaacaggcagccgcagccgggcaaaaaatcgtgctgtgtaccggccggccgctttgtggagtgacggattatcttaagcagctcggactttggcagcacgcggatcagtacgtaatcagctataatggctcgctgattcagacgacgacccaaacaaccctgatgagtcaccagctgcagtttagtgactatcttgatctgctagaatttgctcaccaaaatcaagccgcgttcagtctgttgacgcctgcgtgcatgtacgtcacgcctggcgatcaaaaccgcgtcatcttaaaagaggcggcaacggttaagattgagctgcagacgtgtacgctggcagaaatgcgtgctttgccaaatctaataccagtcaagggcatgatcttggatgaaccggccaaactggattacctgcaaacagtcatgccaaaagcctttaagcagcgctttacggttctacgcagtcaaaaagaccacctggagtttacgcatcctttagccagtaaggaatccgcgctgaggcagctggccggtctgctaaagattgagccgactgcaacgatggcaattggtgatgagcaaaatgatctgggaatgataaaaacagctggaattggggtggcgatgggcaacgcggtaccgcagctgcgggcgattgctgaccaggttacggccgacaacaatcataatggggttggcgaggcaatcttgaaatggcgttaagggggctgattggtaaatcatatcattggcagcggcgtttgatcgtgaacagcactgtgttaaaggcggcttagttgattgtcaaccgcgtatcaccttgacagcctaaagtaatggttgatcggcgaaaaagctggcggctgatcattggcattctgacaggtcggtgaaaataagaccgtaaaaaatctgaaaatgggtttgatctagatggatcggatccatttttattttgcatacaacggtatatttttagaatattatacagttatttaaaagaggggatttgtagtcagttagttaatcttgtttatttattaaaataatattctctttaaaagcgcttaaatgggaatttgataattactattcaaggaatataagaaaatagccaataaaaggttgtcgaattctaattcatgggttatattatcaccaatgattttattaattttttatgcaatcacaaacaaggaggtcacagattatgaacgcagccattatcggggtgactggttatagcggcacggtcttgtaccagctgctcagtcagcatccagcggttgaaaacattcacctgtatggtcatcaagatactgccgcaccgcgctttttgaatgatgaagtagaggccttctgtgaccgacgaatcatgattgagccttatgatgtccgaaaaattatggccgaaaatgacgttgtgtttttcgccacgccggcgggagtcactgccaaattggcccagccttatttagacgcagattttcccgtaatcgatctttccggcgacatgcgcttaaaggatcccaaagaatatgccaagtggtaccacaaggatccggctccagctgatcaattggtaaaagcacaatatggtctggctgaattcaataccgtgcatgccggttatgttgccaatcccggctgttacgcgacggccacgctgttagggctggcgccgctggtcaaaaaacatttgatcgatctggattcgattatcgttgatgccaagtcgggactttccggagcgggcaagaaactgacgaccagctcgcattttgcctggatcaacgaaaactcgcagccttacaaggttaatcagcaccagcacattccagagattctgcagcagctgcagcaatgggatgcaggcgttaaagctctgcagtttacgacgacgctgattccagtaacgcgcggtattatggcttcgatttataccaagccgttgccgggcgttgatgaagaaaaactgaccgcggcctttgaagaatgctacgacaagcgacgatttgtccgcctgattaaaaacggctggccaagcatcaaagaagtcagccattcgaatttctgcgacctgggctgggcactggatcccaacagtcacacgatcctggtcgtttccgtaattgataatctgatgaaaggggttgccggacaagcagtccaaaacctgaaccatatgtttgaactggatgagacgctgggattgccaatggttcccagctggccataatgaaaggatgtctttaatatgatggaaccacaaactacgcctaatactgcttcaattgttgaaaccgccttcacctggcctaagggattttacagtgatggactgcatgccggactcaaggctgaaaaaccagatctgggctggctgttttctaaagtgccagccagtgccgcgggggtttatacgaccaaccagttctgtgcggcgccaactgccttgaccaaagaaacgatcaatcacgatcatcagctgcagggaatcatcgtcaatagtgcaattgccaattcctgcacgggtccccagggtaagctggatgctttgaaggaacaggcgctgatggctaaaaagctgggcgtcagccaaaatttgatcggcgtggcttcgactggggtaatcggcgaaatgctgccaatggacaagatcaaggccgggattgccaagctgaagcaaaccaagtcggctaaagttaccgaagccgtcttgaccacggatactcataccaagacgattgccgttaagtttgaaatcgcgggtcatcaatgcacgatggcaggtttttgcaagggttcgggaatgattcacccaaagatggccaccatgctgggctttgtgacgaccgatgccaagatcagcggggcctgcctgcaggatctgttaagcgaggaggttgacacgactttcaatcagatcacggttgatggcgacaactctactaatgatatggtcgttaccatggcaaatgggcttgcaatggcggatgaggaattattgacaccggaccatccagattatccagtctttgcccaggcctatcatgaagtgctgagcgcgctggctaaagagattgctcgtgatggcgagggggcaactaagctggttgaagccaacgtcaagggcgcggccaacgatctggatgcccagcacgtcgctaaggcaatcgtaggctccaacctggtcaaggcagccttatttggtcaggatgccaactggggccggatcatgggagcgattggcgcaacggatgctgacttggacgtcaatcgcgttgacatcaagcttaatggcatcaacatcgtcttgagcagtcatggcgttgaatatgatgaatggctgctgcggcagaaactggctgaggatcagatcaaaatcgatgtcaatctgcaccatggctttggcaagggacaggcatggggatgtgatctgacctataaatacgtgcagatcaatgcctcataccggagctaggaggaattcatgaaagatctggtcattattaaaatcggtggccaagccatcagcgagctaacggatgattttttcgaccagctggcagtctggcgcacgcagggtaaaaagattctgctgctccatggcggcggccctttgattaccaagctttgtcaacaattacaggtgccggtcgttaaaaaagatggcgtacgggtaaccgatgcccagacattggcgttgaccaaattagtgctgttgggacaggctcagccattattgctgcagaaactcagcgatcatcagctgcccgtcgtcggtttgaatgcggcagataatcaaatgctggtgggcaagtatttggatcaaagcgtctacggcgaagtgggcactgtcgtcagcgtcaatcaagacaagcttttatcgctgctggacagctatattggcgttttggcaccattagcgatgacgccggctggcaattggcttaatgtcaatgccgatcaggccgcggctgacgtagcaagtctattaggcgctaaaaagctttatctgatgacggacgtagccggcgttttgaatcagcatcatttgattccgcacttaacgaagctggtttcacaaaaactggtcgctgaaaaaattatcagcagcggaatgcagccaaagatcaaagctgcctttgctgcctgtaccgcgggagttgagcaggtagccatcactaattgtctgcagaatcccggcacgattattaccaaggagtgatttaatgagccatttatttccaacctatactcgtttcccatttgaaatcgtaaaaggagccggtgcccatctatttgatgaacagggcaatgaatacctcgacttgaccagtggcatcggtgtctgcggactaggctacaacgtcaaggcgctcaatgatgccgttgaacatcagctgcatcaaatctggcacacatccaatctgtatgagagctcgctgcaggaaagcgtggcggcacagctgggcgtccatcaagatatgctggtcagttttgccaattccggtaccgaggccaatgaagcggcattgaaactggcgcgcaaggcaacgggccggcttgatttcctggcatttgatcactcgtttcatgggcgttcggctggttcgctgacggtaacaggtaacgagggcatcaaggaaggctttcttcccctggttcccggcgcgcggtttgccaagtacaatgatttcgcggccctagatgagattaagccggatctggctggggtaatcctagaagtcgtacagggcgaaggtggcgtgattgccggtgatgccaagtggctaaaggccgttcaagataaatgccacgaggttggcgcgctgcttttgatcgatgaggtgcagactgggatgggcagaaccggctcgctgtttgcctttgagcagtttggcctggatccagacatctatacggttgctaaggggctagccaatgggattccggttggcgcaatgatcggcaaaaaagagcttggtcaatactttggtcccggcagccatggttcgacgtttgcgggtaatccgctggcaatggcggccgctcagcaggtattaaagacgctggatcaagaatttttgagcgcggttcagcaaaaagccgcggcaatgcatcaagctatggaaaaagagttgctgccaatggacatggttgattcaatcagcggcctgggtttgatgatcggcattcatcttaatcaagctgtttccgtgggtcaggtcttggctcagctccattctcagcatgttctggcactttcggctcgtgacaacacgttgcgtcttttgccaccattgattgccagtcaagacgagctgctgactggtgtcgatgagatcaaaaaggcgctgaatgcagttgaatcagcgaccgctaccgcataaacaaaatccgtcaagcccaaaccggtttgacggatttttgatattggggctaatgacgggctgtttagctgattagtttggtgaaaactgactttgcgagcgaatctggtgagacgatcattgaaaaaagcgttgctgagcgttgattgggaacgattatgcaaaaagttctgcataatactagctggcgaaatcgcattagggtgtgtcaataattttgtgtaaaaagggaccttctggggcgatacagtagtccagcacctccttggtcccatcactgcgaataccgatcacgatattgaccgcctctcgctcaacggtaccgcggcgcagcggaatgtaggtcgcgtccaggaagacacagacgtactgcgactgcttgaacttccgggtgtggaactcttcgaccaggctcgctgtctgtttggtaatgttggacaccgtcgctggcgaataatactggccatacatcttctcgatcagttcagcttggcaaacatagtcaagcctgtcaaacataagaaggatttcagtgcgatgattcagaacagtcattatagcgcagctgatttaaagcggcagacccatcaccatagctaagttattgcggtgtcacggctagctcaatctgtcggcctggtcagataacaaataacgacatctttttttgaatgatactggcttattaaatgaaagaaaaatcatatgatgcaaaaatattttatttgacaagacgtttaaagtcaattgtcccaacgatgaaagcccttacgagagtagggttttaaatgttaaggtcagtaaaggtcaaataatattgccgaggagcagcaaatttcgaaaagtgaagggttgtattttttaatatacaaactaagataaaagtgtacaaatgatatgagttattttaggaaaggaagttttggatatggctaatgaaattcaacgtcataacaacatgtttgacgacgtaatgagcgcgggcatgcgcaatctgctgaacgacaatttcttctctggcttcaacgctaaggcagatcacatgaagaccgacattgcagaaaccgagaagaactatgtcgttaaagtcgacatgcctggctttgacaagaaggacatccacatcaactatgagaacaacatcctgacgatcacgggccgccgtgacacgtttgacgacctttctgacaaggatggcaacattttgcacagtgaacgcaactatggtcagatgagccgttcattccgtctgccagaagttgacctgaagaaggcctctgctcactacagcgacggggttctggttctgacgctgcctaagctggcaccagaagtcggcactggcactcacatcgaaatcgaataatttaattgacaaatagtctttaaatgggtagcagttttaaattgctactcattttttattttgtctatgtaaatgctttcatgaatttgatataattaatttgtgcaatctaacaactttgcaattattttattgtcttaaaagctaaaggagggaacgttttggaaaacgcaaagccaaccaaaaagcaccgttttaagatgccatccgcgtttacgattttgttcttcattatcgtcgtcttggcaatcttaacttggtttattccagccggtaagtacgctaccgattcagccggcaacattattgctcatacctaccataccgtttcgccacacccgcaaggtatttgggatgtcttcatggcaatggttattgggatgatcggtgacagcaagactgaaggggcaattcagatcgcgctgtttatcctggtaatcggtgggttcttaggcgtcgttaacaaaaccggagctttaaacaatgggatttcctccgttgttcgtcgttatgagggacgcgaacggactttgattccaattttgatgattctgtttgctctgggtggtacgacctatggcatgggtgaagaaacgctggccttttacccattgctgattccagtcatgatcggctgcggctttgactcaatcgtcgcggttgccgtggctttggtcggtacgcagctggggtgtctggcatcaacggtcaacccatttgccactggggttgcctcagctacattgaagatctcgccaggtgaaggcttgattccacggctgatcctgttggtgatcgtcacggcgcttggtatctggtacacgatgcactatgccgaccaggtcaaaaaagatccaaccaagtcattagtctacgctcagcgagctgaagatgaaaaacggtttgatatttccgaaaagacgcaggacacgcagcctttaaccaaggtacaaaaacgcgtgctgtggctgtttgggattacgtttgtcattatgatcatggggctggtgccatggactgatctgaacaagcactggacggcctttgacacgtttaccaactggctgcatggcattccgttcctgggcgtattgattggtaaagacattccagccttagggacttggtactttaacgaaattacgctgctgttcatctttatgtcggtagtaattatgtttgttgcccatatgaaagaaagcgagtttatcgacgccttcttaaagggaatgggcgacctgctcagcgttgcgattatcgtggccgttgctcgtgggattcaggttatcatgaacaatggtatgattacggcgaccgttttgcattggggtgaagtcggactgggcggcctgtcgcgcagtgccttcattattttgacctacatcttctatattccaatgtcattcctgattccatcaacttccggcttggctgccgctacgatgggaatcatgggaccgctgggacacttctgtcatgtttccggcagtctggttattacggcttaccaagcagcttccggctggatcaacctgattacaccaacttctggaatcgtaatgggggcattggcaattgcgcacgtcaacatcagtgtctggtggaagtggatggccaagttcatggtgatcctgttcttggttacctgcgtcttcttaggcattgccgcggtactttagcttttttcaatcataatcagggggaattaatatggctgcagaattggttcaagaaaatgagcgccaacaagcattggcagctttaaagcgtttggttgccaagccatcgtataatgaggctccagcaccaggcgcaccgtttggacccaagattcgtcaggctttagatgagctgatgcggatctgtgatgagctgggctatcaaacctatgaggatccggatggctactatggctatgctgaaactggaaccggcagcgagacgtttggcattattggccatgtcgatacggtgccggctggcgatttgagtacttgggaacatgatccgtattctggcgaggtctttggcgatgtggtctatgggcgcggcgtacaagacgacaaaggtcccgtgattgcggctctgttcgcggttaaggcattggagaatcgcggctgtcattttaacaaaaagatccgctttatcttcggtaccgatgaagaaacgctgtggcgcgggattgccaagtacaatcaaaaagaagcgccgattgatctgggcttttcgccagacgctgaattcccggttacctatgctgaaaaggggctgcagcagtcatatctggttggaccgggtaccgagctgctgaacgttgaaaccggtggcgcgttcaacgcggttccagatcgggccgaatatgctggtccaaagcaagatgaggtcaaggctgctcttgaaaagcacggcttcaagtatcatgaggaagctggcaagctggtcgtagaaggcaaggcgattcatgccatgctggctccccaaggcgtcaacgcggtcttaagactggcaattgctttggatgacgtctttaaaggctttggaccgctggactttatcggtcaatgctttaaagaggatgcgacgggaaccaatctgctgggtgacgtcaaggacgaagcatccggccatttgacgtttaatatttccagcctcaagatcacgccgaaagaaacgcggatgcagattgatctgcgaattccggttaccgttgaccgtgatgcgctgcttgaaaaactgagccaaaacgtcgccaaatacgatctgcaatataagcattttgactacgtagcgccactgtacgttcctaaagacactgaattggttaagaccttgatgacagtctatcaggatcaaaccggtgacgttgcttctcagccacaggtcagcggcggggcaacctttgcgcggacgatgcataactgcgtggcctttggggcgatgctgccaactacgcctgattttatgcaccaggctaatgaacaatggccgcttcaagacatgtttaaggcaatggatatctttgctgaggcagtcaagcggttatgtgtggactgatgattgaataaaaagagcagctgcgagaactcgcggctgctttttttacggtttcaaaccgatttagatgtgttccttgatgccattagggaagtctttatcgatttcctttaagattggcagcaaggtgttgatgtattcatgatatgcttcgattggcttgcgatccttgccgtttgcctgaagcagcgcgatggcaatgtcatgcgcgcgttgttcattactgatcatattattcacctcattcctacagtttaacaaattttatcgatagttgcgcgatccaatcagccaaggcagtcgcttttaaaagcaccatgatataaaaaccggctaagacgccagctgcattcgtgatgacgtcatcaatatcgacgaagcgttcaacatggaaaaacagatcgcataaaaattgcgtgctttcgattgagattcccagtaagatgccaaacagcaataccgacttgagatcatgccgcgcgctaagcagataccagtagatgccagccggaaccgtcatgacgatatttaagaaaaaatcaggcgacaaggcttgaaatggaatgacgttgcagtgaacacctaagacgtgataaaaaatcttgtgcgggccgccccaattatactgggttggcgtaaagcagagataggcaatggccaaagtatagatcaaggcgctcagcatcgtaaaccattgccagccatgaagcggaagatgcaaggctcggttaaacatggtgccccagatgattaatagtattataaatggaatccaagaacgcaaaattaaaaatctccccaataactctaacgaaaatttaaaaacgtggtacaataaagattctaggttttaccctccagtctagcaaaaaatgttgggcaggttaagagaaggaggaaattaaatatggcggaaaagcaaccggatcagcaaacactgtcgcggggcttaaaggatcgccacgtacagctgattgcccttggtggtgcgatcggtacggggctgttcttgggttccgggaaatccattcacgttgctggtccttccattctgctggcatatctgattacggggatcatgtgcttcttgttgatgcgggcgctgggcgaactcttgctggctgacctgcattacaattcatttgtggatgcgattcgtgactacttaggctcacgggctgcatttatcactggttggacgtactggctctgctgggtcgcaatcgcaatggctgagattactgcgatcggcatgtacgttcaattatggctgccgaattgtccacaatgggtacccggtttgattacgctggcggtgctcttatgtgtcaacttgattacggttggtgcatttggcgaggtcgaatcttggtttgcactgatcaagatttttgcgatcctgctgctgattgcaatcgggatcgggatgatgctggtgcgcttcaagagtcccaacggcatcgttacctcaccaagcaacctgatatcatatggcggatttttcgcaaccggcctggatggctttttgaagtctttccaaatggtcatcttctcatttgccggaattgaaatggttgggatgacggcggctgaaacggctaacccccgcaaggtcattcccaaggccatcaatgacattccagtccggattttgttgttctacattggcgcactgtttgtgattatgagcatctatccatggaatcggcttgatccaaattcgagtccgtttgtcatggtctttaaggatattggcatttcttcagcggcctcaatcatcaactttgtagttttaacggcggccgcttcatcttgcaacagcgccctgtacacgactggacgcatgttggccgaattgacctcaacttcacgacggccttcaattcgcaagatcagccgcatttctaagaattcggttccagctacggcgatcatcatctcagctctcttgatggggatgtcgtcactgctgaactacttgattccttccgaagtctttactctggtttcaagtgtcgccacgaccagtttcctgtttatctggggaacgattgtgttggctcacctgcgctaccgtaagttgcatccggaaggcagtggctttaagatgccgggaacgccggttactgattggatggtcttgattttcctgtttgccgtgggcgtgatcttgatgttcagtgccgacacgcggattgctttgattatcgcggtagtttggctggcattcatgacggttctgtctatgacgtttaaagaatataaatataactaactaaaaaacttctcgatttttggtcgggaagtttcttttttgcttcttaagtttaatcacgctggctttggcagtgactgttgcaatagcagcgtttctcatccatcatatcgcagtgacagatgccatctgtactggcacaaggacagcctttttggcaggtcataccagccttgcagtattctttttccattttcatccccccatatttgaaattatcaatataatacgctgtttaatcggggttggctcattgtctgctcaaatctttagatatttttagcaaacttgatgattgtcaattaccaaacggcaaaatctccttaaactgtgattaaacatttggagaggagaaagaatcatgttttttgccaagcataaaaaagaaagcgtcgttttaatgacggctttgctgattattgcttacattggccgcttcaccaatctaatctggctatttgatgtctcgatgatcgcaattgccattatcggtggcctgtcattgatctttcgagcagtcggggccttgaaattcaaaattatctcaattgagcttttggtttcaattgctgtaatcagtgccctggcaattggtgaatacagcgaggccggcatcgtggtctggctgttttcggttggggatttgctggaagagattacgctaaaaaaaacccgcaagtcgattcaagatctggttgatatggcacccaagacggcactgaagattgaaagtcccagtgatcgttcgtttgaagaagttgacattgacgagattgaaaaaggcgattatctattggtcaaaactggttcgcggattccagtcgatggccaagtcgtcgctggcaatggtcatgttgatcaggccagcattaccggcgaatccaaacccagccacaaagaaatcggcagcagtgtatttgccggtacgattctttccagcggagcgttggttgtacgagctgaaaaggtgggcgaagataccacgtttggtcggctgattgaattggttgaagaagctcaagatagtcaaaccaagacccagcgttttattgaccgcttttcacaatattacacgccattggtattactgttgtcaattatcgtaggcctgattaccaaagacttacgcttgtcaattaccattctggtccttggctgcccaggtgctctggtaatcggggtgccaatctcgacggttgccggcatcggcagtgcagccaaacgaggcatgattgcaaagggtagtgctgcattggatgagttaaccaagattgatacgtttgtttttgacaagaccggtacgctgacgacgggtcagccgagtgcgggaaaggttgtcaatgttaatggcgatcagaatgaaaatctaaagattctggccagcattgagcatgagtccaatcatccgttggccaaagccattttggactactggcaaaaagatgacgtctacccggttagcgacagccagattattgatggacgcggcattcaggctgtcgttaaccagcactcggttttagttggtaatgaaagattgttaaacgaagccggaatcgaaacgaccaccgatcagctttcaaagaccagctcacacgttttgctggctgttgatcacgagctgcggttggtactggaggtcagtgatcaactgcgtcctggggccaaagcagcattggacaatctgagaaaaatcaaggactatcgcctcatcctgctttctggcgataaccaggcagctgctgaaaacatggtggccgacctgaactttaatgaagtgcgtggtgatcttttgccagtcgacaaggcagcagtcatcaaacagctgcaatcagatggccatcaagtggcttttgtaggggacggaatcaatgacggtccggcattaagtgtggctgatctagggattgctatgggcagtggtaccgaagccgctattgaagtggccgatattatcctggtcaactccagtccggctcaattaccgattgccgttcgtcatgcgcaaaagacgatacgcaacatgtatgaaaacattgcaattgcacttttgacggtattactgttgttcatcggtctgtttaccggctacatctacatggcgtcagggatgctggttcatgaattgagtattttgatcgtcatcttaaatggtatgcgattaattcgtcgtaattgaccgtaatcaattatttattagagtaaatcgactaagctatattcataaataagcaaaggggaaatgaatcatgaaaaaagtaacgttaaaactcaatgatctgtcttgtccatcatgcatgagcaagattcaaaaagccgtcagccaacagcctggcgtatccaatgccgtggtaatgtttaatgccggcaaggtcaaggctgaagttaatgaaagccaacttgcaccagaagcattgggcgatgttgtcagccagcttggctatcaagtcgaaaagatcatcgttaaggaggcttaatcatgagtgaaattgaaattcgttatgcaaaagaacaagaacgcagcgaccatgagcaccatgttccaactgctggtgccatgatcggtcacattactgccaacctggcagtgcatgctttaaagattgagcaggcagctttatttgccaaagggccagccgcactgtttttagatcagtatgggcgggtctggattcaaaaagaactggctttttgggatgatatcaatcgtgccttgcataccgaagcagatttggtgccaacgaccagcgaggagctgcttaagtacagcatgctgaccgaaaatggtgctactaagtatgctgatggtaaagatcagctgtttgagctggttaaagattttgatatgcagctattgtttattacacgggccattaagctgaccgaaaaagaagggcatgaggcgcagaatcaactgatgaaagagctgtatgcctggattaaggaacagattgggttgacacaaagattcttgggccacgaaccaaccgagggcctgccatctgctgcagaagatgatggcgatgatgcagaataaaatgtctgatttataaaagagtagaaacaactggacgaaactaaaaacttttcctctcaatatgaaaactcggatgattcgctaagcaatggtggatcatccgagttttattatgtaggtattgtcggtcgcaagttagcattacaattacgtttgaattattctaaagctaatttttaattgacagatttccccaatctgttagtgctatctggcacttcataatgggtttttcaaaattaatttatacagagtgattgtatatggatgacgggctgctcaaaatcaattaaacaaatttactataaatgtcttaaatacaatcgtaaaaagatgctgaaaaatacagatggcgtcatttcaaactcaaaagtctgagatgacgccatatttttagttaagtagaaagtcgttttttcagctgtttagcctatgccaggctcggctttttttgacagttgggacagatgccgtgaacttcaatatcactttggtttaccatgaaattggtcttttcgcgggtaatctgttgcagatccttggttagggccgcgaaatgatcatcaaaaacgtcttggatcaaaccgcagttgtcacagacgacatggtagtggggatgcccaaagtagtcataatgggagctgccatcaccatttttcagttcaatgaccagctgatcttcaaccaagagattaatggtgttgtagatcgttgccatgctgatgttgtcggcttcttgttttaaatcggcgtagatcatctcaacgctggggtgcgtgtggtgattgatcagatagtgcagaatcagtttacgctgcggggtgagccggacgtgtttttcgcgcagatgctgcagtgcgtgttcatattctgaattggccattgcaacgatcatcctcctttcacagacgagtgattagacaagtcattattatagcattgtcaaggtcgataatgcatcaggaaataaaatgtttctttttagataataataattctaatttagcgaaaagaaaagcattctgcttggtaaaatttaaacccagaaagtcagaatcgttgtcagcaattgcaacagagtataaaaaatttgattatgcgggtttgcgaccaagcgctgcaacagccaccagcttaagatcaccaatgcgatggctaacagcagcgtcgccttgattggccgcgtcagcatcgttaaaatcaagatcacgccaagaccaccctcaatcattggaaaacgcgggtcatcagataaaaaaagcggggcgtagtaaaaacagtagatcatcaataacggaatcagtttgagcagatagctccacgacagaaacttaaccgagatgaaggtaaacgccactggaatgctgagggtcattaaaaggccgaaaaccagcagaccaactggattttgaaattcgtgcagataaagctcaaaaatcagcagatagcaaggcggcagcaaaagcaggataaacaaaaagacgttgccatgcaaaaaaccgctgatggcaaataaaaagctgatcagcagcggaataatcgaagtcagcgagccgccttgctggtcaaaaataatgatggcggctagggcaatgcagatctggtaggcaaacagactgtacagatcatgagaaaagacggtggttttgatctgaatggcataggcaaagggcacgtaagaccagcagcacatcattaaaaaagcattgggtagcagactgcgccagtcgatatcttgaatttgcaacttaaaatgcgataacgggttttgcaaaaaaattcctcctgagcggtcaaaaattaagttttccttattgtaacaaattccatcataaaaaattgcttattatcacgagaatatgttaggatggtgaacgttataaagcaaattcccgataggattcacagattgtgaagatgccttgtaaccgcaataaccgaactttttagtttagaaaatgggggaattaacaaaatgactgaacgacacttatttacatccgaatcggtttcggaaggacatcctgacaagattgctgaccagatcagcgacgcaattttggatgccatgctggaacaagacccagatgcccgggtagcggttgaaacctcggtcacgaccggcctggtgctggtatttggcgaagtctcgacgacggcttatgtcaacatccagcagatcgttcgtgatacgattcgtgaaattggctacacggatggccaatatggctttgatgccgacaactgtgcggtgattacagcgattgacgaacagtcgccagacatcgcgcaaggggttgacgactcgctggaaacgcggggcggcaacgttgatccattagacaagattggtgccggcgaccaagggctgatgtttggctatgctactgatgaaacgccggaatatatgccgctgacgctgatgcttagtcacaagctgatgcagaagattgctaagctgcgcaaggatggtacgattccatatctgcgccctgacgccaaggctgaagtaacggtcgaatacgatgaaaatgataagccattgcgtgtcgatacggttgttttgagtacgcagcatgacccagagatggctttggatcagattcgtcacgacgttatcgagcaagttatcaaagccgtgattccagccgaactgttggatgatgataccaaatatttcatcaatccaaccggccgttttgtcattggtggtccacaaggcgatgccgggttaacgggccgcaagatcatcgtggacacttatggcggggctgctcaccatggcgggggcgccttctctggcaaggatgcgacgaaggttgaccgttctgccagctatgcggcccgctatattgccaagaacttggtagcggccggctatgccaagcgcctggagattcaggttgcctacgcaattggggtggctcagccagtctcaatctcaatcaatacgtttgggacggggacgcgttcggaagctgaactgatcgcggcggtacgtaagacgtttgatctgcggccggccggaatcattaagatgcttgacttgaagcgcccaatctacaaaaagacggctgcttatggtcactttggccggactgatatcgatctgccgtgggaacacctggacaaggttgacgaactgaaagccattttaggataaaaagcaaaagaaaagccaagtgcccagatgcggcagcttggcttttttgctggcgattatttgactggccggcattttgactcatgatcatcaagacttagtcaaacaagcccgctaatgccagatcacgatgcagttcaaatcagtcattgataaactgaacgtcgtagctatggtcaataatgcgaacctgatctggtttgagaccgacaacttgaacatggcgtgcctgatcgacaaaaacggcccccatgacgtcaggatgatcattgatccagtttggcagcggctgaccggcaaagaaaaggcggccggtttcgatctcgccggtaatcgattcaccagaaaagacggtcacgccggccagggcagtttttctagggtgaccagtggctggatcgatgatgtggtggtagtcttgcccattttcttctagatgacgctcgtagattccgctggtaacggctgaacattccggcagagcagctaccagaatcgattgaccacgcttggcactaggatcctgaacgccgattcgccataagccgtcctggtgcttgggtgccgtgccgtgcatcagaatgttgccgcccagatcgatgatgccggcgcgaagatcacgcgagcgccataagtcacgaatgcgatcggcgatatatcctttggcaatggcgcccagatcaatctccattcccggctttttcaaaaagatcgtcatgtcgtggtcatttagctcaacgtcatgcggatcgatcagtttaaggcgttcttgaatctccgcctcgcttggtacatgagcatcgtcaaagccaatgtgccacagttttaccaaaggaccgatcaaggcatcaaagccattgtcttccaggctgatggcaatggcttttttggcaagatggtagctggcatgagaaacctgtacgggatgctggccggctgcctgattaacggccatcagctctgaatgatcgcgattgacagtcagaatgtcttcatagcgggcaatcagtgcataggcatcgtccaaatcgcgctgctcggcacttccaaacgccgttaaaacgatgttggtgccaagaccataatagcttttggagatggtatgctgggccagattgctgataatttggggatgatcgtttgaccaaagaggggttttgttttccattgaggtcgtcctttctacgcttgcggtttattaatgtcattataaccttgaggggcttttagaaacgagcaaaattaagttaattatcgaacaaatacggctaaaaatcaggctgcaatttaaaaatagttttttaaaatcagttgatgaaacaccgatgaattcgtttgcgcgacttttgtcaaataattgataaaatattcacaatatctctagtaaaaatcatttaaaacgagtaagatggatccgtaaaggttaaatcaaggaaggggtcttgagtcatgcattcattcttaagtatcgatgtcggtgggacagcgattaagtatgccttgctgaacaacgccggtcagattaccaaaaaagacaaagtgccgacgcctaccagcagcctgactgaatttatgaagtcgctttatgcaattattgatcagtaccaagctcagatcagcggattggcggtctgcgttcccggcaaggttgatccgcaaaagcaggtggtcgtttttagcgatacgctgccgtttttgaagaactgggatctgccaaaactgtttaaggaacattaccgtaagattctaccgattgccgttgaaaacgaaggacgcgcggcagctttggcggaatcatggctgggcaatctgcatggtgaaaccgatgcggcagccattttgctgggaaccgacatcagctctggcatcatcaccaatggcaaactgaactatggcgcgcatgccggtgccggaatgctgaattttgtgccaaccaactttaaggcggaaggcacggatcgcttggcaggctttaacggctcttcagtcaaaatgattcaggacgtaattgaggcatctggcctgccggaaggtgcagatggcttagcggcctttcggatgattgaagctggcaatccagatgccgccaaggtctttaacgaatactgctatcagattgcgtgcttgatcttgagcatgcaggcgatcgttgatttaaacaaggttgtcattggtggtggggtctccgcgcagccgatattgatcaagacgatcaatgctcaatatgaccagctggtagagtcaatgccgatcgtgaaaaaagaaatggtcaagccaaagatcgaaccggctaaattcaaaaacgacgccaacctgtatggagctttagatgccttgctgctgaaactcgacgaacaaaattagaaacatattagaaaagagacttgcacttagcggcggtccttgctagaatagtttgtaatctttgatcgtagaggagttagtagccaactcagctgtttacagagaccaggcggcggtgcaagcctggagcagacgttggtgaactggcctcaaaaaattgccgctgaaccaatagtaggcggcaacgtgaaattcgcgttaagaatctcaagggccatgcataaagcgtggaattcaggtggtaccgcggattttaattcgtcctgcatttagttgcagggcgtttttttatacgatcaacttactgacaatcagaattttaaaaggagcagggctaatggcttacgatcacaaaacgattgaaaagaaatggcagcgctattggaagaagaacaagacctttaaggcggaaatcaacaaggaccaaaagaagtactatgctttggacatgttcccatacccatctggacaaggtctgcacgttggtcacccagaaggctacacggcaacggatgtggtttcgcggatgaagcggatgcagggctacaacgtgctgcatccaatgggctgggatgcgtttgggctgccggctgaacagtacgctttaaagacgggccacaatccaaagggcttcaccaaccaaaacatcgatcactttagagaccagattcaatcgcttggcttctcttacgactgggatcgcgaagtcaacacgactgatccaaactactacaagtggacgcagtggatctttgaacagctgtacaagaaggggctggcctatgaagatgagatcatggtcaactgggctcctgacttcatgggcggtacggttgtctccaatgaagaagtcgttgacggcaagacggagcggggcggctacccagtctaccgcaagccaatgaagcaatgggtcttgaagatcacggcctatgccgatcgtctgattgatgatctggacctggttgactggccagaaagcgttaaggaaatgcagcgcaactggattggtcgttcagaaggggcttccgtcttctttgacattgctgatcatgatggcagaatcgaagtctttacgacgcgtcctgacacgctgtttggggcttcctacgttgttttggcccctgaactggatctggttaacgaactgacgacgcctgaacacaaggccgaagtcgaagcctacaaggaaacgacttcccgccgctctgatctggaacggaccgatctgaacaaggacaagacgggtgtatttacgggggcttacgccatcaacccagtcaacggcgaaaagctgccaatctggatctcagattacgtcctggcttcatacggtactggtgcggtgatggccgtgcctgctggtgaccagcgtgactgggactttgccaagaagtttgacctgccaatcaagccaatcatcaaggatgtcgatatctcagaagcagcctatgctggcgatggcgagcacatcaattctggttttgttgatggcatgaagatcaaggaagccaaaacggccatgatcgactggctggaagaacacgatgccgggcacaagaaggtcaactaccggctgcgcgactggatcttctcacgtcagcgctactggggtgaaccaattccggttattcactgggatgatggtacgacctcattggtgcctgaagacgaactgcctttgaagctgcctgatatgaagaacattgagccatctggtaccggtgagagtccactggccaatgctaccgactggatcaacgtttatgacgaaaatggccggcatggactgcgggaaaccaacacgatgccgcaatgggctggttcttcttggtactggctgcgctacacggatccgcacaacgaaaaggaatttgcctctaaagaagcgctggactactggtcaccagtcgatctgtacgtcgggggggctgaacatgccgtcctgcacctgctgtatgcccgcttctggcacaaggttctgtacgatctgggctacgtgccaacaccggaaccattcatgaagctggttaaccaagggatgattctgggttccaaccacgaaaagatgtccaagtccaagggcaatgtcgttaacccagatgacatcgttgagcaatatggtgccgacacgctgcggctctacgaaatgttcatgggtccgctaactgaatccgtaccttgggatactaaggggctgcacggtgcctacaagtggatcaaccgggtatggcgcttgatgatggatgacaacaaccatctgcgtgatcgggtttcgaacttcaatgatggcaaacttacgcgcatctacaaccaaaccgtcaagaaggttacggaagactttgagcggatgcactttaacacggctatttcgcaactgatggtctttgtcaatgaagcgtacaaggttgatgatctgccggttgaatatatggaaggcctgattaagatgatctcgccggtaattccacacgttgccgaagagctttggagccaattccacgtttccgacacgattgcctaccagccatggccaacctatgatccaaaagccttggaggaatcaacggttgaaatgatcgtacaggttaacggcaaagtacgggcccgaattgagatgccaaaggatgccgatcaagaaacggctcaagctaaggcccttgccaacgaacacgtccaaaagttcatggatggcaaggaaatcaagaaggtcatcgtcgtaccaaaccacattgtcaacattgtcgttaaatagtctaacgtaatttaaaggtcagcattcggtagcgtcgaggctggcctttttggattttaaagaaaggaaacagcaatggaactggttagctatggggcagtctttaccccaaccgaaaaagagattcaggttgattttccggatgtccctgaggcatttacgcaggggcagaccatggatgaggcaatcgaaaatgccaagctggggctggcaatcgtaatcaatgacaagctgggccattttgaatcggcgccagcagcaacgcccatcgaccagctgaaaacggcctttccggatcgtgaagtacggttgatcgaagttgatctggaaaaatattaaacgcgttaatcgttgttggggtgggcttttgaagcactcacggggattaggtaaaacagcttactataaataagacgttgacaattgaaaacctgatcgctataataaactcattaaatttttaagagatttttaattattgaatttcattgcgaaaggaggaatttctatgttgaagcatcaatttaaaacattggagatttctgccttttcgtcaatgatggcctgttgttaatctattcctcaatcggtttttcgatctgaggccttttttgggttactgtttttgcggttcccaaaggctgattaaaggaatggaaagacaatgggccttttttcatgcaattttttgattagacattatttggatatttgtctaaaaggggagtgagaaattttgagttggacgatcattcagcagagtctgcctgaatttgccaagggctttcgactgacgctgtggctgtcgttggttggaattctaggcgccatggtcgtgggcatcatcgtcagtctggtgcggtatttcaaggtcccgtatctggctggcatcctgggcgcttatgttgagctggcccgcaatacgccgcttttgattcagctgttctttttgtactacgcctttccggtaattggctggaaaatgagcgcggccacctgtgggatcgttggtctgatctttttagggggcgcctacatggcagaaggattcagcggcggctttaacggcgtggccaagacgcagcttgaatccggcagggccctgggaatgagccgctggcagctggcccgttacgtagtctttccgcagggatttgcactgtcggtacctgctctggctgccaacgtgatctttttgattaaggaaacctcgattttttctgtaattgctattccagaactaacgaacacggccctggatctgatcggtctttactatcgttctaacgaatatcttttcgttttggtgatcgcctacgcaattatcttgattcctctgtccttgattttgacctggctggaaaggaaggttcgctatggcacattcgggaattaacgttttgttggaaggacataattttgtccgactgctaggtggattatggaccacggtttggatcgcggcgctgtccttgctgattggtttggcattcggtgcggtactgggaatcttgcgaacgtttaagaatcggctgctgcgcttgattctgcggctttacctcgagtttttccggatcgttcccacggttgtgctgctgtttttggcctattacatcctgccaagaatgatgcatgtggccaacctccctggctcattgatggccgttgtcgcgtttgccttatgggtggccgcggaattcagcgatatcgttcgaggagctttgatctcggttcctaagcatcagcgggaatcgggtatggcgttgggtttgaaccgccaccagctgttttactatgtcttattgccccaagcgtttcgattggagctgccggcaacgatcaatctggcaacgcgggtgattaaaacgacctcgcttttgatgatgatcagcgtgatggatgtcatcaacattggccagcagattatcgaggccaacaatcatctttatcgaacaggtgtcttttgggtctatggtctgatttttgtattttactttctggtggattatccattgtcgcgctgggcaaaaaagatggatgccaagcaagtagattaagggggatgtcttttgactgaagaaattttaaaagtagcgcatttaaacaagttttacggtgaacgccaagttttgttcgatatcaactttgagcttaaaaaaggcgaggtgctggcactgctgggaccttccggatcgggcaagagtacgacgattcggacgctgaacggcttagaggactttcaaagcggtcagatcacttttgcaggccagaacgtgattccggatgaaaagcattggcaaaagctgcggcaaaagatcggcatggtttttcaaagctacgatctgttcccaaatatgacggttttggaaaacatcgtcctggcaccaactaaggttcagcagcgcgaacaaaaagaagcgacggcagaagccaaaaaactgctggccatggttggcttgagcgattatgagcaggcctacccacgccagctgtcaggtgggcaaaagcagcggattgccattgtcagagcgctggccatgcatccggatctgatgctgtttgatgaggtcacggcctcattggaccctgagatggtcagaggggtcttggagatcatcaagaagctgagtgacgaagaggacatgacgatgctgatcgtaactcatgagatgaactttgcggcccagattgccgatcgggtgctgtttttagaggatggtcatattttagaggatacgccgggtcagcagttctttaagcagccgcagactgagcgggcccagcagtttttggagagtatggatttttagtgttttttgagaaaaggggaattgattatgaaaaagcagagttttaaaaaattgattcagacgctggtattggccctgggcgcttttctactggcatttgcaccactggcaggtactgtgacggcccatgccgctgataatcagagttcggtttcagcaatcaagaagcgcggctacattaagattgccgtgtttggggacctgccgccatatggctgggtcaacaaggatggcaagcgcgtgggatatgatctgtacctggcacggcggattgccaaggatttaggcgttaaggccaagttcgtgcaggtcaacgccaacaaccgggttgacacgttgaactccaacaaggcagatctggttttggccaactttacggtgacgccggaacgcaagcagacggttgattttgccaagccatacatgaaggtttccgttggggtcgtttctaaaaagagcgatccaattactaaggtcagtcagctgaaagggcaaaaactgatcgtcaacaagggaacgacggctgaacaatactttactcaacaccagaccggcgccagccttttgaagttcgactccaagacgcagcagttcaacgcgcttaaaaacggtcgcgccaaggcattggctgatgacaactcctacctgtacgcctgggttaagaacaatcctaagtacacggttggcatcaagcagctgggtaagagctcatacattgccccagccgtcaaaaagggaaacaagtcgcttttgaactggaccaacaaggaaatcaccaagctcaacggcgaaaacttctttgaaaaggactacaaccaggaactgaagccttactttggctccgaagtcaaggccagcgacatcattttgactaatcaaaaatagtcattgatgaatgctctaaaatatgaactgtaaaaacgtcgtcggttaattgccgcggcgttttattgattgataggtgaaagtgattcactttagtactgagtaaaaaatttagttgacatgagaaaattgcgtgactataatgagtgaaaattaagaaattcattaaacaataattataaaagcgttgaagagaagagtaggccgctttattagtgtttcagcgactgccgtcagtgaaagggcagcacgaaccagcggctgaagatgagctcagagcaaggtatttggtcagtttggctgaattcccggcaggatccgttaccatcccagacatcaattggtgttgttgaggccgctgtgggcaatccagcggtaaaatcgggtggtaccacgtcggatcagctgcgtcgtcctgaatctatcaataggttcagggcttttttattgccttgagaaaggggaaagacatgacagaatttaataccagactggtgcacgggccagcccaaaatgacaatcagacgggagccgtcaacgttccaatctatacttcaacgacctatcgctatccgaaaatcggcgcggcggtacagtatgactacggccgctcgggcaatccaacgcggcagtatcttgaggatcagttggctgctttagagcatggtacgcgaggattggcgctttcttccgggatggcggcgattcatacggcgctggcgatttttaaggccggcgatcatatcatcgttggtgatcagatctatggcggcacgtttcggttgctcaatcagttctttgaacgctgggggctgagcgcgacaccggttgataccagagatccggcggccattgaacgcgcgatccagcctaataccaaggccgtttattttgaaccggttaccaatccgctgctgcaggtgacttcaattgccgctgtggctaaggttgctaaaaaatacgacttgctgacgattgtcgacaacactttcttaagtccctatctttgtcagccattgactttaggcgccgacatcgtgattcacagtgcaactaaatatctggctgggcattctgatgtcagtgcgggcgcggtgattaccaatgatgaaaaattaggcgactggctctactttgtgcaaaacgcgctgggggccgtgctttcaccagaagacagcaatctggttcggcgcgggctgcagactttaagcgtcagaatggatcgccagcaggccaacgtcaaggcaatcattgctcatctgcagccgctgccagccgtcaaaaaaatctattatcccggtctgttcggccagccaggctatgaaacgctcagcagccaggccaagggtgcgggcggcgtgctttcaatcgagctggctgacaatgtggatgcagttaagttcgttgattcgctgcagctgtttcaactggcagtcagcctaggctcagtggaaagtctggttgagctgccaagcaagatgagccatgcggagctttcgccagctgaacagcttaaagccagaattacgccggggctgatcagattagcggttggcatcgaggatcagcgcgacttgatcgcggaccttgatcaggcattagccaaggcagtttgatcattagcaggcctttatagcactggcatgcagcattagaacgcatggatcaaaacagtcgatcaccagttgaatgaatcagaaaataccagaaagagggaattatttatgtgtgaatgtcaaaataaggtagccaaactgtcactggcaaccatcgcggctcaggccggtaatcatgaagatgagcgtggcgcggtggccctgccgatctatctgtcgtctaattatcgtcacccaaccttaaaagaggccattaattttgatgcgaccaaagactatacctactcgcgcctttcaacgcccaatcgccgtgccgttgaaaaaacgctggccaaattggagggtggaacggcagcttttgcagtcagctctgggatggcggccgttcagctcgcattaagcatccttgaaaccggcgatcgtttgatttcactggatgatctgtatggcggcgactttcgctactttgattatctgaagcagcatgccgggattgagtttgatcaatgggatggccggtcgattgctgaactggttgccaagctgacgccaaaaaccagaatcgtctggctggagacgccttctaatccaactatgaaagaaattgacattcaagcagtcgcagcggccgttcatgaatatgatccgcaaatcaaggtgatcgttgacaataccttttacacgccaatctatcagcagccactgctaaaaggagctgacgtggttattcacagcgcgaccaagtatctgtctgggcataacgatttgttaggcggggccgtgatcgttaaggatgaaaacctagctcaggcgtactacgactactacattacgactggcgataccttggattcatttgactcttggctgcttttgcgaagtcttaagacgcttaaggtgcgcatggctcagcacactaaaaatgcccaggccgtcgttgagtatcttaagcaggcgccggaagtcgaaaaagtgctttatccaggcaaaggcggtatgatcagcttttatctaaaagaggctgatcaggttgaaagactgcttgatcacgttaaggtaatcacctttgccgagagtctgggcgggatcgaaagtctgattacgattccctactatcagacacacgcggacgtttcagtcgagcagcggcagcgattggggattacgcctaagctgttgcggctgtcggttggtcttgaagatgcggctgatctgattgccgacatcaaacaggctttagcagcgacccgttaaggttttcttaacaaattgtgaattgatttgcgctgactgccaattcaagctagaatagttaggattattttttgaaattttaacaattaaaaaggtaggaaagcagcaaattatggatgcacaacaaaaaacggccccgagcaagcaggctgcagccaaggcaaaaatgctcagtgggtcggcctggatgacggcagggagtgtattgtcgcgagttctgggtgcactttatatcattccttgggtaacttggatgggggcctacagtgatcaggccaacgcgctttatgccaagggatacaacatctacaacctgtttttggtgatcgcaacggcggggatcccatccgcaatgtcgaagctggttgcccattataatgggatcaatcagaccaacatcagcaaaaagctatatcataccgggatgtacgtttcaatggcaactggagtgatcgcggccttgatcatgatggttggcgcttcattgctggatggcggggatcctaatgaaattccggtcattcgctctttggcctgggccgtactattgattcctagcatcagcatctcgcgggggtatctgcaggggtacagctggatggcgccatctgccatctcgcagctgatcgaacagctcttaagaatcatctacatgctgggggccacttatctggtcatgaagatccaaaaagggagttgggtcttggcggttacccagtctacgtttgctgcctttatcggggccttgggagcagccgcggtcttgatcatggcgcggattcactaccggcggccaatggaggcgatgctggaaaacagtctggcgacaccagaaatctcgacgatacagttgattgtcaagatcgtttatcaagccatcccgtttatcgtgattgaatcagggatcacgatcttccaactgattgaccaatataccttctttaagatgatgccattggttggccactttacctactatcaaatgaatacggtctatgccatgttcagctttaatgccaacaagctttacatgatcatcattgcggtggctacggccatggcaacaacggtgattccgctgctggctcatgcacgcgctaaaaatgatcaggaaggcatgcgtacacagattgaaaacgcactggagctgttctactttatcatggtgccggcctccttgggactggttgccgtagcaccgcaagtctacacggttttttatcgttataatcaagctgggatcgtaattttggaatttgcggcgtttgcctcgattgccatgggactttacagtgtggcggccgcgatgatgcaggggatttcagaaaaccgcaagatgatgaaaattttgggagtcggcatgatcatcaagctgattttgcagttcccatgcatctggcttttaaaaggcatgggcccgctattggcaacggccctggctatggtggtgatgaactacttgattttgcattcgtttaatatggaatttggtctgcactttgaagaaatggctaagccaaccaatcagattctggccttttctctggtcatgtttgtggttaccaagctggtgatgttcggcctgggctatctggttaatccgcatggccgctatgccgcattcttccttttgatccttggcgtggccattggtggtgttatttatgcttatctggcactgaagtcacgactggctgatcatttgctaggcgcgcgagctgatcttttgcgcgaacggctgcatatgaattaaatcaatctgctcgtctcagttttgggacgggcttttttactgccaagattgttggtcaaaaaaggtcaaaatatttaacaagatgattgagacgtgctaaaacgtagtcgtaaacaagaaaggaaggctgattttattatggaaatcaaagaaactacgattaaccagatgaagaagtctcatttcgacgttacggacactgacaaccatgaagtcgatctaaccaaactggctgaacagccgcaagacgccaagctggaactgcgcgccaagggtcagatcgtccaggataatctgacgcccaagcagattagtatagcggtcaatgacttatttgccgcttaagcaatcaaattcgaccatcaaaaaaccatgacgctcaggagacgtcatggttttattgtttagttcataaatccaatatgcgtttcagtattttgatcagcaacttttttcataaaggcaggcaaggcatgactgatttggtgaggcaaaacgatgtattgattttccgcgatctgatcagccacggcactgtgcgcgtaaacggcagctaataccgcgtccaaaccggcatccttgaattcagccgtaaacgagccgaccattccggccagcgtatcgcccatcccaccgacagcctgcgcggcagaaccgattggcagcttaaagacctggtcatcatgatagatttcggtatggtgctttttcaagacaacggtcgcattcagcttctgaacggctttttgattgttttcaacggactgatcggcaatcttgattcctgaaagccgctgccattccatctgatgcggcgtgtagatgacactgatctggcaggctggctgtttcagattttcccgggccatcaaggtgattgctgagccgtcaattaccaaggtctggccatcgtgcacgtattcaaaaacgtttttaagaatgtacaggctttgcgcgttatcgcctaggccagggccaacgaccaccgtatcggctgctacgatcagatcgccaaccagctgatcatcattaaaatcggcaaacatggcttctggcagctgagcatgcagagctgccgagttggctgggtcggtcgcagccgtaaccaaaccagtcccgccatagactgctgcggttgtggccatgatgatggcaccaccgaaattctcgttgccgccgaccagcacgatcttgccaaaagttcctttaaagctttcctgtgggcgggctttaatgactttttgcagaattgactcatccaagttttgcatatttgatactccctttatttaatccaataaaatccactgacgattgatccgtaaatcaacctcaaataatgttatcattaaatctaggaatttgactaacattggaggtttttttatgactgattggttaaaagccgcacaatctcaaaaagaagaatatcttaacgatttgcgcacgctgatcaagattcccagcgtgcgcaatgatgatgaagccacaccggaatatccgcttggcccagccccagcccaggcattgaaagctttcttggaaatggctgagcaggatggtttccgcgttaaaaacatcgataacgtggctggctttgccgaatggggtgaaggcgacgagaccttggcaatcctggcccacctggatgtcatgccggcaggaaaaggctgggagaccgatccatttaacccagtgatcaaggatggcaatctatacggccgcggcgtttccgatgacaagggcccgggaatggctgcctattacgccttaaagtacttaaaggatcatggtgccgtctttaagcagaaggtacgctttatcgttggtaccgatgaagaaaacgactggacaggaatgaagcgctactttgaagtggagccggcgccaacctatggcttctcgccagacgctgaatttccgctgatcaatggtgaaaaaggacaggtttcactgctcttggatattgatggcggcaatgaaggcgaggtagtcttaaagcactttgattctggcctgcgctttaacatggtaccgcgcgatgccgaagccacgattgaagccggagacaatgaagccgtggcgactgcgtttaccgatttcttggatgagaatccgattaccgggagcattgaaagcgacgctgatggaattaaattaaccgtggttggcaaggctgctcatgggatggaacctgaaaaaggcatcaatgccggaacctatctggcaacgtttttaaagcagcttgacattcgggggcacgcaggcgactttatcgactttttggccagctatctgcatctggatacgcgcgtcaatcatttcaatgctgcctttacgacggataaaatgggtgagatgacgatgaatgccggcatcttgaagtttgatcagcaggctggcgggcacattgatatgaacttccgctatccagagggaatcacggctgacgagatcttaaactgcatcaagccggtcgcagctgatcataattttgccatttcacgcactcaaggcgaggtgccgcattatgttgacgccgatgatccaatcgttaccacgctcctcaaggcctacgttgatcagactggtgatcagactgcccaagctgaagtcgttggcggcggtacttacggtcgcttgatgagtcgaggggtagcatttggcgccttgatgccggatacgccaaatacgatgcaccagccaaatgaatttcagccggttgatgatctgattaagtcaatggccatctatatgcaggcaatccacgacctagtagttgaataaagaaaacatattgttcaagaaaccgttttcgtggtaaaataataacaaagaaaaccaatgtagattttcttaataaggttgttttctggaggtggcaataatgagtgaatacaagaacttattagttggtgttgatggctccgaacaatccaagatggcggttcaaaaagctatcgacattgctaagcgcaataacgccaagctgcatcttttgagcatcgtcaacggtgaacgctatccaaacacgagcacggttggctatggattcgttgatcgtgacatctacaagaaagctacggatgaaatgaccaaggaactggccgagatgaagaagcaggccgaagctgccggggtcagtgatgtcgtaactgatgtcaagatcggcaacgctaagatggaactgacggaaggatatgccaaagaacatgatgttgacctgatcttagttggggccacgggtctgaacatgattggtcggatgatcgttggttctacggctgcttacgtaattcgtcaagccgattgtgacgtcatggttattaagaccgatgaaaacaataagaaactcaacgttaaaatggaaagctatccagaaatctaatagctgaccatttgaaagctgatctttcaaaatatctaggatctggtagctgatctgccaggtccttttttatttgcattataaaaccggactgcccctggctgcgataaggttctcagtaactgtggctgccttagtgaacaagtgccaaggcgtctgctcaccagccatcgactttagctgctggtagctgatgaaatatcaatgctgtttctcgttggcgattaagagtgcgttgcttaagctgtgggccgccagttatgtcagcaatagcagtacgtatatgcaaaaaatcttgcatattgtctgctgagaaaagaccattacctactttttctaaaaattcatgtataagtaggtaaaaatcattgtatattgagttagggtctcctaacattacctactattgactgaaaatgccataatagtaggtaattcacaaagtcggtctggcccaatcagctgctaaatatgcaagtttacctactatttagaaaaaagctgctgcaagtaggtaaatttcgcagtcacagtcaatcaaagcctaatttcgctcacaaagtcgaaatattttaaaggccatggtcaggtgtgcttcggtgactgtgtagtgaatgctgatgggattaatgaatctgatcgcatcaaaacgcaatttaggcaactgcaaaaatcaacagacggctgctggttggtggcatccagacgttttcgacgaccggggctgctactgtttatcaatgaacgattggctggctgaaattataatatctttcaatttgggaatgttatataattggcgttgcacaaggttaagggtaagggagctgaggaatatgaactcgcgcacgaaaaagtctttgggcattatcgcaacgctgctggtcatcgtaattggcgtgatgacctggcatcaaagaactcattttaataagaatacaaccattaatggcgtggccgtagggggcttgaccgcacaacaggcttatgacaaggtagcaaagacaaaactgaccaacgaagtaaagctggatggcaaggtgatctatcaaggccaagccagcagtgccggctttactaagaatgatctgagcaaattccaaacggctctcaaaaaacaagtcactttctttccttccaacaaggccaagaacatcaaggttgtcccaagtcatgtcgataagacgcgcgttgcagcgatgcgggcagctttaaaggccaatattgaaaaagaaaatgctgggcgcaaggcgccggttgatgccaaagcggttttggcaaatggcaaggttacgatcaaaccagctcaaaaaggcaatcgttatgataccgaagcgcttttaaaagactttgatcaaaatgcggccaacgttaagatcgtgctgcataagcaataccgacacccgctggcagccagcagcaaaacggttaagcaggaagccgtcaagttgaaggcgttgcttaatcaaaagctgacgtatcaagtcgaaaacaaaacctatactttaacgaccaatgacatcattaccaaagccacgtatctgaatcaccaatatcaatttgataccacggcgctagacaagctggtcaaaaatgtcaacaagaatcagtcgactctggacaagagctttacgtttaccacgcacagcggcaagcagatcaagacggcaacgggcggttcatatggctggcggcttagtgaaaccaaggctgctgctacgttaaccaaggccttgatcaaccaccagaccagcgtcaatgccaaaaacgacgtctatggtgttggctataatactggcggcattggctatggcacgacatcaaatcatggtatcggcaatacctatgcagaagtctcaatttctgatcagcacgtttggttctacaaggacggcaaatgcgtttttgatgccagcgtggttactggtaaacatagcagtggcgatgatacgcctaagggagtctggtatattatgtataagcagcgaaacactactttacgcggtaccagcgacaacggttcagcctatgcctcgccagtcagctactgggcaccgtttaccgatagcggctgtggattccatgatgccagctggcgaacggactggtcaagcacggcttatctgaataatggctcaaacggctgtgtcaatatgcataccagcgacgcgggaacggcttacgattcattaactcaatatgaaccggtaatcgtttattgattttgctgatgccatatccagttaaaataacggataaattgatctttaagagttaatctaattaaaaaccgcgctgcttcaagctttttctgagcctaagacagtgcggttgttttattttgctaattaatttcagcctggctcaagcaattggggcagtttttttagtgccaatcagcattttttgacatatggaatatcaggagcaaaagaaaggatgatttcaatatgatcaaaaaacaaatctggctgacgagtctggtaacgatgacgatggttttacagctgatggcaccggctttggcagcccagatagcagtaggcaatgagtcgaatggagctgattttaaggctcagctgccggcggtcatcaattcttcaagtgatggcagcatgggggatgactttaaaaacaactggctggcaaaatgtcaaactgcctatcagcagggattacaggatgccatggccgacaagccgcagctgccgcctgatcaagaaccgattaaaacggcttattgtcaaggctttaaagatggcagccagctggccttggagcacgctgattggctaaagcgcgtgcaggaatcgcagcaaaatgtcgtaccagtcttgaatgatcagacagctgcggaccacggtgctgataacaatgaatcagcaggcaatgaacaggaagctgatcaagacaatgctcagctgtcatctgatcaggcaaccagtgaagtgccaagcgcaaatcagcattacgcgccgctttgtccgaccagggatcaggctcggtttatcgcgcatctgggaccaatcgcgcaaaaagttggccaaaagcatgatctttatgcttcggttctgattgcacaggctgccttggaaagcaattggggaaccagcgagttaagccgagttcatcataatctattcggcatcaagggaacctggcatggtcatggcgtttcaatgatgacgcaggaatgcctcagtggtaagccagccatcgtcgcagggacctttaagagctataccgatgaaaaagcatcgttaagcgattatgctgccgttttggaccagccgatgtatgctggtgctcatcgcagcaatgcacctacctatcgatcggcaaccagttttttaaagggtcgctatgctacggatcctaagtatgaccaaaagctgaatcaactgattgaagcctatcagctgacgcgttttgatcgtccagtcaatcaagcagccaattcgtcgcttagtcggccaagaacggatcaacgtcatcagcagcatcaaacggctgccttggttgaatcaaggagacccatgcaaaaaaagcagccgcaaaaagccgttcgtcagcatacctggctgccggttgccagcgggatcggcagtgtcggcattttagaggtgctgcggcgaatgtacctaaaataaaaaccaccgtgtagtcaggcgacttaaacgatggtttcattaatcggctggctgatcggtaatgccgagtcaatcagcggtttaaatgcagcgattgatttagcgaatctgggccagccgctcgtcaatcatccccagaactgtggcaacgttttgcggatcttccaggtcgtatttatccagatcgatcttcatcttaggactggcattgtattcttgataccagtcttgataggcgctccacattttgtagtagtagtccttaagctcagggttgttgtcgatctgttcatagtcgcggccccgttttttgattcggtagagaatggtctcaaaagaagtttctgaataaaccatcaaatcaggcgcttttttaggcagcttgttcaaatcgctcatcatattgtcaagcagctttaggtaaacgtccagctccgtatcagagatgttgccttccgcgttgttttccttggtaaacagcgcgtcttcatagattgagcgatccagcacgttgttgtcatcgcttaatgcctgcttgatcatggaaaaccgcttgtttaaaaagtagatctgcaacaggaagccatactgtttcggatccttgtagtaaagcggcaataccggattttcgcccaccggttcaaaaaaggctttcgtgtgtaggtgatcggcaatcttagctgtaagcgttgttttgccgaccccaatcattcctgctgtaataatcaccatgttggcccctctttacataaaaattcaacttgaccatcttactacaaaatatagtgtctgcccataaaataaatccatattttgtggatgagtgacagacaaggcgagtcaacaaggcataatctgggcaattgagcgcatcaaaaaaaatttgccgtttacatttgaaacaggcaaaataaaaatagcaatttttgagaggacgttaaaaatgattgaacacatgaatgagccacagattcgcgagcaattgacaatcagccagcagcagggaaccttagttgaggtatataactttgccgatgacgatacctttaacgttggattcgtgattgcaatggatccgctgttcgttttactgatgactttggattgggactgcaagatcaatggcttgacgctggtccgcattaaaagcattcatgcggttagaagccagactgactatttgacgacctgttcttataaaagcaaggtagctcaagaatatgggtattttgatatttttggcctgcagcgttttttgcgtgagcatgattttagccacgtcaacttgctgaacacgcttttgaaagattccattgaccatgagctgccggtggtgattggtacgcaaaaatacaagggccgcgatgactttgagggaatggtgcatgaattgacgcacatcggcttgacgctgcattattataacgagcatgacctttcatcgctttggacctatgatattttactggcccagattgactatctgcgggtacgtggttttcaggctatgcagaccaaggcgattatggaaggcgtttttcaccaaaattaaaaaaattattggtttattacaattatttaaaggtcagcaggtaaatatgtggtaaactgatccgtaaataggtttactaatgaaacaagaggaaagcacacattatgaaacacaaagtaacaattcgcgatctggcaaaggctgctggggtttcggtcacgacggtatcgcagattttaaacggcaaggggcagcgcttcagccaagctacacagcagcgagtcttggaactgcgcgatcagatgaattacgttcctgattttaatgcgcgcaatctgatcatgcgctcttctaaaacgattggcgtcttggtacctaacattggcaatccattttttagtacgtttattcgcggtgtgcaggaagcagctcgtcaagccgagtttatgccgctgatttttagtgccaaccatgaggaaaaactggaacgctactatcttggccgcttgattgaacgggctgttgatggcttgattattgccagttcttcgattacgaccgacacgattgaacagctgttaaagccaaatgatattccgtatctgttgttcgaccaaaacgaggccaatggtggggaccgacttttgatcgacgactatcaaggcggctatctggcagctgagcatctggctggtcttggacatcagcatgtggtcagcatcatgccggaaaacatgaccgacaacttaaatcaccggctgcggggcttgattgacggcctacgtaagcatcatgttgattttaacgatcagactgacgtgatttatggcgagctgaccaagcatggcggctattcgtgtactaagggcgtgttggaaaagcatccgacggcagtctttgcggccaacgatgaaatggcgatcgggctttaccgtggcttggctgaaaatggcgtcagtgtgccagatgatatttcggtagtgggttttgacgacatcgacctggctgaatacgtcacgccaaaactaacaacgattcagcagcccattcgtgaaatcggcgaacaggctaccaagatgctgtttaatcggattcaaaacccagatacggccattcagacttcctactttggcgttaagctggttgtcagagatagtaccaagcaggcatagacttgtttgcgcataagctgatatgctaaaatagtgtagttaagaaatactgatttaatcacacataaaagcatttactaatttgctgattgcatcaaaacgcaaaggagactttgaaatgacgaataaaattacggtcgttggtagtctgaacgttgatacgacgctgcgaatcaagcggatgccattgcctggcgaaacgctgtcatccgaaagcaagagcagtgccgctggtggcaagggggccaatcaggcagttgctgcggcgcgtgctggtgcagataccaagtttgttggccgggttggcaatgatcaagcaggtcagtttatgattgactcattaagcgaaaatcatatcgacacgcgctacattaccaaagatgagcatgccggaaccggctcggccacgattctgctcgatgataatggccaaaacagtattttggtttatggtggggccaaccagtgcgtttccccagctgatgttgataatgcccaagctgccattgcaaacgccgattttgtgatcgcgcagtttgaaacgccgcaggaaacgactctggaagcattcaaactggctaagcagcatggcgttaagacgattctgaatccggcaccggcggccaagatcgaccctgaaatcttgaaggttacggatctgattattccaaacgaaaccgaatgtgccacgctgaccaacgttatcattgcagacgagacttcaatgcttgaagctgctggtcactttgcacagatgggggtcaagaacctgatcattacggtcggcagcaagggtgctttctactgcacgcaaaacggctatgactttgtgccagcctttaaggtacacgcggttgacacgacggcagccggcgatacgtttattggtgccttgagttctcaattaaagcctgacatgagcaacatcaaagaagcattgatctttgctcagcgggccagctcaattacggttcagcggatgggagctttaccatcaatcccaacgttggcagaaattgaagctgccagtcaaaactagtcaaaaatcaggctttttggcgttaccgatgataaaaagcgagatcaacgtctttgatgacttgatctcgcttttattaagcttttggaaaagaaggtcttaaaaatgacagtctataatgtaaatctggggattggctgggccagcagcggggttgagtacgcacaggcctaccgatctaaagtgttttcccgcatgcagattccaacaaagtttattttttccgatttgattttagctgataatattgctgagttgacgcgcaatctgggttttcatgatcaagacgtaatctggctctataatttttttaccgatatcaagatcgcgcccacgacctatccgctaaacgagtttaagcgcgcacagcattttgcggagcgcaatgttgaaactaccgtacagaatttcgcggatggcaagcaggtagtccactactggctgcccgacgaaaacctaagaatcaatgtccgtatctatgatctggcaacgcaggccattgactacgccgaatacgtggttgactcccagatggtgcggcgagaattttattcatacataagatacgtaactgaatacctcagcgccggcaatcatgtctatgctcgcgacttttataatgaggatggctcgattgcctatcatcaatatgttaatggcaccaacgaggtctttgagctgaaagaccagatcttttattctaaaacggctctgtatgctgaaatgattcgccgtttaaagcttactgctcaggatctggttatcttggatcgtgaagacgggcgcggactggtcagcggtcagctgtggtatcagatgcattcgccggcaaaacttggcgttgtagtgcatgccgagcattatgatgagcactataccaaccagacgaatattttatggaacaactattacgagtaccagtttacgcatgccgatcagaccgactgttttatcgtctcaacgccagcgcaaaaacgcgtcctggctgctcagatgaaaaagtatcagcatcaagcaccgcaaattgccgcgattccggtgggcagcctgacgagactgatgccgatgccatacgagaaacggcgccggcattcgttgatcacggcttcgcgcctggccagcgaaaaacatgttgattggctgatcaaggctgtcgtgcaggctaaacgagcaattcaagacgtttctttggatatttatggtcaaggcgcacagcacaccagtctgcagcgcttgattgatgagctgcaggccaatgaatacgttcacttaaaaggacagcagaatctaaccgctatctatcagcattatgctggttatattgcggcttcaaccagcgagggattcggcttgagcttgatggaagccgtgggatcgggtctaccgatgattggctttgacgttccatatggcaatcagacgtttattgatccagatcaaaacggctatcggctgccatatcaagcagattggtcagaggaacgcaaggtaagggaactggcgaacgcgattgtcagtctctttagcgatgatcagcgggcagctggttttagtcagcactcttatgaactggcccaaccatatctggatgaaaagatcgctcaaaaatggcgcgtactggtaaacgaggtggcaaaatgataaatctgtttgataaatgggatcaggccgcgcgcgatttcagactggcccagctgattgcgcaattaaagcttcccacggtggtaattcatgatgatggctttttaccgcgcaaagttcaatcgccgctgcagtactattgtccgcgttcagacgaaggtcagccgctttatttcgatcagattccggtgcctcgtttttggcgaatcgttggcagcagcaggggcgcgcagatttatgatctgaatcataaacgcgcggacgttgtttttaccaaaaacgacaatacgcggcaggttaagcaggtacgctggctaaatgatagcggtcagctgcagtgggtcgatgagtatgatcgctttggtcatttgtttgccaaaaccagttgggcagataatcgggcctggctgaagcaattttttgacgagcagggccaggtagtaatcgaatcgcacctggacaatggcagcctgtttttgaatactcgtcaggaacgtcgtcattttaagagtctgccggattttgtcagcagctatctgcaaaagagcggcctgaatctggaccggattttttataatacgctaagcaccagttttctaacgacgctaaagctgcctaaatcgggtcatgatacgctgttttggcatgaaccggtgcaaaataaactaccgggcaatcttgactacatctatcaaaatgaaacgcggacgcggcatgtgattgttcaggactatcgcgtctggcagaatcggcaaaagctttttaaaaccaatcagcatgtggcgaccgactatttgggcatcgtctatccgcatccacggggaaactcgctgcggcccgcgattctgatcttgaccaattcagaccagatcatgcagctagaaaacctggtaaagattttgccgcagtttgagtttcatattgcagcgataactgagatgtccgatcgcttaatggggatgcaaaagtacgaaaacgtctatctatatccagtcgttaagatggatacggcccgcaatctgatgagaaaatgcgatatttatctggatatcaaccaaggcgatgagatcttggatgccgtgcgggcggcgtttgaaaataacatgctgattctgggatttaatgaaacaatgcataagccgcgcctgattgcggatgaaaatcgctatgccgcggctgaatttgataaaatggctattaagatcgtccaggcagtctcgcaggccgatgaaatgcagcgcttgatcgacacgcagcgccagcaagccggtgatgagccggttgcccgttttcaagctgggatcgaggccctgatcaacgattgaaaaaccaataaggaagtgacagcatgccgactgacagacgaccaagctttccccgcgctctactgattttttcggcgttttgtattttgattctgatgccgccagaagccgcgcgcaatattaccgagcatccccgactgacgattctttgggtgattttgtatctaggatttttcggactgattattgcctggggacaaagactgtatcgtcgctatgaccattttaatcatcgctcgcaaagtttttttgcccatgccaaaatgattcttggcggctatatggcaattgtagctggtgagatcgttttgggtaatcttaaccggctgatctatcatcaagtgcagacggccaataatcaagccatcattgacaccatgagcggcagcccgatcgtcagtatcctggtctgtttttcagccgtttgcttgacgccgtttgccgaagaactgatttttcgcggtctgtttatgaatctgttttttaacgctcgcgatttttggttgccaattctgctgtcggggctggtttttacgctggtccatgccagtagcaacattatcagttatctgatctatttttatatgggctgcgtactggcttacgtttaccgttctacgggtaatctgaccaattcaatcgtgattcatctaatcaataatctggtgtccatctttttgattttgccagcggtgatcaaatagcagtttgattatgatcggcagataaaataatttttagtaaattcttgcaaccgattacagaatgtggtatattataggcgtggaaggataagagatatattcagcgaagcgcgtgatgcggtttcgactgaagctggtggctgaagtcatcgagtaggcctagaagcagcgtaagagtgaccagaagcatcggattgtaattgtgtggttaccagcgtgcgccagtactaaataaaaataatgcagctttgcggaagattgaatcaaaaatgtgtttaagttaagtatgaaaattgtatgcttggcgcaaagtagcagattccttcccaaagtggctcgtctcaattaagaggcgggcctttttggttggagttaaatatcagttgttttagcaagtcactgggaccgatgcgcagatcagtcaaccacaatttcagtgaaaaatggtcggctgatctttagtgggagattgctgaaccaccatgcggcaaagtgctcaacgggaagcactattcataaaaatctgaataaaatatttgaaaaaactcattacctacttttagcaaaaaagcgatgcatagtaggtaaaaatcggtgtatatctagttagggatccctaacattacctacaattggccgaaaatccagtaatagtaggtaattcacaaggtcggtctaacccaatcagcccataaatatgcatttttacctacgattcagaaaaaagctggctgaagtaggtaaagttcggttaactgaatatacaattacctatttcttattaaaattcaaaaaatagtaggtaaatttgcatctgccagcgaactcaacttaattttcttcacaagatccgccagctgatgcgataggacccatcatcatgtgaaccttagcagtcaacgaagcagagcggctgcgttcaaggtcttgattttattaaaattatcctgatgcaaaatatagttggcttttttgaaaacagttcttgaaaatcattatgaaagcaagtaaactagccattgctgtgtttttttagaataccgaagtcggtgaagggggtcaaatgactaaatatcgcttacaatcgctgctgtttgtctttgtagcatttatgctgggctgtaatgaatatatgattgtcggggtcttgcccgatattgcaaaagaatttcatgccccgctgtcatcacttggctataccgttactctgtttgcgttgatctatgctatttcgacgccgatcgtaacaactttggcgagccgcttcaatcgctaccacgtacttttggtcttactgctgatcttttttatcggcaatacctggacggcgctggcaacgggattctggtcattgatgggttcgagagtgcttacggcgacggtagcaggagctattatctcgttagtactggttatggccaactatattgcaccgcgcgataaacgggccagcctggtctcgtgggtatttgctggttttagcattgcttcgattatcggggtgccgattggaacgacaatcagcacgattttttcgtggcatgacagtttttggatgattacctggctgacgattctgacctttgttatgctggcttggctggccccccgcgatacgccacaggttcgaggcggtctgcgctcacagttcagtctgtttcgcgattcgcgggttttgatgggtgtcacgtttatcgtcttggtatgtgctgctgactatactttttacacctatgtacgaccgctgcttaccgatatgatgggctttgataatacttggctcaactggcttttgtttggtatggggatcttctttatgtttggcaacaagtttggcggctacttggctgatcatcgtggcatccagtcattacctaagatctatgttttaatgacgctttgtctggcagggttggcaccaagttttcagtatcgctggctgggcgtggctctgattgccatgctttgcgtgatggtggcctgttatggatcgtcaacgcagctgatgtttttagacattgccgaaaaagactatccacagtcgcttgatctggcatcttctttaaactcgatctttgccaatatcggcatctcgctgggatcgtttacggctgccgaaacggtgcattatctgtctttaggaagcgttggctacgtggctgccgtctatggcttgctgacggtactggtgattactggtttgagtcggcgctatcgcaatgcgtatccatattgaagttgaatctgaaggccggcatgagaaatcagtcggctttttattttatcggagtttagattaaaattatcacattattttttaattttataattgacatctaataaagtgcgtggtaaatttagaacatcaaaacagaggaggcagaaaatgatgtttgctgaaaagaccagtcaattgtccaatattattattcttcgcattattagctaggtgatgcggatcttttgacgtgttcgcatcaccgccctcgatgatgcgaacggttcagcaaatggttgtctgccagcagctgactgttcatgaaacagtcagctgcttttcatttaggggtgatttttatggaaagcgacattagcgacattaagaagccaagctgcagaaatacgatcttgcaaattaaaaacacaggaggatggctatggaaaacgcaacagaacgaatgacagtgaataatgaaaaattggaacgcgacccggttaaaacggtaattttggcatctatgatggggacagccattgaattttttgatttttatgcatacgggacggcttcggcagcctattttcctaaggtattctttccccagatgacgccattattagccacgctgctgagcctcttgacgtttggggttgcctttgtcgcgcgtccggttggctcatttgtctttggtcattttggtgatcgcttaggccggaaaaagacgctagtcgtatcgcttttggtaatgggggttgccacggtggcgatcggctttattcccggctatcaaagcatcggggtcggcggcgcgttgctgctttgcctttgccgctttgttcaagggatcggcctgggcggtgaatggtccggtgccgttttggttgctacggaaaacgcgccggctgacaaacgggcactttatggagcttttcctgaagtcggagcaccaatcggctttttcatctgcaatggtttgttctatgtcttggaaaaggttctgacgccagcccagatgatgaattttggctggcgggtgcctttctgggcctcatcagttctggtcgtaatcggtctctacgttcggcatcgtctgcaagaaacgccgctgtttaagctggcccaagaacgcgacaacacgactcgctcgcctttaaaagtagtctttaaggaaaactggcgcgagatcttaaaaggtacgttcttgatgggtgctacctacgcaatgttctttacgctgacgacctggtcactttcatttgccacgacggcactgggctttagtcattctgagttcttgctgctgttgatggcagctatcgttgagtttgccgttttgatcatggcgacttcggttctggcagacaaggttggacgcaagaaagttttgatgacggcttcggtcgcattggtcgtcttctcattggtctttccatacttcttggaaggtcagcacaacatggtcggcatgctgctgttcttaggcttgggctttgtagtaatgggcacgctgtatggcccggttggcgcggttttgccagagcttttcccaactaaggttcgctattccggtgccggcatcacctacaatctggccgctgtggttggggcagccgtagcaccaacgatcacgacttggctgattgctgcgtttggcctgcactatgctgggatgtacatgtttgtcttggcagtagtttcggtagttgcctgggtattaacgccagaaaccaagaatgtcgattacacgaaataatgctttaatgaagtctgcaatgaaaaatgcatcgtcgaaaatgacggtgcatttttatgttaagctaaaagcatcaaatctagttaaggaagaattttatgaacaactggcagacattttattcggcaagcgagcaggccattattttagcaaagcatcagcgcgggattggttttccggcagaactgtaccaacgggcgctcaaggctggcaaatcaattcctcgctaccagcgcatcgtagcttgtcaacgggcgcagctgccgcttttgactgaagatattcagaatctgacggctgtgatcaatcaccagccgctttcaaatccagtttctggttcagctaagcagcatcagcgcgccaagtcgaaaaagcagcagcccatgactacaagaccacatgaaaaaaattggtcaaaaatgcgcaccaagtctaaaaaacagcggccagtgaatgccaatacagatacaaaaaccagcgctaaaaaacagctgcagactatgctgaagcgttacgatggtctggtggccagcgcagaagaaatcggcgtaatgcagtttgaaaagcaccgccgctaccgtaatcgcgcttttgaggtacttaatgatccggatgcaacgatggcagcgatgcatcgtcaggcaaattatctggaaggacagattcaacgcttagaagaacgcatgcagcagcgaatgttttagctctagttatctattaaaaatgaaaggcatgctaccgatttcaaatcggggcatgccttttagtcagctaaaatatgctaataaatgagttaacgtgccgcattcataaagaagatagccgccaaggccaagatagaccagtgcgctgagttgattgccatgtttttctaaaatgtcagctactactggaagatgaaccaaactcatcgcaaagcaaaatacaataatcagcattaaagcaaagatcagtagggtaacgtagatttcttcaagagttgtcatggcagcaaatagtggtgtatagataccaagattatcggcactgcatgacgtaaccgtaagcagagccacgtaactgcttagtttgaagccagttaagccagcttgaatgttttgatcgtcgtcctcattggaaaagagcagtcggcagccaaaatacagcggaatgatgcctaaaaagcccaacatccattctgcaggtacggtatgcagaattagtcctaaaatcaaagaacagcttaccaaaatgataatcccaatcacattgccaatcaggatatagcggtattttttaggcgccttgctttgcgcaaaaaaagccattaagaagccaagatagtccaggttagtcgaaagataggcagttacagccgaaataatcgtgttaagcatgaaaaacttccttgtagattaataaatgagttgttttagccagttttgatagtcacggttggttggccaatgctgacaatgataaacgagtcgataattgtagtcaatgacgcttgtcgagaactaagtcgattgactgaggggtgggcgagcctggctgattggtattgccgaagcgctgctaatgggattcggttgagtacggtcatgcgggaaagcatcagtgtaaagaatatgatcattagcctggcatgtggctgtaacaggttgctaatcagtgtgctgaattttatgtcagcaagcaaccgtaatcttagcaaatgattttggtatacgtagaaagctgattgacgattcagcatgagaaatgaactttatattgatgaagaacaaggcggcgaaaagtttacgactttataagttaaggttaaaaatgtgattgagttaggcgaaaattgctgcttgaacaatgactggattggcgttaaagtataaagaatctcttacaaaaaggaagtcgaaagcatgcttcacaactttactatcgatcatcaattaaatcaccgcacgattcgtaaattcaaagatcagccgcttacagaggaacagttgacaacgctgtttgaagttgcacggcagacctccagcagcgagtttctacagcagatgacgatcattcgcgtaaccgatccgcaaaaacgggccgcgattcgtgccgtcagtacccagccatatgttggggcagaaggcgaattgctgatgtttatcactgatccgcatcgtaatgagctgatccggcaccatcaaggaaatcttgacgatcgtcgtattgaaaaaaccgagatgtttctacaggcctatgaagataccgtcctagccgtacaaaacgttttgaatgccgcggaaagcatggggttgggcggtgtgattctggggtcgattcaaaatgagcctgctaagatcatcaagacgctgcatctgcctaagcatacttttccaaccttggggctgcagctgggcgtaccggatcaaaaaccgcagctgaaacctcgattgccattggacaagatcgtttttgaaaatgagtatcaagatattgatccggccagcttaaaagactatgaccaaatcgtaaatacctattatgatctgcgggatgccaatcgacgcatcgacacgtttactgatcaggtcaacggtcccaagctcaatggcacgccccaggttcgcgatcagattgctcaagtcctccacgatcaaaaactgtgcctggacttataaaatatcctggcttcgttgaaaatgactgattaattcgctatgatcaaactataaggtggtggtcagatgcctgaatggtttgaaaagacaatgcggattatcgttttaggaatctttgtttttggcattatctggtttggctatctgattttactgaaagtcagtggtcaatgaccagcacgcttaaaaagcgaccggcagcagtgctgatcgcttttttgacgactatataataaaaaaacagccgtatatcaacgactgtttaagcaatgccccagacaggattcgaacctgtacatggtcacccatacaacgacctgaacgttgcgcgtctgccagttccgccactggggcatttgaaatgttaagttaaggctaaaaagccaatgccccagacaggattcgaacctgtacatggtcacccatacaacgacctgaacgttgcgcgtctgccagttccgccactggggcatttaaaatgttaagttaaggccaaaaagccaatgccccagacaggattcgaacctgtacatggtcacccatacaacgacctgaacgttgcgcgtctgccagttccgccactggggcatttgaaatgttaagttaaggctaaaaagccaatgccccagacaggattcgaacctgtacatggtcacccatacaacgacctgaacgttgcgcgtctgccagttccgccactggggcatctcaaatttaattgattaattgttgcctaagacaacgatattaactataccgttaatattaaaatattgcaagcgaatttaccaaaaaaaatcaatttttttgattcaacagctgtaccatcgttccataaccggttaagaccagaaatttaggtgcgacttggacgttggcgacattggtggtaaaacggacaccaacgattccatcagcacctttttcacttgccttttgctttaatttttcctcaacggcaggaaaaagctgatcaaaggcctcaaattcatcgatggcctcgctgggcagcatcagatgactggttgcgttaacgatgccaagcgatttatgcggcgatggcagatttccggtcattaagaacatggcttcacttccttaaaatttatcaatatttattttagcataaagattttgcatcgggcacgggtgcggtatagtggttgtattgaattttgaaaccaggtaaggagaggattatcatcgggcgcatcaggatcaataatatgaagtttcatacctataatggcgtatttgccgaagaaaagaaacttggacaaaagctggagattgacgtcgatatgcagtatccaattgaagaacgggttcagcatgatgatttgaacgaaaccgtcagctacgcggatgtctatgatactattcaggattttgttacgacgcattcttttaacttgatcgaaagcgtggccaatcagcttttaaaaaagattttagcagactacccaagcttgcagcaggttactttaagaattcgcaaatacagtgtgccgattgatggtgtttttgacaatgtggagattgaagtgacgggggctaataatgactaaacgagcgtacttaagcattggcaccaacctgggtgatcgatttgataaccttacgcgcgctttgaatctattgatgcgcaacccagccaatcaaaatttgaaggtctcgccaatctatgaaaccgaaccagttggcggcgtcaagcaggatgattttttaaatatcgctgttgcgctggataccaatctaacaccgcttgagctgcttcattggctgcagatcattgaaaagtcactgcatcgacggcggctgattcactggggaccacggacgatcgatctggatatcgttctttatgaagatgaagaatggcagacggcgaatttaaagattccgcatcctgaaatgggcaatcgtcggttcgtcctgcagccgttattagacgtgatggatgatgatccggcacaccaagcttggatcaagcggctgctgcaaaacaccacggatcataactggattcgtccagtagaataggggaaattatggatcaagaaaaaatcaagcacgcggtcagtgagcttttagaggcatttggcgaggatccgcagcgtgagggccttaaagagacgccacagcgggttgccaagatgtatgctgaaatttttgcctctttgaaccaccagccagaagacttcagcaattataagacttttcatgttgatgatcagccagaaatggtcctgatccagcagattccgttttactcaatgtgtgagcatcacctgctgccgttctttggcaatgtcagtgtggcttacgtgccacgcgactgcaaagttatcggcttaagcaagattccgcggctggtcgattttgtcgctaaaaagcctggaatgcaggagcggctgaccactgagctggctaatgagctgcagcggatcttaaaccctaaaggaattgcaatcaaggtcgcagctcggcatatgtgcatggagatgcgggggatcaataagaccggtcagtttacctatacttctaaatttaccggtgagtttaaagatgacctggcactgcgcaaagagtttttaatgcagactaaggacctggtcaaatgagctatgaacgaatcattgccagtctaaatccacagatgcgaggtggcgacaatgatcgggtgggcatcctcaagcgggtattggcaaagctgaatcatcctgagcgtcagtaccgaatcattcatattgctggaaccaatggcaagggctcgactggcagtctgatcgttaattttttgcgggctgcgaatttaaaagtcggtcattttagcagtccagcaatggttgatcagcgtgaacagattcaagtcaatggtcaaatgattgcacgcacggcttttgttgccacttatgagaagatcaaacggcagctgcctgatgatctatcaacggctgatctaaccgtttttgaatggtggacgctgattatgctgcagtattttgccgaccagaaagttgactgggccgtcatcgagtgcggcttgggcggtcaaaatgatgccaccaatgcgattgaggctcccgaactagcgatcattacgcacattgcccttgatcacacgcgaattttaggacctaccatcaaaaatatcgcgcaggccaaagccggcatcatcaaaccaggcagtcaagcggttattttggcgccacaccaagaaccggctgcttttcaagagattttaaaaaaggcgcaggcatgccaggtgaactttttggacagtgaaaatcaggtcgcagtcaaggtgttggatcaaagctggtcgaaaacacagctgcagatcaggacggcagccattgactcaacatgcagctttaggcttttaggtgcttttcagttggataatcttaaaactgcattgacggctgtcgattggctgaagcagactggtacagaaatcacagaagaacagatcaagaaagtgttggcgcagattacaattcccgggcgtctgcagcagatcggcacgcacccgcaatgttttttggatggcgcacataatcctgacgcggcatcacggttgattcaaacgctcaatcaattggggtaccccaaaaaactagtcttggtactgggatttttaaaggacaaaaacgttgctcagatggcttgtcaatacgcgcagctggatgcccagattattttggcaactcccgatcagcaaaagcgcgctctgccagctgaggagctgcatcagtatctgcccgatgccatggtgattgatgatgcctggactgcctatcaaaaagccgttgcattggcaggtccgagcggtatggtgctggtaacgggatcgttttatctgatcaaagaaattgaggcgagaatttaagatgacgacacagagttttgtaattgcaactcataatccagccaagcagcgcgaaatcggtcaaattctggaattttacggcgctcgtggaattgcctatgatcaattgacgacgcggcaagaatttccagcagaaggcaagcgcagctacgaagaaaacgccacaaaaaaagcccagttcatcagccggctgctacctgatcaaaacgtgattgccgatgattctggacttgaattgaaagcttttccgcaaaagtttggaattgagactgcgcgtcagctaaccccgcattttgccaccaaaagcgatatgaatgatggtattattcaattggttaatggtcatgaccgacattttgtcatgaaaaccgtaattgcgctggcaagaaacggtcaagtcgttcaaattgctcatggagaattgagcggaacgattgccacggctcagcatggtaatgagggttcaggattcgaccgcattctgattccaaatggtctcgatcatacgctggccgagatggattttgccagttgggttgcctattgtcatcgcagccgtgccgttaagaatcttttagacctaatggaggaaacatcgaaatgaaaattgttgaaaatacaaatattgctagcctgtctccgctggcctcagcaatttatgacaagctggctcataatcagcagatgctttttttaacctgggaatgtgaagatgatgaactgaccaatcaagttgcccattttttgaatcattttgatgctgccattgcgcatttaaaaggcaaggttgagttcatgctgccactgacggcctttcatttaatggctcaccgtgcaaccagtaaatggccgactgataaggaactgtgtcgctcgctggctaagattgcggctaatcataccgtatattggcgggcgggccggtttgactttaacgtttcggccaagccaatcatttatggcattatgaacattacgcccgactcgttttatgatggcggacgctacaatactccagaagccatgcgtgaacatattcgccaaatggttgcggcaggtgccgatgtgatcgaggttaacggtcaaaccaccaagccggggagatacaaggaagtttctcctgaagaagaattggcgcggatcgttcctggaatcaaaatgctgcagaaagaattccccaatgtagccattgccgttgatacctataagttgccggtgatggaaaaagttttggcaatgggtgttgacattatcaatgacgtacgagccttcgatgatcaacgcaaactgctgctgttaaagaacagtcgcgctggcttggtaacgatgcacagcagccgggaccgtgagtatggcaatctgaccgttgaaatgaagcacttctttgagcataacctggctaagatctcagaagccggcattaacctggatcgggtaattattgatgagggaatcggctattctaaggttgccgatggtgagcaggactatgcaatgatgcgcaatattgatgaatttcgctaccttaaccggccgatcatggttgccatctcacgcaagggttttggcaagaagctgtttgatctgccaaaagatgagcggctgcccattaccctgattgcggaaacctacatgtatctgcatggtggtcgggtcttgcgtgttcatgacattgaagaaacgcgtcagctggtaaaaatgatcgatacgattatggctggatattggcagcgcggctgatcaacagtatcggcactgactaagatcgatcgcatcgttaggtcattcttgcggcgttggacggataaaacctgattaattggctttgattaccaaatattgataatgacgttgatgattaagatcaggtaggtagccccaaacagccagggactgccaaaggtttcgcgtttttgtcgaaaggcagtctcaattgccagcagcgcgactagcaaccaaatgatacggccgataaacagcagcggatgcagacggaaaaacattagcgtcgttgccagagccgtgatggccgcgacaatcaatgccaagcgcgtgagaacgaaccagtcactgacgcgcttttccattttggcatgcagtcccataaaagcagtgacaaaaagagcaattgcacagatggcatcgattaaagttagggttttgatcatttgaaaggcctctcttttaaagttttagctgtttaaattttatcattttttacctgataaaaccgggtttgatacgtgatgcttgaattttgccgcaaaaagagtaaactatcatgtattgctatcaatcgggaaaattgacgaggtgaattgcatgctttacaagattggcgatgttgtcaaaggcaagaagtttggccccatggatcatgacttttccggagaagtcgaaaaggtttatgaaaactcgattatgattgccattcaagactacgatccgtctgaccagagcggtgtcaacgaattgaacggtcgcgcaatcattcgcaaagatgaggccaagatgttaaaggcggttccacggacggcagaagacaaggaagccgaagtggaggcagagaaagaagaagccgaaaaagaggctaaaaagacgactggtaagaaggcgacgcgggcacgacgctcttcaaaggtacgcattgaaaagccagccgacaagaattagtttgaaaaaatcaaattacttgatgacatttttaaattaatgaggtatacttgctaagtaagttatttttacttagcttttgcgggtatagttcagtggtaaaacccaaccttcccaaggttgtgtcgcgagttcgattctcgttacccgcttagttgaaaggaatgagcagactgctcattccttttttatttatccgataattttaaatagcgggtttgtccgattacgattgaatcacattaaacggtgatggctcaccggcagacttggttgatcgatattggaatgtcttatttaaaaccgtgatgtctcgttggcagattagttgactgccatcatgacgattattatgcagaaaatcttgtataaaacatctgacgaaaatctcattacctacttttttcaaaaaagcgatgtaataggatgtaatagtaggtaatctctaggccaatagccgattaagtctctattttcttcacaaaggcagttcgctgatgatcataaaaacagctgacgactgaatttatagtaacagctcccatccatcaactgaaaagacttgatgaggaccacggctttcccatcagcatgcagattgcagacaagtttgggcaaacgtacctatctgcatattttgaaataatgctgggcgtaagatcgtttcctttttggattataattaatgcataggggggagcaaaaatgctgtttgaacagattgctcgtaatcgccggcatacgatttggctgctgatttttatggcaattatcgttttggcggttggcttagtgtttgcttgggcatttggtactgattggatgtggatcttttggctggttggttttggttttactggcattcggcgacggttttgatgaaaatcaatggtggtcggcaggtcgatgaaaagtctgccccgcgtctttatgagctggtgacggaactttgcttggccagtggattgccaatgcccaaaatctatctattgccgattgactgtcccaatgcgtttgcaaccggctgcgaccctgagcatgctagtttagcggtaaccagcggactgcttgaaatgatgaatgacgaagaactgcgcggtgttttgggacatgagctggcgcatatcaaaaactatgatatccgagttaccacgattgcgatgtcgctgcttgagctggttcgctattcaggatgggggctgctgattgctggtctgggattgatgagcgtcaaaaccagggccgggatcatcaagctgatcttttggatgatcggggccagcctggcagtagttggcggtttgattgccattgttgggattccattggctaagattgcgttttttgccatctcaagagagcgcgaatatctggctgatgccgggtcagtagaaataacgcgtgatcctagtggcttgatcggtgcacttgagaaattgaaaaatgatgatcaccagatgccaactgacgatgcggccaccaatgccatctgctttaatgccaagcaaggaaattggctgatgaagctgtttgatacgcacccgccattggaaaaacggatcgcccgactgaaagattcggcatcttaaaaacgcacgagctgagaagatgaatcgcgtgaaaaaattcattctcgtaacaaacatgtaacttgccttttttaattgaactggtataatctgaaattgtataaaaaactgaagaatattagagaggtagccgctggcaagcgagcctgcgttgctggaaggcaggtgcagctggtctcttgaacgcgctttggtaagacatttaaatatcatttgagtggaatgttgcacattcaactagagtggtaccgcgggaaatttctcgtctctaatggactttggggttcgttggagacgtttttttatttaggaggttaaacatggacgaaaagacacaggttgctacggcgctgcagactgcattgccagatatgagcattgaagacatcaagaacaagctggaacggccaaaaaccagcaagaacggggactacgctttcccaaccttctttttggctaaggagctgcacaaggcaccacaaatgattgctggtgaattgattgaaaagatcgaccaaactggtttcgaaaaagtcgttgcagctggtccatacatcaactttttcttggacaaggccaatgtcggcgcagggatcttaaaggaaattttggctgacccagaacattacggtgacttggatcttggtcaccaagccaacgttacgatcgacatgtcttcaccaaacattgccaagccaatgagtatgggtcacctgcgttcgacggttatcggtaacgcaattgccaacatcatgaagaaggtcaactacaacccaatcaagattgaccaccttggcgactgggggacccaatttggtaagctgatggccgcctacgaaatgtggggcgatgaagaagctgtcaaggctgacccaatcaatacgctgcaaaaatactacgttaagatcaacacggaagccgacgaacacccagaatatgccgaagctggtcgtgaatggttccggaagctggaagatggcgatgaagaagccgttcgtctgtggaagtggttccgggctgaatccttgaagcgtttcatgaaggtctacgatatgctggacgttcaattcgactcctacaatggtgaagccttctacaacgacaagatggatgaaatcctgcagctgctcaacgacaagcatttgctgcaaaagagtcgtggtgccggcatcgttgacctttccaagtacgacttgaatccagccatggttcaaaagtcagacggctcaacgctgtacatgacgcgtgacctggctacggccctgttcagaaagcggatgtacggttttgaacagtcgctttatgttgttggggctgaacaaagctactacttccaacaattaaaggctacgctggcgacgatgggctttacctggtctaagcagatccaccatattccatttggtctgatgacgctgaatggtaagaagatgtcaacgcggaagggtaatgtcgttcaactggaagaagtgctggacgaatccatcaagctggctcgccaacaaattgccgaaaagaaccctgacctggcaaatgccgatcaagttgctcaagaagtcggcgtcggcgcaatcgtcttccatgatttgaagaacgaacggaccaattcaatcaacttcaagctggaagatgccgttaagtttgaaggtgaaactggtccttacgttcaatatgcgcatgctcgggctgagagtctgctgcgcaaggcgggcaacccagatcttgctggtgccgacttgaagcttaatgatgaagaatcatggaacatcatcaagcttttgggacaataccaagaaacgatcaagcgggcagctgttaagtacgacccatccctgatcggcaagtacgctctgtcactggccaaagccttcaaccaatactacgctcatacgcggatcctggttgacgacgaccaaaagctggcgcggctggcactggttcaagcagtcagcgatgttttgaagtctgctctggcattgctgggcgttaaggctccagacgaaatgtagtcaatctcaatggcttaatggctgacaactgctggcaattgaaaccagacgattatcgattctgaccagatcaaatcaatcaagaaagctccttgcttcaatgactgaagtgaggagcttttttgataaattgacgataccggagctgattttcaatggtaagtcttaggcatgattgtttgcgttttggataagttttaatggactgacttggcgactgataccaaaaaggactgattgtgataaaattacgtggtgaatttcaaacatgaggaaaatttaaatgaaacaaccaacatctgattggaaattacgttttaaagcctggctgggcaagacctggcatgctttttggacgcgttttaagtatttatggcatcgttttcagctgacgcgctggattatcgttgtcctaatgtcgctgtttttggtgatcagcatctatttgacgtttgttgccaagacagccaatgttaaggatctggagcgacgattggaacagccgaccatgatctacgacagcaagggtaagtcggccggcagtctttattcgcaaaagggaacctacgttaagcttagcaagatctctgcaaacgtacctgacgcagtgctgtcaactgaggatcgccgcttttatcaagagcacggcttctcggttcgcggcttgggacgggcggcactgctgctggtcaaaaacaagctgttgggtcgtgactatatttcaggcgggggttcgactttgacccagcaattggtaaaaaatgcctttttgagtcaggaacagaccttttcgcggaaagccaaggaaattttcattgcgattgaggttgagaatcaatactccaaaaaacagattctcactatgtatctcaataatgcctactttggcaatggcgtctggggcgtgcaggacgcggccaagcgttattttaacgaagacgccagagaattaacggttccccaggcggccacgctagcagggatgctgacctcgccaggaatttatgatcccgtcaagcacccggcggccaccaagtcacggcggaatgtggtcttgcagctgatggtcgaaaacaagaaattgacccagtcgcaggctgatgcctataaaaagacaccgctaacgattaccaatggctataccagtcctgacacttataagtatccatactactttgacgccgtaatcagcgaggccgtcaatacctaccatctgtcagaaaaagacattatgaacaatggctacaagatctacacaacgctgaatcaaaatcagcaaaaggccatgcaggatacctatgatgacgacagcaacttcccagacagctccaccggctcaacgatggttcaatcagcctcaattgccatggatcccaagactggcggagtaacggcagtcgttggcggtcgcggcaagcacgtctttagaggctacaaccgggcaacccaaatgcggcggcagcctggatcaaccattaagccgattgtcgtctacacaccagcactggaaaaaggatatttctatgactcaacgctgcaggacaaaaagacgtcttatggcagcaatcactatacgccgaaaaactatgacaacacgtacagcggcagcgtgccaatgtacaaagcgctgtatgagagtctcaatgctccagcagtctggcttttgaacaagattggcgtcaatgccggctaccagatggctgagaagtttggactgccggttgaaaagagcgacaagaatctggctttagcgctgggtgggatgtcaaacggcgtgtcgcctcagcagatggcccgtgcctactcggtctttgccaatggcggtaaattgccaactgcgcactatatcgtcaagatcgaggatgcaaacggcaaagtgatcaagcgttatcgagccaaacccgctaagcagatcatctctaaaaagatcagcaacgagatgaccagcatgctgttgggcgtcttcaatcatggaactggggtatcggctaaaccagacggctataagctggccggcaagactgggacgactgactcgggaattggcgatggtgatcgcgacaaatggattgtcggctatacgccagacattgtcgttgcaacctgggaaggctatgacagtacgactgagtctcagcagctcacagacgttaccagcaaaaacatcagcgtgctctacaaggctgaaatgagtgcgattctgtcagaaacagccggcacgcagtttacggtcaaggatgcgcaggccaaggctacggctaagcaaaataaggccagcagcagttggtggagcagttttgccaacaacttaaacgacagcggcagcacgctcaagcaaaaggccagcgattggtggagctctttgcagtcgatgtttcagtagctttgccttaagcggtgcataatgttacaatctaaaaagcaatgaattataggaggtaggccgattatggttgtcaatatctacgacacggcaaacgaaatggagcgccaaatgcgggaaacgcaggaattccaagcattgaaggaagcttttgcagaacttaaaaaggatgaggatgcatttggtactttccaaaaattccaagaaaagcagatgcaggctcaacaaaagcaaatgcaaggcactcagctgacggaagaagaaatcaaggaagttcaagacttggctaaagaagttggtcaaaaagacgccattaaaaatctgatggttaaagaacgccagcttgacgacatgattcaacagatcagcaagacgattacggcaccaattgcggaactgtatcgcgaagctatgccggaacaaaacggcggcgcggaaaaatagtttttaaaacggaatcgtagcttgcggttccgttttttaaaggcggtgaaaaaatggccaaattgattgctcaataccaagatggcgaggaaatgcagctttttgccctgatcaaagaagcagcagctaagactaccagtgctggtaagccttacctggcactgactttggctgatgcttccggtgagattggcggaatgcgctgggatgcgtcaccaaaagatattgccgaactgcaggctggcaaagtcgtcagcgttaaaggacagcgcgaaacgtatcgcgaccggccccagatcaagattgaaacaattcgtttggctggtgacgatgagccgcatgatccgctgctgttcgttccgcgggctccagaaacgacggcccagctaaaagcaggttttcgcgagttttttgatctgattgatgaaccggtttggaaaaagattgccgggcacctgtttagcaagcacggcgacaaactattctcctatccagcagccaagagcaatcatcatgcttttgtaggcggtctggcctttcacacgctgtcaattctgcggctggcgcgctcggttgcggcccagtatccgggaatcaatgctgccttgctttatactggggcaatgctgcatgatctgggcaagaccattgagctgagcggaccgatcgcgactcaatataccgtgatggggaacctgattgggcatatctcgcttctggacggcgagatcgtgcaggcctgtgacgagctggaccttgatcccgaggcacccaaggtaattctgctgcggcatatgattctttctcatcatggtttgctggaatatggctcaccggcgcggccccagcttttggaagccgagattctgcatcagctagatgaattggatgcctcaatcatgacgattcagacggctttgaagcaaaccgcgcctggcgagtatacggatcgtttgttcagcttggataatcgccgcttttatcgaccgaccaatgaagaaactttgaagaaaagctaaacattgtctaagccgggtttaatctgggatcggttgtgttatattagattggtaaatttatcacgagtaaattcttaataaactaaaggatgtgtaatttagtgaacgcaaagaaaaaagctttggcgattttagccggaatttctttaatgctgccattggccgcctgtggcaataaggctgttgcaacgactagcggtggcaagattaccgaaagcgaatactacagcagcatgaagcagacttctgctggtaagcaggtgctgcagcagatgatcttggataaggtactggaaaagcagtatggctcgcaagtctccaagagcaaggtcagcagtgaatacaatgcctacaagaagcaatacggttcatcattctcaaccgttctgcagcaaaatggcctgactaccaagacgcttaagcagcagattcgctccaacctgcttttgcaagcggccgttcgccactactccaacttctccaacaaggctttgaacaagcaatggaagaagtaccagccaaaggttcagacagcagagatcctggttggctcaaagtctgatgctcaggcaatcattgacgagctgaacaacacttccggcgacaagtacaaggcattcaagaaactggccaaggaaaagtcaacggatacttcaaacaagagcaatggtggtaaggtagcagcctttgacaacactgatacctcgcttgactcagcttacaagaaggcagcctttaagcttaagactggcgaatacacgacgacgccggtcaaaaccgacagcggctaccaggtcatctacatgatcaagcacccagccaagggtaagaagagcaaccacatcgctcaattgaagcagcagatcgtcgaagaaaacatgaatgattcgactttcctgcaaaacgttgtctccaaggttctgaagaagggcaatgtttcaatcaaggacagcgacttgaagaacatcttggatgaatacttgacgaccagctccagttcaaccagctcgacttccagctccagcaagagttcgagctcggcttccagctccagcaattaatcaaaaaggattgcatctgatatgcaatccttttttggcagcattggaaaaattaaaatgggactccttgtctaaaggcagggggtcccattttggctatgcttgatattttgacaacagtttttgaatcttgatcagtcgcggctcatttttaaactgccaaagatcaatggcatgctgggcagcgcgggtaaactcactgacgccatccattgcctgattcagcttgatcacgctctgattaagtttaaccagctgcatctggagattcttagcggcgcttaaagtgtcgcgaccagcgtttttgaagtcgtcgaacatgactagtcaccgaattgatcgataatcgcctgttgaacagcttgatacttctgctcatcatattggcccgagttgtccgaaaacgtaatgccaaaatcatcttggtcgctgtagcgcggaatcaggtgaatgtgggaatggaaaacggactggtaggctacggcgccattgttgtttaaaatattcatgcccttgatgtcagggttggagtcgcgaatggcccgggcaatctttggcagccggctaaatacggcagctgccaagtcagagtcatattcaaagatgtcttgaacgtgcttttttggtacgaccagcgtgtggccaggcgtgttttgcgaaatgtccaaaaaggctttgacgacatcatcttcgtagaccgtgtagctaggaatctcaccattgataatcttgcaaaaaatacaatcttccattctgagaatacctcttttcaattttttttaagtataaacgaattttccaaaaactgcacccttagtcgattataatcagtatggtataattactcggttaggcaagcaagaaagacaaagaagggatgacaatggcgctggaagttgaacatttaacgggtggctattctcagctgccggttttaaaagacgtttcttttaacgtgcagccaggcgaactggtcggcctgatcggtttaaacggggccggcaagtcaacgacgatcaatcatgttatcggcttgctgcggccgttttcaggatcaattattttaaatggtcaaaatctgcaggaaaacgccgcggcttataagcgtcaaatcgcctatgtgccggaaacgccgatcctgtatgatgagctgacgctaaaagagcatttggaactgacgatgctggcatatggcctggatcgagatctgacttggcaaaaagcccatcagctgctgaaaatctttcgcttggacaataagctggactggtttccggccaacttttccaaggggatgaagcaaaaagtcatgatcgtcagtgcttttatgacggacgccaagctgttcattgtcgatgagccgttttatggcctggatccactggcagttcatgatctgttgaatctgattgaggaaaaaaaggcacagggagcaggtatcttgatgtcgacgcacgttttggacacggcgcagcgctactgtgatcgctttattctgctggcacatggtcaggtaaaggcgcatggtacgctaaaggaactgcagcaaaaagccgctggcgccggagaaacgctggatgacatttatctgcgcttggcaagggatgagagcgatgaatagtctttttaagaaacggcggcaagcccatctgctgcggctgatgaagtattggcggctggtatttaatgaccaattcacgattgcgctgttctttatgattggcgcactggcctatacctatgcgcaatggctcaagacgctcagccctggcatatggtggattcgctggcttttgattttatggttcgtcttggcaatgcaggtcggccgctttgctactttgctgaaaccagccgatcccgtatttttgctgccgcagtctgatggcatcaagaaatacctcaaccaggcgtttttatacagtctaatattgggcgagctgatgtcgctggggcttttgattatcgcgctgcccttagctctgattgacatcagactgaccgcgctaaccattttggaattgctcttggcaggctttgttgctaagctttcctggatggaattggccaaagcccagttgagtctgcaatggtcgcggcatgccaagcaattacggctgggacaatggatcgcaccgcttttaatcggtatgctcagctggctgattgcgccggtttggggctgcgggagcgcggtactgatctatctggtcattaagattgggttgcaaaagcaggatctggactggcgagcggccgttgatgccgagcagaagcggatgtatgacgtctatcgtttctttaatctgtttaccgacgtgcccagtgttaaaggtgggatcaagcggcgaacttgggccaatggcttgattcactggctgacgattcctgatcatgcctggtcttacctatacgcacgcggctttttgcgggatacggaaaccagcagcctggtaggcagattgacgatcgtcgggatgctgatcgtattcttcgtgccattgggctggctgcgctgcttactggcactgctgtttatttatttgattgccatgcagctgatgccatttgcacagcattaccaaaacaatgtctttacccatctctacccgattgagcaaacaacgcagctgactgatttccaggcgcttttaaaaaaggtcatgatcagcttgggtctgctgctgatcttggccagtcttggtactgaatttgactggatgagtctattgagctgtctgattctaggcggtctggagctgtactggctgattaatttttatttcaaaaagaaaatgcaaaagtgaggataaccaatgcgagtaaaacacaaaaaatgggcagaaccactgattgaggcccatcctgaaaaaatcaccactgatccggctcaatttaaaggcaagtggcagagccgttttgccaaagagcagccaatctggcttgaagtcggcatgggcaaggggcagtttgcaatcggcatggccaaggcgcatccggaagttaattttatcggtttagacgtggtttccaccgtggctgggattgccttgaaaaagtcgctggaagatgaagaactgccaaacctgcagtttatctgtgccaatggagcgggtttggatgagttttttgcggacggtgagatcgatcggctgtttttgaacttttccgatccttggcctaaatcgcgccatgccaagcgtcgattaacctacaagacctttttggcaaactatgaaaaggttttggtgccaaagggaacgattgagttaaagactgacaacatgggcttttttgagttttcactggtcagcatgaataattatggcatgcagtatgatggtgtctggctggatctgcatcatagtgatgaaaatgaaaataacgttgaaacggaatatgaacaaaaatttgcggcaaaagggcagccaatctacaaactgaaggctcactttgcttaaatattgaaacggcacagtctggcattgattcaacatcactgccagatttttggtttggttattttgcggagctgcctggcagatttaacgataccaatcgtttgcgggaaagcaggtaatgatgattttatcgtatatcattatgcagaatttattgaataaaagatgtggctgaatttttatcaactgcagaaagcgttgaatgccaatcaaagaagattgtattttaagcggctttgtcacaggataactcccatggcagagccgtttttaattgcttttaaaaattatttatgcaatttaggaaaataatttctataaaagtatggaatttatttcaaaacgtggtatagtaaaagtgttcactaatgaaaggggttacaaaaatgaaacttacagtagcacaactagccaaatacatggaccacacgatgctcaagccaaacgccactcaagcaatgatcgaccaatgcattgacgaagctatcaaatacaacacggcttcagtctgcatcaatccatattgggtcaagcacactgctgatcgcttgaaggatacggatgtcaacacctgcacggtcattggttttccgctgggggcttccacgactaagatcaaggttgccgaagcagttgatggcatcgaaaacggtgctgatgagattgatatggtcatcaacattggtgaattgaaatctggtcaccaagaaatcgttgagcaggatattcgcgaggttgcccaagctgtccacgctcaccacaagcttttgaaggtaatcattgaaacctgcctgttgactgatgaggaaaaaacgattgcctctaagctgacggtagctggcggagccgattttgttaagacctcaaccggcttttcaactggcggtgccaaagctgaagatgtggcattgatgcgcaaggcagttggccccgactttaagatcaaggcttcgggtggtattcatcatttagatgaagcctatgcaatgatcgaagcaggagcaaaccgcttgggagtttccgcttcggtccaaattctagaagaagctgctcggcaataaaattggtttgaaacgtcgcttaagatcgattcaggggaggaaagattatgacgtatcaacgagtatttggcattgttttggattctgtagggattggcgaggcacctgatgcattgaagtttggtgatgatggtgccgataccttaggccacattggcaaatggtatcaaggcaagctggcattgcctaacttagccaaactgggactgagcaacattcgcccggccgatccgattcaaggcgtgccgacagctgatccagcaatgggctgctttggcaagatggctgagatttcggccggtaaggacagtatggatggtcactgggaaatgatggagctgccggttaaaaagccgttgtcaacgttcccaaacggttttcctgacagcatcattcaaaaactggaagccttttctggtcgtaaggtgattgtcaacaagccatattcagggacggaggttatccatgactacggcgagcagcagatgaaaaccggtgatttgatcgtctacacttcgggcgactcagtgctgcagattgcggcgcatgaagacgtgattccggttgaagagctctaccgcatctgccgttatgcgcggacactggtcaatggtcctgaatacacggttggccggattattgcacgaccatacgttggcccagacaaggatcactttgtcagaacggctaaccggcatgacttcagcttggagccaaccggtgagactgatctggatcatttgaaggcagctggtctggacgtcattggaattggcaagatcaacgacattttctctggtcatggcattacggaaggctatcacaacgaaagcaatatggatggcatggatcacgttgaccatgtaatgaaagaagattttcatggcttctgctttgtcaatctggtcgactttgatgccatgtatggtcaccggcgcaatccagagggctttggcaaggctttgatggactttgaccagcgcttgggaacggtacttgaaaacatgcgggaagacgatctgcttttgatcacggcagatcatggcaatgatccttgcttccgcggtaccgaccataccagagaggtaacgccgctgctggcctactcgccgtcaatgaggcacccaggccagtcgctgggaacgcgtgatacgtttgccgatttgggtgcaacgatcatggaaaactttggtgttaccggcaatcaggttggcacgagctttttatcaacgattgaaaactagctaattataaagggggattcatcatgcgaatggtggatgtaattgaccaaaagcgcaatggcggcgttttgagcgatgaacagctgcaattctttgttgatggcgtggtcgacggctcgctgcctgactatcaaatcagtgctttgctgatggcgatctattttcaggggatgacggatcgtgaacagacgcagctgacaatgaaaatgatgcattctggtgagcggcttgatttgtctaagattcctgggattaaagttgacaagcattcaactggcggcgtgggcgataaaaccagtctgccactagctgcgatggtcgccgcactgggaataccggtaccaatgatctcaggtcgcggacttggccatacaggtggaacattagacaagctggaggctattccaggttttcaagttgaattaagcgagcaggattttatcaagcaggttgctgaagaaaagctggcaatcgttggggcaacgcgtgacgtcgcgccagctgataaaaagatctatgctctgcgtgacgttaccgatacggttgattccattccattgattgccagttcaattatgagcaaaaagctggcttctgggaccgatgctttggtaattgatgttaagactggtgccggggcctttatgaagactgaggactccgccgtgaaactggctaaagcattggtagcaatcggcaagcaggctggattgaagtgtgaagccgtgatctcagatatgaatcagcctttaggatccaaaatcggcaacacgctggaaattgaagagacgctggatcttttaaagggcaaaggaccaaaagatctgctggagctggtcttggaactgggtagccgtatggtcgtgatgggacagcaggcggccagtctggcagaagcccgcgccaaattggaacagacgattgctgatggttcggcactggctcgctttaaggcaatgatcaaggctcagcatggtgatccaaacgtggttgacgactactcgctgatgccgcatgccaagtatcaaattgaatatcctgctcaaaaaggcggcgtaattgccaagctgaccgcagatgagattggaatggccagcatgctgatgggcggcggtcgtcaaaaagccgatgatcagctggactatgcggttgggattgagctgcataaaaagattggcgattcggttcaaaaaggcgaatcaatcatgacgatctggagcaactgtgaagatattgatgacgtcaaagaactgctggatcaagccgttgcgattaaagagtcagctcagcagccaactttgattcacgagacgatcgaataggaattatttataaaatacgaggaggaattccaatgagtacgccacatattgaagcacaaaatggtgattatgctgaaacggttctgctgccaggggatccgctgcgggctaaatatattgccgaaaatttcctgaccaacgttaaacaggtcaacagcgtgcgcaacgcgtttggctacacaggcgaatacaagggccatcgcatctcggttcaaggatcggggatgggaattccttccatgtcgatctatatcaatgaactggtacgtttttatggtgtcaagacgattatccgggtcggatcctgtggtgggatggctcccggcgtcaagctgcgggatgtctgtttagcctcgggatcttcaactgattcggcagtcgttgccaactcgtttgcagctggcgttcactttgccccgttagctgattttaagctgcttgacacggcttatcacgtggctaagaacatggggattgagcctaaggttggcgatatctttgctgccgaccgtttctacaatgatgatattgatatgaagaagctggctgattatggcgtgatcggtacagaaatggaatcagcaggactttatctgttggcagccaaactgcattttagagcgctctcggttttgacggtcagtgatctgctatttggcagtcaagaaaaaacaacggccgctgaacgtgaaaagacctttaacgacatgatcaaaatcagtctggaaacggcgattgtccaagctgattgatatatgatcgattactaaaaaagacggtccgttactgacgggccgtcttttctttagtagaattgatataaacagcacaaaatcagaaagtggatgggaataatgattgatgaaactgataagcgggctttaagcgttaaagtcgcgcagctctattatcaaaatgactggcggcagagtagaatcgcagccgagttgaatctttcacggcccacggtatcaagattgctgcaatacgcacgggaaagcgggattgtccagattaagatcagcaatccgttggtttcgactcagcagctagccgcggagctaaaggactattatcatttagatcaagtcattgttgtaccttcagagatgacagccagtggcgagctgttggaactggttggtgcggctgctgccgaatacatcgagacaatcgttaaggatgatgacacaattgggctggcctggggaaaaacgatccatgccattgcccagcatctatcacctgaagacgtgcatggggtcacggtggttcagttaaagggcagcgttgccaataccaagcagaaaaactatgcctttgaaagcgtcaatgcttttgccagtgcttttcacacgctgccacagtatctgccgctgccggttatttttgatcaccaagaaactaaagagctggttgagcaggatacgcatatcaaatacatcatggatcttggtcgacaagccgatatcgcggtctttacggtcggaacggtacgagattcggcactgctgtttcatttagggtacttcagtcaagctgagcaggagtatctgcagcagcatgcggttggtgacgttttttcgcgttttatcgatcaaaatggcagcattgtagcaccacagatcaatcagcggacgatcggtattgacctggaacagctgaaaaaaattccgcagcgtgtgatggtaattgccaatccagctaagacgcaggccgccgcgggagcactgaaagcgggctatgccaacgttttggtaatcgatcagggcagtgctgccggcttggttaagaaactgcatgaaaaaggtgccaactgatgctggaacgttttttggaagatgatgttgtggtgagcgttcatctgctgaccttgctgtttgatcgttcagggctaacgctgcatcatctggcagagctgaccagaattcccgagccccggcttagaaaggaactgaataccttaaatcaagaactgcagccgaaagcatgcattcagatcaatgatgcggttgtctcgctttctttaaccagtccgggtcagctgtttgagctaaaaaaacagctctaccaaaagtctgaggtactgcaggtgatggcctatctgctcaatcaccggggacgctcggtgacgacgttttgtcaggagcactacttttctgagccgactttttaccggttgcagcggcaatgcaaaaattttttgcagacggttggtctgacgattcgacgcggtcagatctgcggtcaagaatatcgcaagcgctacttgattgcggcattaagctgtcattatggcattgactgcgtggatttcggttcagtcagtcagcagatcgtaaaaaatttcgtcattgcggccaaccccggcgtaaaaccgctgctggacaagatgccgcaagcatttgccatgtttgatcatctaattgctttgacctggttgcggcatgaccagtctttggaattgccaactgataatttctggcgggcggtctgtcgagaaaaggcgcatcagcaattggaacgcatggttgatgaatatctgcagccgcaattgtcatttgaactgacgccgcttgatcatgactatttatacctggtctatctaacggttgccaacgagctgtttcgtgatgatgcctggagcctgcagcgagcaacgtttcgcgagatcctgcagcagcttcctgagattcgacagctgacggatgcttttgccgcgctatggggagagccgctgatcaaaacggcagcctttaaagaaacggttaatggattcggcctgcactttatgggtggtctgcagaatctggtaattgaacgccagctggactatcaaacggaaaacaagtcgcagagattgaccgatcagctggtgaaagtgatcgttatgaggtggtgccggcaaaattattggtcagatctggttgatgataatcagatcaagtatttttcgcgacagttgctgccactgattgaagaacagcttcctgccacgccgttatatatctttaccaaatcgcgggctgattatgaagtagtggctcaaatggtgcgtcaagaatttggcaatcgccttcagatcagcagctgcagttattttagtgccgagcagcttaagcagatcaatcaagtaccgcaaagcatgattttggctgaccatgaattttgggagcttttggcggatgccaattcaaacaaccagcgttttttaattaccttggataatccttttttaggaatcgaacgcttacggaccaggctatatcgcctgcgtacgactgcttatgcagaaaaccttacggagaaactatcaattttgcatgctcaagagggttagattttgataggagcaaaacgtttttaaccgctatactttaattgtcattcaggggggaacccgaagatgactgctgattatgtccgggtacattagaaaagcaaagataaatagttgataatttgtcagatcaagtatgctgcatcacgaaaaatcgcttagtgcacgatgttttcggcaggaccccattcaactgctgatgcagatgctgactccattaatagcgataaacgcattaaataatgttaagcttcaatacgacaaatcattgtttggtcaagatagtgtgcagcttggctgagtaagtggttgttgtgccaaatgataaatctagatcatcaatgcgatgcccatccactccgccattgatgtttccaatttcagtaaaaattgattgctttgaccgcagtttatagtgcaatttacatcaaaagattccaattaaatcataatcggcagttatgaatgacaatcggccatgcatcatgttcagatagatgatgcaaaaaaaggctgttggagaaatccaacagccttttgtattgcttaattgtcaatgcgctttagtttcagcagcgtaccagtactggcatctgccaagaattcgtagctgaccagctgatcgtcttcaaagcgccggatgccaccgcgatataccaaagtccgcacggcaaactgacgataaggaatcggctgatgatcaatccagctgccctcaatcgtgccttcacgtttaaaatcattggtaatcatttttaagatcgtgtttgcggaacgccgtcggttgcccaccagcttgccggcaaagaagcccgcaataccggaagcacctaaggtaagcgggatcatccatgggctaagtgaaccatttgaatcattcatttcaatcgcttctttcgtttagcctatgccatattttgacccaaagtagattggatgtaacaattttaacacaaaggcagatcattatgcattgtctttcaacttgtagtagactatacttacataaaataagtaaaaggatggtgttctgtgatggaagctttgcctaaagttaatgctgaacagctgcaggaatatttgaaagggcaggtcgtcttgatgtttactgctgactggtgccctgactgccagtttatcaagcctgccatgccagaagtcgaaaaggattttgccgattttaagttttataccgttgatcgtgatgaaaatctggatttggcaaccgaactaaacgtcatgggcattccaagctttattgcctaccgtgatggtcaagaaattggccggttcgtcaacaaagaccgcaagaccaagcagcaggtcgaggatttcttgagtaatttaaaataagcaaaaatggcggccggcaagtcgccattttttgatggactggggtcatgagcacgggttgtgtggtacaatttagtctggttgtcaaaagtttttgacgaagcgaaaaagaatttttagcaccgttgcaaagcgatgccaagggaaggatttttgatgttaatttcaagctataacccaaatgagatgggtgatgttttggtagtcgtaactggtcaggccgctgatcaaaacgtcaagcaaaatcaaggcgtagttcagatcgtcagtgctcaggatggcagtctgctgggctacaattttctgaaagccagtgaggtattgccagaactcaaggagcaaaacggtcaggtctttttgagcgaggatcaggtcgaaaagctgaatgaaaagattcaagcagctggttttgatgaaaaattaacggctgatgaaacgccaaagtttgttatcggctatgttgaatccatgaccaagcatccaaaatcggatcatctgcacattacgcaagttgacttgggcaatcagaaagttcagattgtctgcggctcgcctaacattgccgaacacgttaaggtcgttgttgccaaggttggcgccatgatgccaagcggtcagattatctggccaggtgcactggttggcgtgccaagtaatgggatgatctgtgcagctcgtgaactgaacttgaaaaatgctccgcaaaagcctggctgtttgattctgcctgatgattttggtcaagctggcgatgcttttgactttgcgcgcggcaatcagctgtttgcctagttggcggcaaggaaaggaaaaacggcattatggaaaagaattattattttgtaggcatcaagggaaccgggatggctgctttggcacgggtgctgcatgatcgcggctgccatgttgaaggctcagatattgaaaaagaaacctttacgcaggcaccattggaacaagccggcattcagattcacgattttgatccagccaacatcaagccagggatgacgatcgtgcaaggaaacgcctttagcgatgaccagcctgaaatcgtgcgggccaaggaactgggcgacaaggttcaaagctatcccgccacggttgaagaattagttgagcagtataccagcattggcgttgccggagcccatggcaagactagtacgacggcgctgctttcccacgtcttgagctcagttgcgccaacgacctatctgatcggagacggtgaaggggttggcacgcctgactcgcgcttctttgtctttgaagccgatgaataccgggatcacttcttggcctatcatccagactatgccatcatgaccaatattgattttgatcatcctgatttctttaagaatatcgatgacgtgcgcgattcgtttgaaacgtatggcaaacaggtcaaaaaagccgtctttgcctggggtgatgatgaaaatctgcgcaagctgcagttggatgtaccgatctattactacggcaccagtgaaaaagacgatttccgcgcggttaatattcaacggacgccacaaggatctacttttgaagcctggtttaaggatgagaagctgggcgagtttgaaatccatctgtatggtgagcacagcgtcttgaacagtctggccgtaattgcggttgcctacatggaaaaagttgacttggctgacattgctaaaggtctggccagcttttctggcgttaagcggcggtttgccgaaagtcgggttggcgatatgacgctgatcgatgactatgctcatcacccaagcgaaatcaaggcgacgattgatgcagcacggcaaaaatatcctgataaacaagtactggtcgtttttcaaccacatacctacagtcgactgcaggcttatctcaaagaatttggtcagtctttgagcgctgccgacaagacgtttgtcacgccaatctttggctcgattcgtgaaaatgccggtcatgtctccagccaggatctggaagacttgattccacaaagcgaaggcattgacatggactctatggacaagcttttagcgtaccatgatgccgttgttgtctttatgggagccggcgacatcgaaaaatatgaagataagtataagagtttgttagcaaatgattaaatagcttgtggaaaatggtggcatttgctaccattttttatataaaagacaatattggtcaaattagtttgactgcttaattcaatcgaaagaaggggagtttatgttcaactctacaccagagcctgagcaaagaagacgcgtcgtcaatgaagctggtttaaatggctttttgaccaagatgtacggctttgtcggcctgtcagtgtttgtctcggccattagttcgtttttggtaatgacgacttttagaaccgccgtgtttggctacttttctcagcacacggggatgatgtggttgctgttgctgctgccaattgccctgtcaatggggatcagtgctagtgccacgcgcaatccaactggcagctttatcatgctgatggtcctgtcgattatgtatggggttgagtttgcgttgctggctggtttctatactggcgctgatattacggctgcctttgtttcgtcggcaacgatctttgtggtaatggcactgtatgggacggttaccaaacgctcgttggatcgctttggggctcatgctacggcggccttgattgctttgattctggcttctttgatcaacatgttcttacacagtccggccattacctacatcttttcctacattgccgtaatcatcttcgtaattttgacggcttatgatgcacaaaagatgaaaaacatctaccttaattaccaagaccaggtttcagttactggtctggcaatcatgggggccttgcagctgtaccttgactttatcaacctgtttattcagctgctgcagatttttggcatgagcggtgatcgtcgcgattagctaattgaataaaaatttagattggctctgcatccttaagtggtgcggagctttattttttattgaaacagatatggttcctaaaaatgccaggggtggtgaaagtctgttacaatcaagaaagaaaataaaagaacgaggtagtttaaatggcagaaaaaatgttgttgattgatggcaatagcattgcatttcgggctttttttgcaatgcataatcaaatcgacaaatttaccaaccaaaacggtcttcataccgcggcaatctatggctttaagctgatgctggatcacgtgctggcaaactatcagccggctaaggccctggtagcgtttgatgctggcaagcagacttttcggacggaaatgtatgctgactataaaggcggtcgggccaaaacgccaactgagctgactgaacagctgccatatctgcacgagatgatgcatgcctgtgggatcaagacctatcaattagctaactatgaagccgacgacattatcggtaccctggccagactcggcgatcaggctggtgatgagaccctgatcgtaactggcgaccgggatctgacacagctggtaactgataacacgacggttgccgtaacgattaaaggtgtgacgcagaccgaaatgtacacgccggctcattttcaagaaaaatttggcgtgacgccaactcagtttatcgacatgaaggcgctgatgggtgacagttccgacaattatccaggggtcacgggtatcggtgaaaaaaccgcgcagaagctgattcaagaatatggctcgctggatgggctttacgaaaatatcgatcagatgcgcaagtcaaagcggaaagaaaatctggtcaatgaagaaaaaattgcccgtgaatgtaaggatctggccacgatacgccgtgacgctccactgacgatcggtctggatgatttgaagtatcaaggcgtgcagactgaagaactgatcaagttttatcaagaaatgaactttaagtcgtttctaagcaagatgaacgttgcgccaagtactgaagaagccacggatgcaaaagaaatcgcatatactgaactgacggctgataatctggatcttttagcggatttagatcatcacgtaaccttccagctggaaatgccgaatgaaaattatcatctttcaacgtttgccggctttgtaatcggggatggtcaaaaatggctcgtcagtcgtgacgaaagcctgctgcagaccgcgccagtcaaaaagattttaaccagcgatcaatatacgaaagacgtttttaatgccaaagcacagatcgtcggtcttcaccgattgggaatcgagctgaactatgtggcgtttgatctgctgctggcttcttatctggttgatccgagcgataacagcaatgatcttggcgagctggcccatgcccatgactattatgacgtcaaaagcgatgaagaggtttatggcaagggtgtcaaacgggcaattccaactgacgaccaggtcttctttactcatttagcgcaaaaagcccgagctattcacgagctgcgcgccccagtctatgaccagcttaaggaacatgagcaaatgccgctttatgaagacatcgagctgcctttgacctatgtcttggctaagatggagattgctggtatcaaggtcaacgcacagacgcttaaagagatgggcagcaagttaaaggagcgcttagccgaaatcgagcaggttatctatcaagaagcgggtacggagtttaacattaactccaccaaacagctgggcgagattctgtttgataagatgaaactgccggttattaaaaagacgcgtactgggtattccacggctgttgcggttttagaaaagctgcagggttattcgccgattattggtcatatcttggagtatcggcagatcgccaagctgcagtcgacttatatcgaaggactgctgaaagttattcacagcagcgaccaaaagatccatacccgctatctgcagacgctgacggcaaccggccgcctgtcttcagttgatccgaacctgcagaatattccggtgcgcttggaagaaggtcgtcagattcggcgggcgttcgtgccacgcgagcctggctggaagattttctcttctgactactcacagattgagctgcgggtcttggctcatattaccggcgacaagaacctgcagcaggattttattgatggcaaggatattcacgaaagtacggcacgacgtattttccatctgctgccgggcgaagaggttacgcctgatatgcgtcgtcatgccaaagcggtcaattttgggatcgtttacggcatcagcgactatggcctctcacaaagtattcacgttacgcgcaagcaggcccatgaatttatcgaaagctactttgaggaatttcctggcgtcaagaaatacgtcacggagatcgtcaaatcggctcacgaaaaaggctatgtcgaaacgctgacgcatcggcggcgctatttggatgatatccattccaaaaattttgccaagcgctcatttgccgaacgaaccgcgatgaacacgccaattcaaggtagcgcggccgacatcatcaagattgccatgatcaatatggacaagatgctgcgggctcataatcttaaagcacggatgcttttacagattcatgacgaactggtctttgaggcgccggctgcagagattccgactttggaaaaactggtgccgcaggtcatggattcggccttcaagctggacgtgccgctaaaggttgaaagcaagtatggcgacacctggtacgatctgaaaaaataaataaagctttaggccgtggcagtcaaggctagccgcggcttttgctttggaatgcgttttgagcaaaaaattggttgaaaactgaaaatcaactataatcgataatgattctaaaagaaacgaggacgatcaaatgccagagatgccagaagtagagaccgtacgccgagggttgatgaatattgccgcgggccgtaagattcaaggaattgacgtttactatgggaaaacggttgaaaatgatatcgaagagtttcggcaagccttgattggtcagacgattgaacggattgatcggcggggcaagtatttgctgtttcgctttaccaataatctgaccatggtttcgcatttgcggatggaaggcagctattatcgccagctcaatgatggtccaatcgacaagcatacgcatgtagtttttcattttacggatggtacagagctctgctatcgcgacacacgcaagtttggccgcatgcgcttggttaaaaccggcgaagagatgcaggtcggcggcttaaagactatgggaccggaaccaaccaccaaagactttaaggttgactattttaaacgaatcttgaaaaagagccgcagcaaaatcaagccgtttttactaaatcaagatcacgttgccgggctgggtaatatttattgcgacgaggttctttggcagagccgcatcaatcccgaacagccggctaatacgctgactgacgagcagattcagattctgcatgacaacatcatcaaagaaattgccaaagcgactaaatacaaggggacgaccgtgcatacatttatgaatgcctttggcgaagccggcgcctttcaaaatcaactggaagtttatggccgcggcggcgagaaatgcgaacggtgcggtcataaactggttaagatcaaggtagcgcagcgaggcacgactttttgtccgcgttgtcaggcttgggcaggtgatcagaaatgactaaggtaatcggtctgacgggcgggattgcaagcggcaagtcaaccatcagcaatatctttaaagaagtcggttggccggtaattgatgccgatcagacagcccgtcaagtcgtcatgcctggcagtcttggcctagcgcagatcgtaagccgttttggcagccaggtgcttcagcctgatggcacgcttgatcgtgcagcgctgggcagtatggtctttgatgatccccaaaacctcagcgatctggatcaaatcgagcatcctctgattatggctgcgattgataaacagctggccggctttaaaaaacaagggctgcccgtggtggttttagatgtgccattgctgtttgaaaccgggatggatcaggaatgtgatctgaccgttttggcagtcgttgatcgcaaaacgcagcttgagcggttgatgaaacgagatcattgcagtaaagacgctgctttgaaaagaatcaatgctcagatgcctttggaagaaaaaatgcggcgtgccgatgtgacgatcgacaataacggttcacttgcacaaacgcgacttcaagtggcaaaactggttgaacgagtaagtcagcaaaaatgatcgcaagtgtgataagataaatgcataacctattgacaggaggaattcggtatgcaatgtccacactgccatcataacggatcacgcgtggttgacagtcgtcccagtgaagatggtacctgtattcgtcgccgccgcgaatgtgcaacctgtggctttcgctttactacttttgagcgctatgaggagacgccgctgttagtaatcaaaaaagatggcacgcggcaggaattcaatcgccaaaaagtcttaaacgggttggtccgctcggctgaaaaacgtcccgtcagcatggaaaaacttaccagcatcgccaatgatgttgaaagacgcgtccgctcacgtggggaaaatgaggtttccagtcaagtgatcggcgaatacgttatgaatgcgctcaaagacgttgatgagatctcctacattcgctttgccagcgtctatcggcagtttaaagacgtcgacgcatttatgaatgagctggaggccatgatcaaccagaatcatcaaaagcatcaagactgattaaggaggagtcgttatggctgaagtgcaagggcgcttgacgccgcaaaccggctttatcgtggccgctgcgtcagactttgtacggtttgaccaagcgacttttattgatttttaccaaccattgctaagtcccaccgcgctggggcttttttatgctttgcaaagtcagctggtccccgaaccaatgctggccaagcgccaggcccacagcatcatgctggatcgcttgaatctgggagttgctcaatttgctgaggcccgtaatagtttagagggcgttgaaatgctgcagaccttttatcagcaagatgagattggcggcgtctatgtctatgttctgcagcccacaatgacgcctgaagaatttattaatgatgatcttttaagcgttcggctgctccagcagattggcgagcagcggtttgacgaactggtcgcccgctcaagacgctatcagttcgataccagccgtatgcataatctgacccatgattactttgaggtttttcgaccggatcgagcggcctgggatgcagaacggccaattttagacaatgccagagcgacggcggttcctaaaagccaggcaatccaaaaaataccgtctaacagctttgactttaactttctgcttgatcagctgagaaatcgcggcattgatctgcaaagcgttaaagagcagcaaaaactgatcatctcagaaagcgtcctgtatagtattgatgagagcagcatggccggcctggtctacgatgcgacagattttagaagcggtattctgcagccccaggctctaaaacgcggcattgtagcccattatgccggcacgttgcgcaggtcagacgatccagccccgacaattccggcggcagctgaagatctaactgacctgggcgaagttgaacgcagcttgattcaaatggcacgccagtacgcaccttatgactacctggctggaatcaagcagtcaagcggttctggctatgtctcgccaaatgagcgcaacaccctgacgcgcctggttgagcagggacagctgcctggcgaggttgtcaacatactgatctatcatataatcgtccaaaaagaaaatactaccttaaaggccagtctggcagatgggatcgccaatgcctggatcaaggcgggagtaaagacggcagctgacgccattcgtgaaatcaagaatcataaaaaggacaatgataggcaggcttcatcaaagtccaagcgccgctattactcaactggccgcagcaatatcaacgaagaactgccggaatgggcaaaacatccagaaaaagttaaaaataaaaagccatctgctgaaaaacttgctaagattgaccaaatgctggctgaacttgatcagcaaaaaaacagttcagataaaaaacaatgattggagggattgccaatgcgtcctatcatagaaaccattaactcaattatcggcgggcaaagcggctcacctcagtatcaggaactgattaaaaaggcctaccaagatcctgaggtgcagagctttttgcgtcagcaccgcgctgaattgtctgatgagcagatcaagcggggcgggtcaaaactttatgagttctaccatgaaaagatgctgctccaaaatcatcagaccagcattgctccaggctatacccctcagctggtcgttagcgccggccgaatcgacgtcgtctatgtaccgacagctcagcttaaggcacagcagcaggctgccgagttaagacagcgcgtgacgaccgtgcgaatgcctaaatttattcgtcaggccgattttaagcatgtaattcgtgataatgacgatcgcgtcaatgctctgcaggcagcgatgagctttgtagggagttatcaaccaggccagtttcaacccggaatgtatctctctgggaactttggggttggcaagacctacctattaggcgctactgccaatgctttggctgaacgcggtattatctcaactatggtgcattttccaagctttgccgttgagatgaaaggcgcaatcaaggatggtacggttgatgaacggcgggatgccatcaaaaaagcaccgattttgatgctggacgatattggtgccgattcaatgtcggcatgggttcgtgacgatgtcttgggcgtaattttggaataccgaatgcaagaagagctgccaacgttttttagttccaacttcaccatgcagcagctggaagaccagcatttggccattgatgcgcaaggcgcgcgtgagcctttgaaagccaagcggatcatgcagcggattcgtttcttgtcgcgtgagtattatattgaaggcgaaaacatgcgggctgggaattaaattgctgcttgacattgttaaagtggtttagtatattagtatctgttgaaagaaaaagcagaagcacccgcttctcgccttggtgaccagagttgccgggctgacgagtttaaatgaccgttgacattcctttgtcaatggagtttagcggggtgcagtatgcattccgctttttttgcttgatctttctgctagtaaaattggaggtgtgttgccatagctcaaggaatgattgtcaatgacggtattcgtgcacgggaagttcgtctgatcgaccaaaatggtgaacaactgggcatcaagtccaaacgtgaagctttgcagctggctgaggaggccggtcttgatctggtgctggttgcgcccaaggcccgtcctgcagtcgcacggattatggactacgggaagtaccgttttgagatgcaaaagaaagaacgggaagcccgcaagaatcaaaagacggtcacggttaaggaaatccgcctgagtccttcgatcgataccaacgacttcaacgttaagctgaagcgtgtacggacgtttatcgaaaagggcgacaaggtgcgagtttcaattcgtttccgtggtcgggcaattacccataaggatatcggacgtgacatgattgaaaagatggccgaagaaactaaggacatcgcaacggttgtgcaacggccaaagatggaagggcgcagcatgttcttaacgctggcccctgctgctgataaggcaaaaaaataattattaagaaggtaggaaatagttatgccaaagatgaagactaatcgcgctgctgctaagcgtttcaagcgtactgccaagggtggcttcaagagtgcccaagctttcaccagccaccgtttccacggtaagacgaagaagcaacgtcgtcaactgcgtggcctttccatgatggacaagtccaacgtaaaacgttacaagaagatgcttcctgccaagtaatcagggcattttacgattaaataatttttaaacaatctaggaggataccactatgcgagttaagggtggaactgttacgcgcgcacgtcgtaagcgcatcatgaagttggctaagggttacactggttccaagcaccgtctgttcaagactgctaaggaccaagttatgaagagcggtctgtacgcattccgtgaccgcaaggctaacaagcgcaacttccgtgaattgtggattgcccggattaatgcgggtgcccgtcaaaacggtatcagctacagcaagctgatgcatggtttgaagctggctaacatcgacatgaaccgtaagatgctggctgacttggctgttaacgacgctgaagcctttaaggccgtagttgacgaagctaagaaggccctcaactaatttgcgtttaatacattgataaggttggagcagttaatgttctgaccttatttttttaccgctgcctttggatggcacgttaattgaacccttaccggttagtcggtataattaaaattagaaattttttacgaggtggaaaatgctcgaaatgtttaaaccgacttggatggttgaacgcgcttatgagatctcaccagcggctctcaagcgtcaaggtatccgagccgtcttcagtgatttggacaatacgttgattgcctggaacaatccaaacgggacgcctgaactgcgggcctggatggaggaactgcatcaggcaggaattccattgatcgttgtctctaataacagtcgggcgcgaatcggcaaggcggttcaaaagctggatctgccatacgttgcgcggtcgcttaagccgcttagctttggcattacaagggcacgtaagaagctgggcctggcaacgtctgaggtcgtaatggttggtgatcagctgctgaccgacgtggctgctgccaatcatgctcatattcgcagtatcttggttaagccgctgattgaaactgataagtgggtaacgcggccaaatcgttttatggaaaaattcgttatgcaggatttgcaaaaacagtatccagatatggactggcaggaggaacttaaatagatgacagaaatgcatgatgaagaattgcgctgcattggctgtggcgcgataattcagacaacggatccggatggcttgggatatacgcccaattcagcactgaaaaaaggactggaaacaggtgagctttactgtcagcgctgctttagactgcgtcattacaacgagatcgcgccagtctctttgactgatgatgattttttgcgtctgttaaaccatattcgtgatgcgcacgccctaatcgtttatgtcgtggacatctttgactttaatggcagtctgattccgggactgcaccgctttgtgggtaatgacaatccagtcttgctggttggcaataaagaagacgtactgcctcgttcgctgcggcggcgcaaattgacggactggctgcggcaacaggctaatctggctggtttgcggccaatcgatacgctgcttgtctcggccaaaaagaaccatcagattgatcagctgctggctgagattgaaaagcatcgtgccgatcgcgacgtctatgtcgttggggtaaccaacgtcggcaagtcgaccttgatcaatgccatcatcaagcagcagacaggagttcaagacctgatcacgacttcgcattttcctggcacgacgctggataagattgagattccgctggatgatggtcataagctggttgacacgccagggatcattcatcaagaacaaatggcgcatgtcttatcggctaaggacctgaaaatcgtggccccacaaaaggaaatcaagccaaggaccttccagcttaatgattcacagaccatctttttaggcggcgtggctcgttttgattacgtcaagggaccgcatgccggcatcgtagcctattttgaaaacagtctgccgctgcaccgaaccaaactgaccaatgcagatgaattttatgaaaaacactgtggcgatttactgacgccgccaaccagtgatgaagtggcagactttccgccacttgaacggcatgagtttgccattaaggaaaaaagcgatctagtctttgaaggcttgggctggatcacggtaccggctggcacgacagtagccggctgggcgcctaaaggagtcgatgtcttggtacgtcgcgcaatgatttagttacagaaaggaaaataatctatgaatcttcgcggaaagcagaagcgttttttacgtgcacaggctaaccatctccagccattgtttgcagtcggcaagaatggtctaacccaggcttggctcgcgcaattggatggtgccttggacaagcgtgagctgatcaaggtcagcattttgcagaatgccgatgaaacgactggtgatgtcaaagagttcattgaacaaaacagtgatatccaggtcgtccaagagatcggccgggtgctggttttgtttaaggtatcaagcaatcccaagctgcgggaactctcacagcgtgttaaacgcatctagaaacgaggtgtgattcttgcagcaggctaaagcaacgatcgcgatccctaagccgcaagttcagcgtaccagctttcagcatcgcaagcgaatcggcatttatggcggtacctttaatcctgtgcataatgctcatttactggcagcggatcaagttggcaaaacgctcctattgaacaaggtgcttttcatgcctgatatgattccgccgcatgttgatcataaagaggccattgatgctgaagaccgcgtcaatatgctgcagctggcaattgaggataatcctttgtttggtattgaaatggctgaaattgagcgaggcggcatcagctatacctacgatacgatgaaatatctgaaagaaaagcaccccgataccgattattacttcattattggtggcgatatggtagactatctgccaaaatggcacgagatcgataagttggttaaattggtaaactttgtcggtgtacggcgtcctggagcgcaaaatgactcgcagtatccggtgatctgggttgatgtaccaggcgtcgacttcagctcaaccgatattcgcgatcggatcaagcagggccgttcgatccgctatatggttcccgataaggttgccgaatatattaaggagcatcagctatatcatgaatgatgaattgatttatcaagagcatttgattccaatgacgcgccaagagctgattgagcatctgcgggccgccttgcgtgataagcgttttgagcatgtgctgcgtgttgagcaaaccgcaattgaattggcaaaacaatatggcgttgatgtagaagcggccagcattgccggactgtgtcatgattatgccaagcagcgtgctgatgaggactttatcaaggtaatcaaagccaagaagctggatcccgatctattaaactatggcaacgcgatctggcatggttttgtcggtgctgagatggttaaagacgaactgggcgtgcatgatgaagatattttgaatgccattcgcttccatacaacgggggcagcctatatgaccaagctggcacagatcatctatatggcagattatattgaaccaggtcgcgactttccggccgttaaaaaagcacgcaagcttaccaggcaggatctgggagctggcgttgcctatcagaccaagcatacgctgctttacctgattaaaaacaacgccccgattcatccacagactctggcaacctttaatgcatgggtgccgcaatatggaaaggaaattgattaatggacagcaaagaattattaaaaatggccgtacaggcagctgatggtcggcgtgccgaagacattacggccttaaaagtcgatgcgattacgccaatggctgattatttcgttattatgaccgggggatccaatcgtcaggtccaagccattgccaacgcgattatcgaagccgcgcatgaaaacggcgtcgatattaagagcgtcgaaggcaagcaggaggcacagtgggtcttgattgatcttggcgatgtggttgtacacgtctttcgtgaagaaacgcgtcattactataatctggaaaagctttggtccgacgcgccgctggttgacttgggcgaatgggttaaagaatagtcatgatctacggaacgtttgcccagctgtacgatgaattgtttgaaagcgatatgtatcagcaatggcgtgaatttgtcgagagccggctgccaaaaagcgcgcagacgattttggacgttgctgggggcgcgggacgactgggcgttttattggcacaagatggctatcaagtcgtggactttgatttttcagaagagatgctgagtctggcctttaagcatgcccaagaagcgcaggtaccaatgacgctggtacaaggcgatatgcgcgatctgaacggcttggaacagtatgatgcgattacctgttttgccgactcgctttgctatctggatgattttaacgatgtccaggcaacgctcaaacagatggcggcgcatttaaaagatgatggctggctgctgtttgacgtcattacgccgtatcagaccgatgaaatctaccctggctatatgtacaactatgaagatcctgatgagcagcgggcctttttatggcgcagctatgccgatgatgacgttgagcatggcgtgatccatgaattaaccttttttaaccgtctgcccgatgatcactaccagcggctgcatgaaacgcattttgagcgagcctatgagttaaaggactggcgagaggcgcttttaaaggctggctttaatcaggttgaggttaaagctgattttggcagtcaagcgattgatgaaaaaacaacgcgctggttctttatttgtcgaaagcaggtggattaatgcatgccgtggggttggtaaccgagtataatccttttcataacggtcatcgctatcacctcagccaagcgcgggagctaacccatgctgaggttgtcgttgccgtaatgagtggcaattttacgcagcgcggcgaaccaacgctgcttgataaatggcagcgcgcacaggcggcactgaccaacggcgtcgacctggtcattgaactgccaatctttatggccgtacagccagcccatcgttttgcggccggagccttggaactgttagcagccttaggagttgatgacgtggtctttggcgctgaacatccaaaatgggattttaaacagctggtagccgcggagcaaaactttacggctagcggctttagtcagtacaacgcgacttttgccacgcagttcaatgaacagctgaaagatcagaccggtttgtcattgactgaccctaacgatatcctgtcatttggctattataaggcacagatcaatgaacgactgccgcttcgtctccacccgattcagcggcgtggcagtcagtaccatgatgagcgcattgagggaaggattgccagtgccagtgcgattcggcaggctgttttagagcatggcgattttaagcaggcagttcccgtccagacggcccagcagctgcaaaagcttcagcaagtgccaagctgggacgcaatgtacccgatgctgcgcaatcagctgattcaagcccccgtcgagcagctggcccagatctatcagatggcagaagggctggaataccgcatgaaagacgcggctcagcgtaatctgagctttgctggctttatgaaggcggtcaaaacaaagcgctatacctatgcgcatctgttaagagtctatctgtatacgatcctacagcttaccgagtcgcaggtgagtgatcatcttaaacggccctatctgcatgttttgggctttaatgaacgcggcagagactatctgcattcgattaagaagcaggttgaattaccgcttttaaccaagattgatcaaaatctgcgtgacgatctgctcaatcttgactatcgcgcaggtaagctttaccagacttttacgccggttgagcaggatttaaagcatgcgccggtgattgttaagggtgtcaaggaataaacattgacaagcaaacttgggactagtataataacgcttgttgcattaggaggttagtaccgtgaaatggacgttggctgaacttcatcgctatcatgatgagccgctgcatattcaaagtacttttgatctaaacgcatcactgacagaacggttccctaatcaagtccttaactgtcagcctgttgaggttgacggctacgtggtctatgatcagggtgatgctactttaagcgtcaacgttaagacaacgctgaccgtaccatccagccgttcgctgaaaccggtcgaattgccattggattttgcttttgccgaaacctatgtcaatgatgagacgcatgctggtcgctatgaagacgatgacttggttttcgtcttgcctgatccgcatgatacgattgattttgacaatgttttggcggaaaatattattgagcagattccaatgcaggtattgtccgaagatgaaaaaaacagctcgcagatgccaaatggcaagggctgggaagtcattgccgaggacaatatcaatcaggcaccggataaggaacatgttgatccacgtttcgctaagctaaaaaacttatttcctgatcaggataaccaaaattagcgaacggttaaaaaccactagtggatagattatttgaaggaggtgtcacacatggctgtaccagcacggaagacatccaagacgcgtaagcgcaatcgtcgtggtcacatcaagctgactgtgcctggcttggctccatgtccaaactgtggtgaactgcgcaagtcacacatggtttgcccaagctgtggttactacaacggcaagcaagctgttgaaaacaactaatcacgtcgattttattcgattaaagacctttctcgaggcgccggacctgggaaggtctttttttatgtaaagattgttaaagattgaaaaaattttaattttaacacagtttaattaatctcaaaggtagggtagattaattttgtgtgataaaattggtgtggttattatgtgggagtaagacccaccaatttaaacgaggagcgttttaatatgagtcggattttaattattgaagatgaagaaaacctggcacgattcgtagaactagaattaaagcatgaaggatatgaaaccgatgttgagctggatggccgcgccggactggatgctgccttaaatcaagactttgacgtaattctgcttgatttgatgctgccagaactgaacgggattgaagttgcccgtcgcgtgcgggaagtcaaggacacgccaattatcatcatgacagcgcgcgattcggttattgaccgggtttctggcctggatcatggtgccgatgactatatcgtcaagccatttgccatcgaagagctgctggcccgcgtacgggcactgcttcgtcgcatcagcattgaaggcggtaatgccaagagtcatcagacaacggttacgtataaggacctgacgattgaaaaggaaaatcgcgtcgttcgtcgtggcgatgagatcatcaacctgaccaagcgtgaatatgaactgcttttaatcctgatggaaaacatcaatgtcgtcatgtcgcgtaaggaactgctcagcaaggtctggggatatgactccaaggttgagaccaacgttgtggatgtctatatccgctatctgcgtaataagatcgaccgccctggtgaaaagagctacattcaaaccgtgcggggtactggctacgtaattcgttcctagtcgataaagaagggtctttatgagcgaaaagcaatcaaaatcatctcgcttcgtttcgctcaaggtaaagtgggccattggcacggccatcggatctttaatcatttcaatgatcgtggtgatttcgctgttcagtgccttcacgcaaaacctactacagcaagaacgcagcgagcttaatcataatatgtccgtcgtggtgcgtcagctggggaatgctggcgaaagttctctgaccaagagtaaggtgcggtcgatttttgagcatgagaccaatctcagcagcacgaccgaattttatcgtcagcctttggttcagggcttaagcaattcacgagtgacggttaccgtgatgaacagtaatgggaaaaagattttccaaactgccaaggccacgctgccgcttaaaacgtccaaacaagctaaaaccgaaatggtcaaaggcggccatcatcaaatcatggttggccgcgagccgatcctatcgcatgacggcacgatcattggctatgttcaggtcgaaaatgatctcaagcagtactatcaagtctttaaacgcttgatcttgatttcggtgctggccctttgtctggtcgtgattgccagcggcttgctgggctatttcctgtcttattactggctgagtccattaaacgatattcatgataccttgacggtggtacgagatgatccaaccagcgatgcgcgcgtgccaaaagacgttactgaattaaatgacgagctgggcgaattatcgcgcatgtttaatcaaatgcttgatcagactcagcgctatattgatcagcagacgcaatttgtcagtgacgtttcacacgagctcagaacgccggttgccattattcaaggacacatggaaatgctgcagcgttggggtaaggatgatccccaggtcttggatgagtcaattgccgctgccttaaaagaaacgacacggatgaacagtctgatcaaagaaatgcttgatctgacccgtgccgaacaagttgacgttaagtttcacgatgccgtcactgaggttaaagacgtggttgaacaggtctttaacaatttcaagatgctgtaccctgactacgttttccgttttgatgacgatctgcatgaagacgttccagtacacatctatcgtgatcatcttgaacagattctgatcatcttgtttgacaatgccgtgaaatattctaaggatcgcaaggaagttcatctctcattatcgcgcaacctgaattccgttgaaatcggcgtccaggactttggcgaggggattccgcaagaagacgtgctgcatgtctttgaccgcttctatcgtgttgataaggctcgcagccgcaaaaaaggcggcaacggtctcggactagcaattgccaagcggctggtagaaggctatcatggtcatattgccgttgaaagtacggtcggctctggatcgctgtttcggattactttaccgatcgtgaaggaaaaaccgattgaaaaagacaaataagcgtaatatttaattgccgcaaaccaaataaaaacctcgtttcaaatgctgaagcgaggtttttatatttaggctgatttagtcagatttgcttttctctgggcgtcttccatcagtctgagccggtgatcctgctgatgaaccaggaaaaagccaaccagcgtgatcaaaagctccgttactggtacggcagcccaaacgccattaatgccgaacagccaacccattaggatgatggccggcagcaagacaacgtagcctcttaaaagcgatagtgaaaacgaaagcgtagcgcagttaatggcggtcaggaaaataatcatcaacagattgatcgctgaaaataaagtgctggtaaagtagatcggcattcccgccatggcatagcgagtcagctgcagagaatgatcatgattgaacagcgtaatgatcggatgacggaacgcaaccagggcgacaaatgccaaagctgcaattgccgctgtaatctttataccatgtcttaaagccagccggacgttgcgaaaatgccgcgtcccatattcgcgactggccagcggctgaacccctaaagcgaccccattagcgattgcaacggtgacgatggcaatatttgagatcacgccataagctgccacggcgtagttgccgctgagctttagcaaaaccatgttgaagacatagattgaaacgccggtgctcaattcgtttaagcatgctgaaacgccaagcttggcagccgttttaagcgttttaagtcttggccagacccaatgccattccagctgccgatatggaaaacgcttatgaaaagaaagcacgatcagactggttgctggcgaaacgactgctgccaaggcggccccttcaatctgaagatgcaggccaaaaataaagaaccagtcaaagatgataacgacaaaactttcaatcagagcagcacgcatggttaaaccagggtgattgtcattgcggacgaaattaacggtgatgtagttgaccatggtaaccggcgcgtcaattgacatcagccgcagatacttgattgccatgcccatggtctgatcattggcccccagaatcgttgccaacggccgtgtaaacagattgattaaaataatgactgcggtccccagcaaaacggcaaaaataaccagttcactgtaaagcgtcttaacgcgttccggatggtcaatcttgttcaatgaaaaataggcagcaccgcccacgcctaaaagcaggccggtacagctgaaaagactatagatgggcagcgccagatttaagacggtcaagcccattgctccggcagccattgagataaaaagcgtatcaaccaggatatagattgaaaggccgaccgaagcggtaacgttgcggacgatgtagttgtttaactcgccgatgatcgattcatgatgtttcaattttcaccatccctttgctttaggatcgctgattagacaaaccttgctcatattataaaataaaaaccagtcagcgtaatggttaagctgcatcagatcaaaaagaaaaagccgattcgtctcaaaaaagaatccttgagataaatcggctctgatgattcagatgataatgccattacaatgatcgagttcatgctggacggcctcggcagcaaaaccagttaatgaaagcgactgtttttgccagttaaggtcaaaatattcaacgacgatctgctggtagcgagttgctgggcgctgaccatcaagactgaggcagccttccttggtctggtaaggctcttttttgatcgtcagttttggattcagcatggctacgctgactggtcctaaagatacggcaattaccgcaactggcgcgccgatcatattggctgccatcccaacgcaatccgcggaattggccgcgagcgtctctaaaaggtctttagctaaagggatgtcttgtttggtggcagggcgagctttttgggctagaatctgcaggttgcgacagattggcttgatcataattacgagcttcctttctaatgattttggtctgaatttataaaaagcaccgggttatgatcagaccgcgatgctttaggattaattacttggatgaatgatgatgctgcttgccggcattgcgacgccgattcttattggcagccggtttggttttggccggggactttttaagctgttcgatcgtatcagtcgtcggcttggtggcagctggctgggctggaatcgggtctggcatcttaactgggtgatccttcatttcttgtttgatgttttcacgcagctttggtcgccaggcatttaccagccaggtctgcagaatagcaaacagggcgctgaccacaaaatacagtcccaatccggcagaagaagaccaggcaataaacaggatcataacagggctcatcagcatcgcggcgcccatctgcttgcgctgttctttaggtacgccgatcatggaaagccacccctggaccatgtaggccaaaaacgccagaattgccaaaattgcgcttggcttccctaaaggcattcccatgaacgtagcatggtaaagatctggcgagtagcggatggctgcatacagggcagcaaagattggcagctgaatcagcaatggcaggcagccgattccgccagtcatcgagatgttgttgtcacgatagagctgcatcatctgttggctgaccgcggcttgttcctgtggcgtcttggcgtctttttgccgctgctgcagctcacgcagttgcggctgcaccattgccattttttcctgcatcagtgttgattttttcatttggctcatcatgaccggcaaaagaatcaagcggacgatcacaacgattacgacgattgcccagccatagttgtttcccatgtgctgagccagccaagtcatcaggtgctgcatgggtttggccatgtagttgtagacccagccgattggatgtccatgcttgtcggtacgtacgcagccgcttaagatcagcagcatggcgcctaaaagcgtggccacggtgagacgttttttcttcattttaaatagctcattcctttgacttcaataaatttaacattttgtatcttaccttaaaaagggcttaaaatctagcaacttcaacaagatcactgcattttaaagtcctgccagtcgcttttaatggcgcgtggctcgattcgcatgccggcaactttggcatatgggttgggaccagcctgaacttctttgacaaacatcttgactactttggctggaccttggacatcgatcgtcacgctgccgtcccattcatttttgacttggccgaccagaccgtattgtaaagccagttcgtgagtagaccagcggaaaccaacgccttggacgcggccagtgacgacaatatgataattaagcataaaaacccctcccataagcggttgacgattatcaaggatcattaggataatggtataattaagttaacgataaactgaggtgaaaaattagactatggaagaattaacttcaattcacaatcaacgcgtcaaaaactggaaaaagctgcagacgcgcaagtaccgtcggcaaaccggccaatacatgctggatggctggcatctggttcaagaagccattcaaagcggactgacgattcatgagctgatcggcaccaaggcagcactggctgaacatagtgatattgtatcacgggtcaacgcggtctatcaggtcacgcctgaaatcatgcgtcatattacagagacgattacgccccaagggatcgtggcaattgttgacatgccgaatctcaagcgcaagccagctttaccgttaaagggggcctggctgctgctggatcgggtgcaggacccaggcaacgtaggaacgatggtcagaactgccgacgcggctggttttgcgggagtagttgctggcgatcggaccgctgacttctgcagcccgaaagtcgtccgttccatgcagggcagccagttccacctgcagctgtttgaaggcgatctaaacaagtggattgccgattttaaacagcagcagtcgccagtctatggcacgcagcttaatccagccgccaagaatttccgtgctgtgcatcctgggactgattttgccttgattatgggcaatgagggtcaaggaatgagcgatgagcttttaaagcagacgacagataatctgtatattccaatgcgtggtcaggcagagtcactcaacgtcgcagtttcagccggcatcttaatgtttcagctgaatgcccaaaactaaatcctcagttgtcgtcaatcctgctgagttgcttactattaatacttaccttttataagagtttattaatttaattttgatggcaaatcatgtatgatattgacaaataaaggaaggggccagttactatgaaaaccgagaacgaatggcgtcaagacccagaatatgtatccttggtcaaagatctgctggaacagccggccgttaaaaggcttgcgcactataagcagcatcatcattccaatcgcctgcagcattcgattgccgtttctttcgacagctacaagctggcaaagaaaatgcatctggactacaagagcactgctcgcgccggactcttgcatgatctgttttattatgactggcgaactaccaaattcaatctgggatcgcatgcctttattcatccacgggttgctttgcgcaatgccgaaaagattacgcatctaaacaaaaaagagcgtgatattatcttaaagcacatgtttggcgctacgatggccgtgccacgctatatggagagcctgatcgtttcgatggttgacaactacgaggctgagcatgagtttttcggcccgctgcgcaaaaaacttgagtagcaaaaagaaattgtgaactggcatgcgactccttccaaaaacagtaaacagatttagttttgaagagaggaagattacatggatcaagtaaaggtcaaacaggatgatttcacactatgtccaaagttcactgaaacgtttgccatgctgggcaaaaaatggaatggattaatcattgaagtcttgctgcatgaacatacacagcgttttaaggatctggccgcacacgttgataaatgcagcgatcgggtgctttgcgagcgtttaaaggagctggaagaaaacgggattgtttcacgcaatacctatcctggcgagagtcgggtcgattattcgctgactgaacgaggtcgtgatctggcgccagttatggaggccgtgcacgaatggagcgatcagtggtgcggcaaagactaaaattaggacttgaccacgttgtcatgattgcctaaaatagccttatatttaactaaaacgactttgatggaaattagtagctgaactgacggcacctagggagaaatgatcatcgactgcaagtcatttctgctttcatcagtgaatttcacttccggagttggtaccttgtatcccggttgacgaccgttatcagtcatttgagcgtatgacattgtcataaaccagggtggtaccgcgaacaactcgtccctcgattcgtcgaaggacgagtttttttgtggccacgctaaggaggaaaattgatgggtttaagagaaaaacttgaagaattgcgtcaacaaggtctcaatgaaattgcaaacagtgatgacctaaagaacgtcaacaatatccgggtcaagctgctgggtaaaaaggggccaatcaccaacgttttacgcggcatgcgtgatctgagcgctgaagagcggccaaaagtcggtaagtttgccaacgaggttcgcgatgagctgcagcaggctttagaagacaaaaagtccagtctggaacaggcattgatgaatgctaagctgcaaagcgagtcaattgacgtgaccttgccgggaaccccggttgcacaaggccagccgcacgtgattcagcagatcattgatcaactggttgatctgttcatcgggatgggttatgaagtcgcagtcggcgatgaagttgaacaagaagaatacaactttgaaaagctgaacctgcccaaggatcacccggcccgcgacatgcaggatactttctacattacgccatcagttctgatgcggacgcagacttcgccaatgcaggcgcggatgatggaaacacacgacttttctaagggaccgctgaagatgatctcaccaggcaaggtctaccggcgcgatactgatgatgccacacacagtcatcagttccaccaagtagaagggctggtcgtcggtgagcacgtgacgatggctgacttgaaagggacgctggaagtagttgcccaaaacctgtttggcgatcagctgaaggttcgcttgcggccaagctacttcccatttaccgagccaagcgttgaagccgacgttacctgcttcaactgcctgggcaagggctgtgcaatctgtaaaggcaatggctggattgaagtcttgggtgccgggatggttcatccaaacgtcttgaagatgtcaggcgttgatcctgacgtatatggcggctttgcctttggactggggccggaccgttttgccatgattaaatacggtgttgaagacattcgtgatttctaccaaaacgacatgcgcttcttgacgcaatttgatcagaaaggataatttcaatgaaagtttcataccaatggttaaatgaatatctgccgcttgaaaagaaccagattgaacccaacgcgctggctgaaaaactggctctgacctcggttgacattaatgaggtctactcgccaagcgatggcttgagcaatatcgtcgtgggccagatcgaatcggtcacgccgcatccagactctgatcatctcaatctgtgccaggtcaagatcagcgaaggagcggtcgttcaaattgtctgtggtgcacccaatgtcagccaggcagccggtaagaaggttatcgtcgccttagctggtgccaagcttaaagatggcactaagatcaagcgcggcaagattcgtggcgaagaatcaaacggcatgctgtgtgcgctgcaggaaatcggctttagtgacaagattgcaccaaaggcttatgaagaaggcatctggttcttgccagacgatgccaaggtaggcgatgccgtctttggctatctgggaatggatgacacgatcattgataccgatctgacgcctaaccggggcgacatgctgagtatgtatggcaatgtcaatgatctgagcgcaatttatgatctgccgaataatttcgtttcacatgacgttaaggaaaacggtacgcaaaaagctgctgatctgctgaggattacgatccctgatccacagattgcaccagcctacaaagcccgggtcatcaagaacgttaagctgggtgagagtccaatgtggctgcagattcgcctgtggaatgcgggcattcggccaatcaacaatgtcgtggacgttaccaactacatcctgctcaagtacggtcagccaatgcacagttatgactatgatcggctgccagctcatgagctcagcgtgcgtcatgcgtatgagggtgaaaagtttgtaacgcttgatgaggccgaacaaacgctgcaaaaagaagatattgtggtaacctcaaacgacgagccagtctgcctggccggaacgatggggggactgaatacggcagtcagcgatcagacgcaaaacgtggtcttagaagcggctatctttgactcggtcatggttcgcaagcaggctcgacgcttggatctgcacagcgaaagctcaatgcggtttgaacggggcattaaccctgaaacggttgaaacggctctgaatgaagcagcttactggctccagcagctggctggcggtgaggttgagcagggcatcgttactggcagtgaggcgccaaacaagtcaacgtcaattacgatgtctttgactaagatcaatgccgtgctggggacggatctgaaactggcacaggttgaaaacatctttgatcgcttgaagtttgcctacacgcaatcggatgacgatacgctggttgtaagcgtaccggcacggcgctgggatatcagcattgcagccgatctgaacgaagaaatcgctcgtctgtacggctacaacaatattccttcaaccttgccaaccatgacgcggacgctgggtggattaaacgagcgccaaaagttcttgaaggcaacgcgtgaatcattacagagcatgggattgaaccaagcaatcagctactcattgatgaacgaagaacaggctcagcagtttacgattgaatcagccgttaagccaatgcagcttgactacccaatgagctctgatcatacaacggctcgcgaaagcatcatcagtggccttttggttgacgtagcctacaataccgcgcgtcaagtagaagatatcgcgctttatgaacaaggccgcgtcttcattcctaaaggcggtgagcgtcctgaagaacaagaacatgtcgcgggggccatggcaggcagtctgttgtctgacagctggaatctaaagcggcgtccggttgacttttatcagatcaagggaatcgtcgaacgctacctgcacaacatggcgattgccggcacgattgaatatgtggctgacagcactcgtcctgagatgcacccagggcggacggccaatattttgttaaacggtaagctgatcggctttgttggtcaggttcacccccaaatggccaaggacttgaagattccagcaacctatgtctttgaactgaacgtcgaagcactgctggctgccgacaagctgccaaaacagtaccgtcatatcagcaaatacccagctgtaacgcgtgatattgcgctgctgatcgatgaagacgtgacgaatgaagaaatcgttgatctgatctaccaaaaaggcggtcaatacctcaaagacgtccaactatttgatgtctacacgggggctaagctgccaagcggtaagaagtcgctggcctacacgctgacttatcaagccgacgataccacgctgacagaagaccaggtcaatgaagcctttgccagagttgaaaaacacctgcaaaacgttttgaatgcagaaattcgttaattgcagttactgattagggaacgtctaaaaaggcggtccctttttgctattttgtttgaggaacttaaaatgccccattttaccaaacaacagattcagcgccaaaatatcgtgaccctgcttgtaattgtcattttgatcgttagtggtctgattgtgcatggctggtttaatcatgagctgctgccggtagatgctgatgaccagaccagacgcatggttgtgattcctaaaggtacgaccgataagcaggccggtacgctgctcaaaaaacagaaactggttcgcaatgcctatgtattcgactattatctgcagacgcacaagacgcagggcattaaggcagggcgcttttatttgaaacgaagccagtcaacgcctcagatcgttgaaaaactgcagcaaaaacccacggccgcgacaaatcctgccgaataaacttgtcgctgctatccggctgcgctatactaagtttcgtattgataaataaaggagaattttagcgtgaacaatgatgacaaacgtccaatcattattggcgtaacaggtggctccggcagtggcaagaccacggttagccgagccatctacaatcagctgcatggacaatccatccagattattactcaagatacctattacaatgatcaggctgacatgacgatggaacagcgtaaggccgtcaactatgatcatcccctggcttttgatacggatcttttggtcgagcagctggatcaactgcggcataatcaagccgttgaaatgccggtctatgactacaaagcctacacgcgggctaaggagaccgtgcatgttgaaccacaagacgtaattatcctggaaggtattttgatcctggatgatgaacggctccgtgatctgatggatatcaaggtgtatgttgataccgacgacgatattcgtatcatccgccgtattcagcgtgatatggaagagcgcgggcgttctttggactcgattattggtcagtatctggcaacggttaagccgatgtatcaccaatttatcgaaccaaccaagcgctatgctgatctgatcgtgccagaaggtggtgagaaccaggtcgcaatcgatcttttatcgaccaaggttcgcgatattctggttaagcgcggtcatactgaactaaagtaagcataatgatggtttacaattaatgttgagcatgttaacgttgcaaaagacgaaattcaaaaaataaatctaggaaaatttaaaggagttgttgaaatggctgaagaaaaaagctacccaatgacggctgaaggtaagcagaaactggaagaagaactggaaaacctacgcttggtacggcgtccagaagtaatcaagcgaatcaagattgcccgtagctatggtgacctttcggaaaactctgaatacgaatctgccaaagatgaacagtcattcgttgaaagccggatctcacagatcgaacacatgctgcaatactcagtgatcattgacaacaatgacgtagctgccgacgaggtttcgatgggacgtcaggtaacgtttaaggaactgccagatgaagagccagaaacctaccaaatcgttggtgaatccgaatctgacccgctgaacggcaagatctcaaacgaatcgccaatggctaagggcttgattggtcacaaggttggcgaagaagttgaaattgagattccaaatggcacgatgaaggtcaagattttggaagttaagtaagcttccaataattccccgcttcaaaagcaaagtggggaattttttattacgtctgtgttgacaaatgtaattataaagttcaaaatgatcacggttaaagattacaatcgtaaacaaaaggaggatgaaataatgattaaaatcttagttttattgattgctgtattattaattgctgcaattatctggtggttctttggccgtcatcaagaaaaggccgttgcggctgacgttagtgccgacagccaggatcagaaggtaaaagtagaagttaatggtggttattcgccaagtacgattgtcttaaaaaaaggcgtaccggcagaactggatttttatcgcaaggatccttcatcttgcttggaacgggtcgtctttccagatatgggaatcaacgaaaaactgccacaaaatcagctgcaccagattaaagttgataccagcaaggctggcgagtatgagtttgcctgtgggatgaatatgtttcatggtaaggtgatcgtaaaatgatgagcatcaaaaagcgtttttggctggctttgatgctggcattgccgatgttatatgacatgctggctatgttttttaattggccaatgatcccaaacggtgactgggtggcattgattttgacaacgttgatcatgctgatctcaggccgtgcatttgttcagagtgcctgggcagcatttttgcatcaccatgccaacatggacacgttggttgccgttgggaccatgacggcatatctgtacagtatctacgcgctattgcatcatcaaggcgtattttttgaaagtgccgcttacatcattgtcttcgttttgcttgggcagtacctggaagacaagatgcgcacgcaagcctcacagtcaacaaccagactgctgcagctgcaggttaaaaacgccacgctgattaaagatggccaaaccaaagaagttccgattgaagacgttaaaatcggtgatcgcctgctggtacgtcctggtgaaaaaattgctaccgacggcaaggtagctgctggtcattcaacggtcaacgagtcaatgattactggtgagagcatgccgattgaaaagcaggccggcgatgcagtgatcggtggtaccctcaatcaaacggggatgctggaatataccgtcgaaaaagttggcaaggataccatgctggctcaaatcgttgagatcgtcaagcatgctcagtccagccatgcgccgatacaaaaactggcggatcggattgctgatattttcgttccagtggtcttgatgattgcaattgccgtttttgccgtttggtacgtctttttggatgctgaattagccaaggcactgacttttgccgtttcgacaatcgtgattgcctgtccgtgtgcgctggggattgccacgccgactgctttgatggttgggacaggacgggcggccaaaatggggattctgatcaaaaatggcgaagtcttggaaaccgccagtcatattaaaaatattgcctttgataaaaccggtacgcttacacagggacaaccgactgttacggatgtgatcggcgacccaaagcaagtcttaacgctggcagctgccttagagtcgctgtcagagcacccactggctgaagcaatcgtaaaagcggcgcaaaagcaagcaatcaccttgccaaacgtgaccgaatttttaaatcgaaccgggcagggcgttaccggtcaaatcaatgggcatcaggtttttgtcgggaagcctcagctggccagtcagccgcttgataaagaatggcaggatcaaatcgaacgacttcaggaagttggcaagacaacggcagcagttgggcaggatggacagatcattggcctgatcgcgattcaagatgcaccgaagccgtttgccaggtcagtcatcgcaagactaaagcagcagggaatgcacacggtgatgattacaggtgataataagcgggcagccaaagcagttgccaaacaggtcggtatcgatgaagtgattgccgaggtaatgcccggtgacaaggctcaacaggttaaaaagctgcagcagtctggggtgacggcgtttgtcggtgacggaatcaatgacgcaccggccctggcagtcgcagacgttgggattgccatgggatcgggaaccgatgtcgcaattgaaacaggcggcatcgtcttgatcaaaaacagtcttaaggatgtcgtcaaagcgcttacgattgccaaaaaaacctttgcgcgcatcaagctgaatctgttttgggcactgatctacaacctgattggtattccaattgcagccggtgtttttgcacattggggactggtgctcagcccggcactggctggtctggcgatggccttcagctcggcttcggtagttgccagctcattgatgctcaactttgctaaaattgatgactaaaatcaaaaccaccaaaaaaggatgacgtcagctgcgtcatccttttacttttagataaattaaagcattagcgcttctgtcgaccttttttaagccaccagatgctgccgctaattgccaacaggctgattgtagttcctaagatcagatatggtggaatgtagtacatggaaaccttatgcttgccagtcgacattggaattgccataaaagtacttaaggcttttttaggcgtaacggttttgccatcaaccttgacgtgccagccctgatcataagggatggtagtcattaaaagatcctggccagctttgagattgaccgtgcccgagattcggttggcggcatagctggagacctttaatggcgattgctttaaggtcttgagactggcattgaaggctttttgattaagcatgtagagactgacgttttgcatccagagcgttgagttcttgagactaaagacgatcttgatggttttacccttagcgtggttggcgacgttgaccgttaccgtattacgataggtatcgtattgagtcaaggccttgccgttgatcgtaatcgtggcattgttcttgacgttggcgcctaaagtcaggtaataagaattattggtcgtcggggtaaactcaagctcaatgcttgctggcgtcagcagattgcgttttttaaacgtggttccggtaatctgaacggcggattggacattgccaaacgtgacgtggttaaagttctggacctggaacagcaactgattgacgccgcgacccgccagcgactggaagatctgcgactgataggccaatggatccagcgtattatgcgtcagattcgagacttggctgctggcaccaaatgcaatcggcagcgcagcttgattggacttgatattgaccattgaagtctgagcaatcgttttttgctgcttgagatcgggtctgagactggtcgacggcaaaacggtactgccattctgcttgccattatgccgttcctgtaagaagtacttaaagcccagcagtgaatcggtaacctgtgtgccatccgtgtaggtgataaagccatcgccatcgggttgcccaattgctcccatgaatgctggctgagcgggttccagcgttgagccaaagtgatcgccgctgttgaaatcggcttggaatgggtcatccttggtccgcataaaggtcttgccggttcgataaaggccgctgtccagggacttgagcttggtaacggctttatccagctctttggtataattgccgaactcagcctgtgagacataagaaatgttgtttagcgccgtaaatgcgctggtgctgacgtcacagaccgccaacataatcagcagcaggtcatagagtcgtgaattgccgtaacgcgggatcaacagcgccaaaatggcaatcgctgcaaagccaagcccgatcagcagctgattgcgattgatatacgaaagatgactgacctgttttagcatcagataggcaaaaatactgccgactaaaaccgctaagccaagcgcggtcggccacttgattcgaaagccaggctgcagagtgcgcgcggccagccagatgcaccaaaatgaaaacaggtaggaaaagcgatatggataccaaactgggaactgaccagcgtgccagaacagatccagtgcctcaatacaaaaagaggccagtaaaaacaaagtaatcagaccggctgtcagacgaccggcaattttttcgcgccgattgaaaaagtaaaggacggcgcccagcataatcagcatgccaacataaatatttggctgaccgcttggcatctgattgaaattaaatgatccgggcaccaatttggccagcatctttaatggattatactcaagcttccagttccatgacgtggtcgtataagtgcccttgctctgcgttaaggcataggcagtcggcagcagaacgaacgcgctgatggctccggcaagcagtgagctgcccagatagcgtcccagggtatagccggctgcatgccattgccattgccaagtcgttttctcactggcaatcgtccaaattccaaataaaatggtgaagatggcaaccatccaggccatatagtagttgtcgatcaaagccactgccagccacagcgtataggtccagggactgcggccggacaataatttgcgctcaccataaatgatcagcggcagcagaaacaagacgtccagccagagcagattgaactggttggccaccatccagcccattaaggcgtagggggtcgaaaaaatccaaatgcgtggcccctgctgaatcttttcacggtcaagcacccaggccatcgccaaaccagccagtccgtatttaagcagcgttagaatggcaatgccgctggccagatgctgtgcggggaaaaagagcaatagcagatttaacgggctccaaaggtagtaggcgttggtaccccacatctcaccgcccagccctttgctaaatgaataaagcaggctgctgggatgatgcagaagcgatgagcgcagataggcaaaaaagtcgacatactgctgaccaagatctacagtcaagacagtactgctgccaaatggtgccatgccgcgataaacaaagtagccgcccataatcaagacgggcagcaaaaaactgatcagcaaaaccaaacggcgctgacgaacggtatgtgtcatatcaaaacagatccttatctttaggaatgaaaattacgtttttcattatagccataaagtgtgaaaacttcgtggtttccttgcttaaaattcgttaaatcatctcataataggtttaatcttgcaaataaaagtgtatagttaaactcttgaggacaatcttgcagttcgattcggtcgtgctgcaaaaaatttgttaaaatagacttattctgtctaaggagattattaaaattgaagttcttaaatcgctttaagggcatcttcgatcaacgcaaaaagagcaaaaaaaccgcgcaatccgtgattccatcgcgattgaactttttgctatgggtcgtagcgctccttttactggccttggttgcccgcttgttttatctgcaggtgctgaatggatcatcttttaaggctgaggttaaaagctcggatacgaccgtgcagaccaacaatgttcagcgggggatgatctatgactcatctggcaaggttttagtcggcaatcaggtccatcaggcaattacctatactaaaggcgctgacgttaccagtgcggatctgtataagatcgccaatcgcctcggtaattacgtcaacgttggcactaagaccaagctgacgcagcgtcaggcagaagactactatctggccgacagcgataatctaaaggcgattgtcaagaagctgcacctgtccagtcaggttaccagcaatggtcaatacaacaaggcattggcctacttgaacaagcatccagaagtctacaagctgaccaagctgcagcagaataaggcgcggatctatgctgcgatgagcggcgcctactcgctgtcgacgacctatatcaagtcaaccggcgttaccgctaaggaattggctgaagtcggcgagcatctgagcgaaatgccaggggttaagattgggaaggcctggacgcgaaattatccacagggtaaagacattcaaaccttaaccgggacgctttcatctgggctgccaagtgatgagctgaactccatgcttgctcaaggatactcacgaaacgatgacgttgggcaaagctatctggaaaagctctatcaatcgactttagccggctcgaaatcgcagactgaggttatgacgactggcaataccaccaaagaaaaggttaagtatgccggcaagaagggtgacaacctggtcttgacgattaattccaagttccaaaagcaggttcaaagcattctggaaaagaactactcatcagctgggatcgcttattcaaccggggtctatgccgtcgtaatgaatccaaataccggcgagatctatgcaatggctgggattgaccgggacccaacgactggcaagcagactaccgatgagatcggggccatcaaccatccgattacaatgggatcggttgttaaaggggccatgatcatgggtggctttatgagcggtgtcatcacgccaagcaacaataccttgaccgatatgccgatcaagctggccgggaccagtgccaagacttcttggttcaacaagactggtagtgccaacattgccttgaatgcggccacggctttggaagtttcatccaactcgtacatgatgcagctggccatgaaagaagggggcatgaaatatgtctctggtggtgcgattgaccttgacccatcgatctttaccaagctgcgctactacttcaagatgttcggcttaggggttaagacagggattgacttgccaggcgaaagctcgggctatgagggtccttccaaacagtccaacatcggttcggcacttgacctttcgtatggtaactacgatggctatacaacgattcagctggctcagtacatgtccacgattgccaatggcggctatcggatgcggccgtacatcgttaagcaggtgcggggaaccaacaaggatggttcgctgggagccattgaatatactactaagccggaagtcttgggaaccatcccagccactgctgccgaatggaagatcgtcaaagaaggtctctatgatgtggttcacggctcaagtacctacattactggtaagaagctggctagcgatacgccatcgatctcgggtaagactggtacggccgaaacgttctacaagaacaacagcacggttacgctcagctttgccggctatgcaccatctgataatccacaggtcgtagttgccctggctattccaggcgcaagcaactctgatggcggggccaacctgacgatggcttcgcagatctttaaggccttttggaaagatgttaagagctcgaaagattatcaatagagctgtaaataatagctgtcaagggaatttccttaacaatcttggacaaaactctggtcaaagcagcgaattgatgatatagttgtacgagttagggttacgaataaccaattaaatctgaaaaaagtttggaggttgccaccaatgcgtgtaaacattactcttgaatgtacttcatgccacgaacggacttacttgaccagcaagaaccgtcgtaacaacccggaccgtcttgaactgaacaagtactgcccacgggaacgcaaggttacgctgcaccgcgaaaccaagtaattcaaagctaaccaagactcagctgctgactggcagttgagtcttttttcttttcaaaaagaagcatgtctggctgctgatgcatcttcttagcttgatgatgacctctgattatgatgctgatctgaaacgcttggttgttgaagaaggcgtttggcagatcaatcgttggcatagctggcctttaagctgaagactgcttttatggattgggggaagcaatttggtattttggtgcaaattatgcgaacggttgcaatttttgcgcaaaaacgcttgcataaattgccattagcggtgataattactttttgtaaacgtctgtcaatacgttttacggagggagagagaaaattgacacattcaaaaaaggaaatgcgcaaggcgtatcttgcccggctgcagcagctggatcaaaatacgcggctgcgcgaacagcatcgcctagcgcaaaagctttatgatctgccgcagtggaccaatgccaagacggttgcactgactatgagccagtcgtttgagctggacacggcaccgctgattctgcatgccaggcatgagggaaaaagagtgctggttccgcgcacgttgccgaaaagacaaatggagtttgttcaaattgatgaggataccgaatttgaagaaactggatttggcgtcttggaaccattggcagggaaggtcttgcaaccacaggagatcgatctgatcgttgtaccaggagtggcctttactgctgatggcaagcggctgggctttggcggcggctattacgaccgttacttggcaaactatttaggccagacggtttctttggccttgactacacagttggctgatgcagttgagtggccggttgaggaccatgacgttatgattggtcaggtcgttaatctagagcaggaataaacatgaaagaagcatggcaaaaagcaccgcttaccagtctgatcattttgattcaagtcattgtattcatcttgatgacattggcgggcggctcgactaattcccaagtgttgattgaatttggcgcgcgctatacgccgctgatcaaggcaggagaatggtggcgcttgattacgccaggattcgtgcacattggactcacgcatctggtagttaacagcgtaacgctttattttatcggcatgtatattgaaaatctgtttgggcactggcggtttttggcgatttatctagtaagtacgctgatgggtaatctggccagtgcggtctttttgccacagtcaatttctgctggtgccagcactggtatttttggcctgtttggcgcctttttgatgctgggactggccttttgggatgagccggcaattcattcgctggcccatcagtttttaattttggtgctgcttaacctgggaaccgacatcttggtaccgggaatcgatctggccggtcatctaggcggccttttaggtggcttctttatggcggctgtggttggcgcaccgcgtttgggcaggatggacttgctaaaacgctttctaagtggcactatattgattgtaacgattacagtttttttggaaatgggattgctaaaatgaaaccaattcgtgagattcgcacgctatatgatgttcaacagcttttaaaacgtttcaacgtcttcgtctacgttggcaaaaggctttgggatattgagctgatggctatcgaagttgacaatctttatcaagcaggtgtcttggacaaggatttgtacatgcaggctaaactggttttaagaaaagagcatcgcattgaagaagaactgaatcaaaaaaacaaatcgccttattgaggcaagggatttattgaggttaaaggagaaattagagcatgaacaagaagttaatcggtgttgaccttggtgggactacgatcaagtttgctattttgacggatcaaggcgaaatccaacaaaagtggtcgctgcggactaacattttggatgaaggttctcacatcgttcccgatattattgaatccatcaaccatcacattgatctgtacaagatggaccgcagccagtttatcgggatcggcatggggacgccaggaacggttaaccgcgaagaaggaacggtcattggcgcctacaacctgaactggaagacgctgcagccagtcaaggaacaaatcgaaaaaggtactggcctgaagtttgctctggacaacgatgccaactgtgccggcctgggcgaacgttggaagggtgctggccatgagggtgacgatgtggtattcattacgctgggaactggcgtcggcggtgggatcatcgctaacggcaagctggttcatggtgtcaatggtgctggtggtgaagttggccacattatcgttgaaccaaacggctatgaatgtacctgcggcaaccacggctgtctggaacaatacgcttcggctaccgggatcgttcacctggctcaggatgctgctgaagaatatgaaggcaacagccgtttgaaggccatgatcgacaatggcgacgagattacggccaagatcgtctttgacctggctaaggaaaacgactttttggcaaacgaagtcgttaagaaggttacgtactacctggggctggcatgtgccaacatcagcaacacgctgaaccctgaaacggtggtgatcggcggtggggtttccgcagctggtgaattcctgcttaagcgcgttcagcaaaacttccaaaagttcgccttcccaacggtacggacttccacgcagcttaaactggctcagctgggcaacgatgccggcgtgatcggggctgcttcattggcgcttgactttatcgctgatgaaaaataaactatttatttgaaagctattaaaaggcaaggaagcacgtttaatacgtgatgaattgcctttcttaaattaaaacaagcatgtttggaggaaattgttgtggtactgggaatgagttcgggatggttgatttttgacatcatcgtattggcaattttgattggctggggagtaagtgctgggatcagtgcttatcggcgcaagcattatgccacggtgctggatgaagatgccttccgtgagggcatgcgtaaggcgcaggtgattgatctgcggcaaaaggatgcttttgataaagggcatattttgggcgcccgcagtcttccatacatctatctcaagcagcagtatggcgaactgcggccagatctgccggtttatctttatgatgacggcatgcagctgagtacgcaggccgtgactttcttggccaaaaaaggctaccgcaagctctacatcttaaagggcggctatgcagaatggcacggcaagacgaagaaagccaaatacgctgactagataaaaaaggctgttgcaagcttgcaacagccttttttataatcttaagaggattacagctggtgagaagagcgtcccttgcgagtagcagcgcgacggttctcatcaaaacgattttcttcttcttcgatgggcttaacgaccgtcttgtggaaagctgctacgctgcctgctacggcaccgagcgtcgttaaggttcccaggataaaaccacgtgtaaattttttcaaaagagtagccccctttatgtcatttggctttattatgaccgatttttgattgatttaccagtaatttaagacaaggaagtgttaaatttgactaaagcaattgcgatcgttggtcctactgcagtcggcaagaccgcgctgtcgattcaattagctcatcatttaaacggcgaggtgatttcaggcgattcgatgcagatctatcgccatttggatatcggcacggccaagattacgccagcggaaatggagggcgtaccgcatcatttgatcaatattcgcgacctcaaccaaagattctcggctgctgagtttcaaaaactggccaacgaacagattgaacagattgaacataaagggcatttgccgatgatcgttggcggaaccggattttacctgcagacgctgacggaaaatctggcattgggcgcggatcattttgatgaagaatcacaaagaatccgtgactactggcataaaattgcagagcagaatggttctgaatacgtttggcagcagctgcagcagaaagatcctcaggcggctgctcagattccaacgggtaatttgcgacgcatcattcgagctttagaggtcattgaaaaaaccggtcatcttttttcgcagcagactcagactaaaacggcaaatgattttttgctgatcggcttgacgacagaacgttcggttttatatgaacgaatcaatcagcgggtcgacttgatgattaaaaatggtctgatagatgaggcacgctggctgtatgaacagggcggcgaaaactatcagtctggcaagggaatcggctatcgtgagctgttttcgtactttaagggtgagacaacgcttgacgatgcggtagctaaaattaagcaggattcccgtcactatgccaaacgccaactgacttggtttagaaataagatgaacgttcaatggtatgatctggttagcggtcggaatacgactaatgaaattgaagccgtcgttaaaaactggttaaaaaattaaagttaaacgttagtcaaactaattaatcaacgcgatcgactgtgaaagccctatcaaaaattgacttattcccttccaattggtaggctattaaagtaatcagagggaaggctgaacataagcattagcaatgaccaatcccttaattggtctagccatctgaaactagttgtgaagtagcaatcgtggaaggaatggaataaaatggcaaaacacgtattcactaaagaagaagttcatgaattggttgaaaaggaaaacgttcattttctgcgggtaatgttctcagatctgtttggtacgactaagagcgtggacctgcctgtcagccaattagacaagctgatgaacaacaagatgatgtttgatggctcttcaattgacggctttgtccgcatcaatgaaagtgacatgtacctctaccctgacatgtcaacttggctggtctttccttggggtgaggaacacggcaaggtagcccgcgtgatctgcagcgtgcacatgactgatggtacgccatttgctggtgacccacgcaacaacttgatccgcgttttagacgacatgaaaaaggcaggctttacttcattcaacattggtccggagccagaattcttcttgttcaagactgatgaaaagggcaatccaacgactgaagtaaacgacaacgaaaactactttgacatggagcctgccgatgctggtgaaaactgccgtcgcgacatcgttttggcactggaaaagatgggctttgacgttgaggctgcgcaccatgaagttgctcctggccaacatgaagtcgactttaagtacgctaatgctctggaagctgccgacaacattcaaacgttcaagtttgttgttaagtcagttgctaaaaagcatggtctgcacgctacgtttatgccaaagccattgtccggcatcaacggctctgggatgcacaccaatatgtcactgtttgacaaggacggcaacaacgccttctacgatgaaaaaggcgaactgcaattgtctgacacggcctaccacttcctggctggtatcttgaagcacgcgcgcgcgctgacggcaatctgcaacccaaccgttaactcttacaagcgtctggtaccaggctatgaagcaccggtttacgttgcatggtctgcatctaaccgttcaccattgattcgaattccagacgaccgtaagatgggaacgcgggttgaaatgcgttccgttgactgcacggctaacccatacctggcaattgctgctattttggaagccggtctggacggtctgcgcaacaacctgacgccaatgaaggaagttacggaaaacatctacatgatgacgccagaagaacgtgaagccaagggcattgaggatctgccatccaacctgcacaacgctttgaagagcctgcgtgctgatgaagtcgttcgtgaatcgatgggcgaacacctctacaagaacttctttgaagccaagacgcgtgaatacgacggttaccgtcaacacgtttctgactgggaacgtgacaagtacatgctccaatactaatttgtgttttgccaaaaaggcctgccaagctgcaggtctttttattttagcgatgaaaaaaacgcagcgttgcaagtgacgctgcgttttttaaatcagaatcgtgacaaaaactattcactgagctttttggcatctgcatccagcttagcgaagcctgaaccactaggctttttgttgccacgcttttccatagccttgcgggccatttcttttcgttcttgcttactcaacttacgtgccataatagtttcgcctcttttcttgacattcaagtagtccacatatgtgtaatactcgaacaactatattatagtcattctggataaatttgcaaccgttatcgtcaatggtaaagattttgcaactacctggattaatcgctttaaaagttatcaaaaatccgctaagattaaatcagtattaaattaaggagttaaagctatggcaaatgttgaacagacaaatggtgcgcttgatgtaagccaagcaatcaataaacaaattgctactaagatcaagtatctgcaagaattggaaaccgcggtcgatcatcatgatgactgcaaggtatatcaattgctggacaatcaacgctatgctgctgaaattgagcatcgcgagcagcagccgaatgaacagggcgtaatgaacctggtcgatgatctggctgatcagttgagcaattttttgagtgccaacctgattcaatatttgggcaaggcctatccattcttttactacgaggaataccagactggtcactaccgcatctattttgggaattggtgggatcggcggcggtttggcgaattagacgtgctgaatatccgctttgcctttgatcaggaagaataccaaaagctggcgcgcgcgtttgagctgagcaagcaaaacaagcgctataacagcgatcgcatcgaacagatctccagtgaaaacgatcgtctgcaaaaactgatcgataatcgtcaagaacgtgagcaaaagcgggccgaactgcagagtcagcttaaggatgccagtgcgcacagcggtttgtttgaatccaataaaaaccgtgaagcacggcaggtaatcgttgaacagatcagcaagttggaagatgaagaacaagaatcgcgaactgctgctgatacgatcaaagaaaatgagcgcgtagtcctggatctgtccaaggaaaacacaatcttgagctacgaacaaaagagtattgttgatacgtttggcacgtttgaggactttgaactggccaatcggaatctgtatgccagctatcttaagagcctaggcggcaagcaagcgggggtgagcgcagatgagcaataatcaaatgatctcaacggcggccgatcgcgttcgctcgctcagtgattcgatcgcccaaggcctggaagttggtcagcgctatgtggctctgcttaatcagctgacttcgactaaggatccgaaagaactgcttgcggcaacggaaaaattggaagggctcagcctggaaaatgcatttgtcaagttcccacagcactatcagctggccgactactatctgcttttaatggcgcggatgctggaattaaacaatgagtctggcttgacaatcgaagaaaatgatattcaccatcagctgttggccaagatttcgccaatggaagatcaagagcgatttacttttgagattgatccgcgtaatggcggggccttctttgccgagcagcatcatcatgagccactgttttatctgaatttgaagcaccagattctgaagttcagcaatcgggcactggttgactttttcatcgtgcgtcagacgcagaaatttagtgatctggatctgcaagccgtggtgcagccaatgatcaagtttgctctgctgctggaaaaacagctggacttcgtgattgacctgggcatcttagaaactggcaatggcgcacggttccgtctgcaaaaaccagatctgccgctgacgattatcgatcgcttgtttgtcaagaccacggataccgactatatgctgctgagcctgccgcaaaacaatggtgccgaattgcggctggatcaaaacgtccgtctgcaattggcttttgatccggatgactacagccaggaatggagctttcgggtattagacagcgaggagcgcgtttcattttttgatgtcttgctgcactatccgctggttcgcgaatggtatcttgacaaccgtgaatttttagcagtccggaccgatgcaatgatttttgctgctgatgagccggaaaatctgacgatgacgacgcctgatcagccagccagtcaaatcgaacagccgactgctgatttggttgaaacaaaagaagcagaagaaaaggaagattagtttgttagatattactaagttgctgcacgaatcaattgaatttgactggcagctggatgaggatcatgatattcaacttggcgccgaagctcgcgtacaaaacgtttttactgccttggacgttgagctggcagagattgccaatgccgcggaatggttcaaagtgtggaaggaacatcaaggaaagcagcttcccggccggacgcatcatcagacggtattagaagaatacgttgacgcgctgaatttctttttgctgtttagtgccaaaaagcagtggacgcatctgatcgtgttggatgagcaaatgctgacccggatcaaaaatggcaaaccggctgaaaaggtaccagattggaacaaggaatatctggcaattaaaaacttcttatatggcagctacttcaatcatcggcaagaagatttccgccatgcctggcatctgttcttaaaactggggctggttgattttggctttactgaagatgaaatcatggcagcctatgaagaaaagctgaagatcaatattcagcgtcaagaagacaactattaagtcaatcaagctcgctaaagccgtacgtcacgcttttgcgagcttttttcagagccgcaaaaggaaggcagcattgattatgatgctttaagaaccggtttttcagtgaccagctgtttcttcagataataaaaacgacattcgccatttgacggatgccgtttttgttgataaggaaaggcgatgcttcttgccgttaagctatgggacttagcggtggggattttattgccaaaagatttgaccaactacagataaagaaagaatcaacgaaatgataaagagtggcaacattttgtgatcccgtcaaaagcattgtctatatgtttcattattgttacttttattaaaaaatgcaatggttttgtaatataaaattatatcttaataaaatcttaaatattatactaaataacacagccattgatatgattgaaagaaggttacaatggattttaatcgtacactttttactgtgtagactacaaaaaagagcgtaaaagcttcaccgttcgaaaccatatcagcaatcgcatcaaccatcgccgtgattatcgcattgctagattggctaggagttaagccttaacactctggaaataagggagagggaaaaccagttctcacttgttttcgtatataataacaaacggaggagaaacatggaagattccactaaaattaaattaggcctgttattttcagttcttgctattataatatcaatctataatgtgctaaggtgatttcaaatgaacataaacttaaatgataaaaacattatgacagcagtagaggcttcaaaaatttggggtttaagtggcagttacgttaaaaccagcctccgtcaaagtaagcaaaaatggccagagggttcttatcgaaaatttggtcatactttagtagtaacaactgctggcatggaagcagttactgggattaaagatccgcgtaaaaaataaaacgactgtcatgtgacggtcgttttttagtacattgggacattattgggacgcctatatgatcataaatgcctttatatcaacgtttttgacaattcttatatggggcaagtgggaatcgaacccacaacctttggtttagaagaccaatgctctatccagttgagctattgccccagacctaattaagtatattatattccacgaaaatgtcaataatacagttgattagaccattgcaaaaccttttatgttaatggaagtctaatttattgacaaagcgcttacatcgttttaatctaacggtagaacaagtttgtagaccagctacatgttttaacctaaagagcgttttttagattggaggcgtagtgtcaatgacgggcagcaaggttgatcctcgtgtagttaagacccgcagtagtctccgcaaggcacttgtatatctgatgaagcatgagaaacttgaaaacatcagcgtccaaaagattactgaaacggcaaatattactcgaggtacgttttatctgcattacaaagacaagcgtgattttatcaagtcagcaatgaatgagatcctggatgatctgtttgcacaaattatggttgagcgccagatctcaacgtctggcaactcagttcaggtgctgtctttaaatgaagcctttcaatgcatcgaaaacagtgcagaagtctttgatgtcttattgaataatgaacgcaatgatttcttctatgcacagctctacgatcgcctttgccaggaattaacgaaatatgccaaacagttggatagtgaatttgacgatttcgatgttccagtcaaaatgcaggtttcatttttggcatccgccgtgctgggcgtaatcaaaagctggctgcaggatggcatgatctatacgccacgctatatgacgcaaagcatgatgaagatgctgcagcagttcagcggtgagggaatgcttttaacctcgttttttgatggtaaggtcaagtcagccttagaaatctagtaaaaaatcaccgagctttttggacttggtgatttttattttgttgtggcttgatttttattgacgcaatcaaaatgttttgatatgatattagcgttgtatttgtgaaccaacaactacaaccgcacgcaaccgagttttaaaagcttcggctgctcggccggcgagtcttagaaattaaggaggtgcacaaactgatgtacgcaattatcgttactggcggcaagcaatacaaggtagaagcaggtcaagctatctacgttgaaaagctggacgcaaaagaaggcgaaaaggtaacttttgacaaggttatctttgtaggcggcgacgacgttaaggtcggcacgccatttgttgacggtgctactgttgaaggtactgtcgacaagcaaggcaaggaaaagaaggttgttaccttcaagtacaagccaaagaagcacacccacaccaagaagggtcaccgtcaaccatacactaaggttacgattgacacgatcaacgcttaatggggtgattcaatgattcgcgcggtttttcataccaatcaggatcatggaatagcttcgtttgagatgactgggcatgccgatcatggcgattatggacaagacattgtctgtgctgcggtttctgctttggcaatcgcaacggtcaatggcttggaaagagtcgtcaagcagcctgctacgattacggcagatcatgcgaatggcggtttgcttaaggtcagctcaattgatccgggacacgattcccagattttaatgcagacattcttggaagccatgcttgacattcaagaacagtatgctgaaaatattgacataaaaatgtcttaaaaacaaatttcaagctggaggtgaaaactatgattatggatcttcaattcttctcccaccacaaagggggcggttcgactgccaacggtcgtaactctgctggtcgtcgtctgggaactaaggctgctgacggttctgtcgtaacggccggttctatcatctaccgtcaacgtggtacccacattcacccaggtgaaaacgtaggtcgcggtggtgacgacactttgtttgctaagatcgacggcgttgttaagtttgaacgcatgggtcgcagcaaccgtaaagtttcggtttacccagttgccgaataataaaattaagctcaaagcatttgatagttttatcagctgccttgagcttttttatttggttggcgctgtcaaagcaattcagatgaggaataataaaatgaatcatttatttgaaaacggaaagccgcaatcaattccggtcgtcttggcaaaccgtgatcgacgcgtggccctgcagaatcagctgacggcaaaacatccggagcagactctgattgctgctaagctgaatattcctggaccaatcaagaacaatcaaacgattagagacttttttgcggctggtttggcagtttttgaaaaacagctggccgctaaatttcagtttaggatggctgagcaatggctaggggagtcgacggggccagaacgtttctatctggttgatggcccagctgcgcaggtcaaacaattgacaacagaatttgaagaggctcaggctgctcatcggctatttgatcttgatgttttgagtcgtcaaaacaatcagaccgtttcgatatcgcgaactgaactgggactgcctaagcgccaatgcctgatctgtggccagccagccaaggaatgtgctcgctcgcgacgacattcggttgctgagctgcaggatcgcgtggcagcattgatcgaaaattattgatgcaataataaaagctccaacttttgagaaatctcaagttggagcttttgctgatttttagtagttgaacagatcagtggacaggtagcggtcgccgccatcaggagataccgttacgaccttcttgcctttgcccagctgcttagctaattcaattgcgccataaatgttggcaccggctgagatacctggcaagaagccttccagacgaccgactgcttgaccggtcttaatagcatcatcgctggaaacttcaataatgccgtcgtagacttcttgatccagcgtcttaggaatgaaaccggcactgataccttggatcttgtgcttgccagccttgccttctttaagcagtggtgactcagcaggctccaaagcgtagaccttaacgtttggatcgacttttttcaaggcgtggccgataccgctcagcgtgccgccagtaccaaccccggcaacaaaagcgtcaggcagatcgtccttgccaaaagcatcaatgatttcttggccagtcgtcgcttcgtgaattgctgggttggctgggttttcaaactgcattggcataaagtagcctttggtgtcaaccagttcttgggctttggcaattgagcccttcattccatcggcaccaggcgtcagaatcagttccgcgccatagccctgcatcagcttacgacgctcaacgctcatcgtttctggcatgacgataatcaggtggtagcccttggcagctgctacgctggccagtccaatcccagtgttgcctgaagttggttcgatgatcgtgtcgccaggtttgagcttgccttctgcttcggctttttcaatcattgacagcgcgatccgatctttgatggagccagcaggattgaagaattccagctttacgtagacgtcggcggcatcttcaggaacaatacggttaagctttaaaagaggcgtgttgccgatcagctggtcgattgaagtgtagatttttgacataattttttctcctttaggcaatggttagtgcgttttgtgaatattcagctgttttttgcagccagttcttaaaatacagctgctggaccttttcccacttgaattggggatcagtcagcgtattaatgtctttaaaataattcttaggcaatgcgtagtgacgatcaggatgggcagctgtttcccgttggtattcggctaatagtgccagacgatcgtattcaaggtgggcaaataaaaagtcttgattgtcgctgccggttagcgaaagcaggtagtcatcactagacacggcgttgatcgtcagtccaggcgtttggcgaatctggtcatggtccagctcggcatagcgtgcatgcggtgccgggaagggaatggtcaggccatttaaaacgggggtttcaaccaaaacctcattgtcaaagacgccgaagtattttttggtcaattgccgtttttcaatgccatacagatagttggcggcagccatggcaccccagcagatgtagagctgcgggatgtttaggtcgaccagcgtatcaatcaggcgcgtgacctcatcatgatattcgacctgtgcaaatggaatctgctcaatcggggcacccgtaatgatgaatccttgcagctgacttactttgttaaggtccagcggttcagagatttgttgaaccagttttgggaccggccgattgcggtagtggtcaacgggatagaaaaaagtaagttcaaccgtgggatcaagggccttaaagattgatgaaaaacgctgctgagtggcagccttgtcatgcatcaagtttaagataccgattttaagacgcggattagtcatcaggtgctcctttcctaacgattgcgatagttaaacaatcagactttcaccggtgagtttgtcataatttaaagtgcgatggatacaaaaagccccacaaactattgctagtctgcggggctttgcaatcgactgggctgtcgatcgggctgtttatactaatgcaaaacaagccttttccgcagaaagaaaaaggcagcaacaagtcatgttcatagcaaagttagacttaatcatgatgcacctctcctttctggttatttatcaacgcatctttaaacatgcccttattttacatgacatcttacaaaatgcaagtagattatcaaaaaattattaaaaaacggtgattaaccgcgccagcccgcgatatcgtgcggggtaaagcgatagtcaagttttttctgataggccttctcataagcagcctttttttgagcatagtctttttccatcatcaacttggcgttttcgttgaccgaaagctggggatctggccaaatcagtggcagaacgtgcagccgatagcgggtctgataaaaatcgtcgttatttttttcggctttgggcaggtcgatgatttccgtaaaacaagatatgatcggcgcgttggccctggcagcgtagtagtaggcaccacgcttgacgggacgaggcttgcggtagttgaaccacatctcttgttctggatagatcagaacccagtgcccatgcctagtctgctgcgcgattttttgcggcagcgtgcggccaagatagttgacgtttttagccagcggtaagacatcgagatgattcatcaaaaaaccgatcaagccgcccattttaagattggtttcttgaatgacgataaacaggcgacgatgatttttttgggccagcttgcggatgacggtattatccagctgattaaagtgattgctggtaattactgcgccttgagttggcgaaagcggcttaagattttctagtccacaaaacgtggtatcgtgattgaaccagtctgtgattccacgcattgtggttctggcaatcaagttgtcaaagcgagcgcgccaatgagtctgatcctgccaaaattgattaatgatatctagactttctgctgaggtcatctgcgggtcgtcaatttcgactttttcgttaaagaggccctgctgcgcgtgatcggcaatattgttgatcacttgatcgcgatggtcgccaataatcatgaaagccgcacctgctctccttggtcctgcagcttcttaaacgtaactggattttccggcagctcgtcagcgtgattgagcatgctcatcaatttttcccggtcaagctgctgcatggcttgtgtatagttggcccgcactgttttgagctgctgggcgtaaggcgttttttgagcggcttgccagaagtactgatcatacatcacttgatcaaaatgccatggcttgaaaaagaggttgtagtgaatcagcttgggatcggcaacgcgttccgctgcaaattcatcatctttaggcatggcattccatttttcgttcaggtaggtaatgcggccgctgcacatgacgtttagataatcttggtcgggagcgatgcagtcgacatgatatttttgcagcagatacaagaagtgctgagtaaaatcgtcttgacgcagctgtttaaaattcatcagtaaaacgccagagttgatgtattcagctgccggtacgccgactgcatttttgatgtaggtctgcattggagcaacgtgttctacggaatggtcgggggctgccccgatcagatcgtcattgagtgcgatggcaaacatttctgccgggtcgccgttccagaccgtatcgctgtcgacatagattgccttatcgtattgcgggaaaagatccgctaaaaacagtcgataaaagatgctgggcgtgaagaaatcggcccgcaaaaagttttctttacgattttgaatggctcccagcttggcatcattgatttcataaaaaataatttcaacgttatcgcgcgtcagacttttaagattttgccgcgtagcctgccgcaagccctgatgaacgataatgatctgatattggtgatctgatgagacgtaaggcaggagtgattcaatcgctacggcggcatagggtgcaaagtcatcgctgatcgtatagaaaattggaattgtttgagacatgttgaccttccttatagttcagatttaagctgccgatattcttccaacagaccatcatattcatgcagtcgcaaatctttatggacgttgctgatctgccatggcttaacggtcagaatgtggaaccacgggaagaaacggaaactggtggtaaagtgctgaaaaacggtgtcgtgatgaagacgtcgttgatcattgaaccgccgcggcgcgatttttttggcgtgcgaaagacggttgatcgcggcttgatccggcatgaacatgtggcgcgtggcaatcatgcggcgtgccttgacgaatagattggttgccttgatctctggcagattcaaaagcagaatccctgaattgatatagtcggccatgcgcatttgatggtggaagaaccatttgccatagtgatccagtacgccgacgacctgcacgccagtcagatcttgatagtaaaaatcgtcaaaaggctcgcgacagataacgtcattgtctagataaagcaggcgatctggcatgtcgggaatcaagtcgacataaaggcgcagcatggaatagggcgtaaagcgggaattcatgttggctgacggctgcgattcattgaataattcagtgcagtcgatcagatgcagcgtattttgtggattataggactgaagctgctgggtcaaaagatcggcggctttttggctgaacggttcgtattcgcgggtttcagtagccgttttcatggtaagaacatagatgtttaacggctctttgacatggtgaagcagagaaagcgcaacgatcaagacgccatcttcagcgcggtgatcgccacaaaataaaatattcacggtttcatcttctttcttgaacgtatttgatggattcatagctgctgcagcgggcgcgctggttcattgcggcttggatctgatcgtgcagccagacctgctgttttttggccgattggtttttagcagggatgaacggtccatcaataaaaacggttagacgtggctttttcccaaaacgcggcttttgataggtcgtcgtcatgcaaaatgccgggctttgcgttttaactggaaagcgaaaactggtgtcgggaaaagggcggatttcagtataggcaggccagacgtgagcttcaggatagatgaagacatgtccctgatgctgaacgactttttggatggcttttaaaagctgtgcagtttggtgaagcgaattgccaaccggcagcgcgccaccaaaagaaagcagtgggccgatcacgggaatcccccagttggctggagctgccagcgcgtagaaatgccgggcctgaccgactaaaaacggcatgaatacgtcgttgatcggctgcgtatgattgccatagacaaagtatccctgtttttggtagggtctcatcttttccaggccgatgattcgagtttgtcgatagccataagtatatagataggcaaacgctttggcactgctgcgcaccatcaaagaccagcagcgttcagccggcttagtgcgcagccagcaaaaatcatcaggcagctgaaagtcttgatgtgcgctttgaactacgtcatcagttggttcggtataataaatggtttttaccaaacttttcaccttctaaaattgtagcagttaatttaaaattaacagaaattaatctagaagttattatactcaaaaaacattgcaagtaaatacttgcaatgtagtaaaattaagcaggaaaggagatgggccaatgaaaagcaagtcagccaccgatgaaaaaatcatgcaggcgtttgctcaattggttgaacagcagggctacagcgcaacgacaaccgtacagctggcccagaccgctggcgttaatgaaagtacgatctttcgtcattttggcgataagcttggcttggcaaccgggttgatcgtcagatatcgcaagagtttgatggatatcatagctgattttaagccggtttgggatctggaaaccgatctgattgatttttccagatgttttcgaaagcagtggcctaagcagcatgtgatggtaatgctgatgagcacggtcaaggacccagcgcaaaagcagaagctgcatgctgcgactcatcagattaaaaatggcattcaagaacagatcacgcaatatttagaacagatgcaaaaacgcggtcggattcgggaggacgtgaatccagagcagattgcactaaattttatttggctcaacatcggccagttttggaccagccgcttttgggaaaacgagcagcaccagctatcagatgagcgcttttatgaactgtcgatacgtccattcgttcatctcttgacgacttaatggcttaaaataatgattgataaagatgaaaaagaagggttgttgaatatggcttcacgaattgaacggctgcggaaaaagtttgatgcttcatatattgacgcgtttatggttaccaatgaggcaaatattttctatcttaccggctttgacttgatgcagggggatggcgagcttttgattaccaaggatgccgccattttgattaccgatgatcgctatgctactgagctgcaggaatttgacagcgatgaggtcgtggctacgatcacgcgggactactggggggctttaaatcagatctgtcagggcatgcagattgaggtcattgggtttgaaaatacgattgactaccgaatctatgatgtcttagatgaaatcatggccgctgacatcgtaccttttgatgggctgattgagtcgatgcgggcaatcaaggaccccgatgagattgaaaagatccgcttggctgctcggctgcagtcagctggctatgaatacgtcttgagttttattaaaccaggaatgaccgaaagacaggttgccaaccggcttgatttttggatgaaggagcatggtgtcgagtccgcctcgtttccgaccatctgtgccagtggtgccaacgctgccatgccgcacgcaacagccggcgataaggaaattgaagaaggcgatatcgttacgctggactttggctactttgttgaaggctatacggcagacatgacgcggacgtttggaattggcgatattgatccagagctaaaggacgtctataaaatcgtcaatgaagctcgccaggctgtgattgaagctgccagggtcggaatccacggtgatcagttggatgctgccggccgccagatcattgaaactgctggctatggcgatgagttcaatcatggcatgggtcacggcattggcttgagcgttcatgaactgccaagcagctatggtcccaatgccagcgatgtgatcgtacaaaacaaccaggtcattaccgtggagccggggatctatattccagaaatcggcggggtgcgcattgaagacgatattttggtcacgcatggcggagttgaagtgctgacgacggcaccaaccgagctggaaatcgttaaatattaagatgaaaaaagagctagacagtttatataagtcaattgatcaaaaaggcaaagcagccatcttaaaaaatcagtttactgatccttatctatgtcaagataaggcagattcgcgacgtggcttgacgctgcttgctcggctgccggttcatgtcggcagaaacatcggctatgctcagcagaaactgcgaatcgccaatcccaatctctactgttatccattggccgatctgcatctgaccgttttggatctgatcggagcacgggctgatttttcgctggcaccggctgttttggcggcctatcaaaacagcatcaaagaactgctggcgaattgccgcccgttttcagtcacgctgcaaggcttgattgccagtcccagcggtattttggcagcaggatattattctgatgagctgtttgagctgcgagaggcgctgcgcttaaagctggctaaagaattaccgcttgctgagcgttatcagacagcatccggtcatgtcacgattgcccgttttaaagcgccgctgaacgattctaacgggctgctttttgacttggccaagatggatcaactgcgatttggcagctttgtcgtcaagcaggtagacttggtaattcacgattggtacaatcatgatgtaaaagtaattgacgaatttgcactgaccgcgctaagctagcatggttgccaattttggcggaatagtgcataattaaaaggatgtcttaatgacgaaaaaactggagggctgacaaatggcagaagattccaacattatcttaaacagcgaagatcaatcgttgggtacgattcaaatcgctccacgtgtcttagaaatcattgcagggattgccgctggtcaaattgagggcgtttcacgcatgcatggctcgattgccaacagcgtcagtgaattactggggcgttctgaccatcgtcgcggcgttaagctttccaacagtgatgacgaactgtcgattgacgtcgacgtttacttggaatatggcgtttccgttcctaaggttgctgctgagattcaagataaaatcaagcagcaggttacgctgatgactgatctgagcgttaaggaagtcaacgttcatgtacagggcgtaattacggaaaaagaagagcaacaggttgaccccaatgatatttttggggaacacgaaaacaaagatggtgaagaatagtggaaattagtcgtcatgcgatccgtgaatgcgcctttcaaacgctttttgcattggcttcggatccggaaatcgatcgcgaggcaatctacgcagaacgcttggggctcaagccggatgaagaggtgccggcctacttgccagagctggtcaatggcgtcttggctcaccaagatgaactggacgctcagatcgaatccaagctggctccaggctggaccttatcacgcttggctcgccctgatctggtgattctgcgcctggcattgtacgagctggaatacacgcaggtaccaaatgccgtggctattaacgaagccttacgcttggcacacgacttcagcgatgaaaagtcgtaccgttttatcaatggtgttttaggcagcattgaaagcgagcaaaattaatcaaaaaactcatctccaaagcggggatgagtttttttgttgcggctttaatgctagaatataaacatatgcaatttttatgcagtctgataaggagagattttagtggcaacattgatcgacggtcgggcattggctaaagaagtcaacgcccacactaagcagcgtattgagaagctaaaggaaaaaggtgttacgccggggattgcaacgattttggttggtgatgatccagccagccagatctacacgcgcagcaaggaaaaaaaggcgcacagtctggggatgaagtcggtacgagaacaattgccggcctcaactacgcaagctgaactggtacaggcggttgagcacttaaacagtgatccatcgattcacgcaatcctggtgcaagagccgctgcctaatcatcttgatgacacggcaatcgttaatctgattgatccgctcaaagacgttgatggttttcatcccatcaatgtcggtaagctctataacaacgttcaaggcaattatccagttgcctgcacgccacggggaattatgacgatgctgcgccattaccacgttccattggccagccaggacgttgtgatcgttggccgcagcacgctggtcagtcggccgctgcaggcgctgctgatcaatgaggatgccacggtaacgattaccggacggcgcactaaggatttagctaagcgaacgcgtgaagccgatattctggtcgtagcagccggcgtgcctaatttgatcaaggccgatgccgttaagccgggagccacggtgatcgatgtcggcatcaatcggctggatgacgggacgatcgttggcgacgttgactttgaatcagtcaaagaggtcgcgggaatgattacgcccgttccaggtggggttggtccaatgacgatcgcctctttaatggaacaaacggttgatttggcagaatggagcgcggaaattaatggataaaaaggattgcctgacggttaatcaactgactcgctatatcaaacgcaaatttgattttgatccttatctgcaaaaaaatctttggatcgttggcaagctgaccaactttaagcaaagagcacgccatcagtatttttcgcttaaagatgatgacgcgcctgaagatcagcaggccgtaatcgatgccgtcatgtttggcagcgactgggaaaaagtcgacttcacaccggaaaacggcatggaggttatcttgggcggcaaggtgacggtctatgaaagaaacggccgctatcagttttatgtcaatcggatgctgccggttggtgtcagtgcagcccagctggcatttcaagaaacctataaaaaactgaaggccagtggggtattttcgcatgcgcaaaatccgcggccgctgaatcggtttcctaagcggattgcgattgtaaccagcaatgatggggccgttaagcatgatatgattacgcggattcgcaacaacaatcccttggctcaagtggttttttatccagcgcaggtacaaggcgagcgggctgctgaggatctggcccgccagatccagcgcgctggcatcaatggcacgtttgatacgctgatcgtggcgcggggcggcggctcggaagaagatctgatgccgttcaactcagaaatcgtggcgcgagcagtagcggccagcccgattcccgtaatctcaggggttggtcatgaaactgatacgaccatctgtgatctggcggctgattatcgggctcaggtaccgggactggcagcggaaatggcgacccagctgcatttgctggacattctgactgaactgcagcgggcccgtacgcagatggctaatacgattcagaaccaactgcagcaggcccagcagcagctgcaggtcctgaccagcagctatgtgttttctcagcctgctcgtctgtatgaaggcgaacagcagcatgttgatcagctgactgaaaagctgcagcagtccatgcagtggcgcctttcgcaaaccagccacgactggcagcgcttgttggattcgcttttattgaatgcgccagccaatcgattgcagcagaatcgacaacagctcacacaactgcagcaggcaatggttcatgccatggataagcagctgctgtcggcaggcgatcggttcaagaatctgctcagtcagctggattcactgagtccgctgaaagtgatggcgcgcggctacagctatgtgaccaaagaagataataaagtcgttgccagcaccagtcagctgcagcctgatgagcaagtggcgctgcattttagtgatggcacggctgaagcagtaatcaaaaaaatcaataagaggtaaaaaatggcaaaacaacctagctttgaagaacagatgagtcagctgcagcaaatcgtcaacgagctgcagcagggcaatctgtctttggaagaatcattgaatgaattcaaaaccggtatggaattggcaaacggtctgcaaaaacagctgcaaaacgctgaggccacggttgcccatctgatgaaagacgatggcaaggaagtcgaggatccaaccgacagccgcagcgatgatggctcaggacaccagggataccgttcacagtttagcggccagggatttgaagacggtcaggacgataacgttgatcttttctaatttgcgattaatgaaaggaatgagcaaatggtcagcacgataacggaacttaaaacacggatcgatgcctatctggaccaggctctgccaatggacatcgaccagccgactttaaaagaatcaatgtgctactcggttgaagcaggcggcaaacgcttacggccggcactgacattggcaacgattgagatgctgggcaaaaagatcgaccagaatgcgctgcgggctgcctgtgccttagagctgctgcatacctactcgctgattcatgatgatctgccagcaatggacaatgatgatctgcggcggggcgagccaaccaatcacgtcaagtttggcgcggggatggcgacgctggctggtgatggcttgctgacgctggcttttcaatggctgacggacaatcagctgccagttgacgttcaggcaaatctaacgctggctttggctaaggcggccggtcccagcggtatggttgctggacaggcacgcgatatcgagggcgagggtcagcatctgaagctaaccgagctgcagtatctgcatcgccaaaaaacgggagcactgctcaaatacgcggttcaggcaggcggtatcatcactgagcagccggttacagtcattgaccttttaggaacgtttggcgcgcagtttggcttagcttttcagatctatgacgacatcatggacgtggtagccacgccagcacagatgggcaaggcaactcaaaaagacgccgctgagcacaaaaacacttatccaggactgttgggacttgatggtgctaaagaacagctgcaaaaagcccttagtcaggcaaaagcggctcaacagcagctggcagaactgacaggacgatcaatggctggttttgatcaatttttggcatactttaaactataggacgagattatgattgaaaaagaacgcgttgatattttactagtcaagcagggcctgttcgattccagagaacaagccaagcgtgccgtaatggctggcgagatcctaggcaagaacaatgagcgccttgataagccagggcaaaagattcccgttacgacaacgctgcacatgaagggcaagaagatgccgtacgtcagccgaggtggtctgaaactggccaaggcactcaaggtatttgacatctcggttaaagacaaagtggtactggatattggcagctcgaccggcggctttaccgacgtgatgctgcaaaacggcgccaagctcagctatgccttagatgttggtaccaatcaactggtttggcagctgcgggacgatccgcgcgtcgtggtaatggagcagaccaacttccgctacagcaagctggctgattttacgcatggtcagccggagtttgcctcgattgacgtatcgtttatttctttgagtctgattctgccgccactggcccagattctgaaaatgggcggctcggtcgtggccttgatcaagccgcagtttgaagccggcaaggagcatgttggtaagcatggcatcgttcgtgatcgtaaggtgcatgaagaagtgctgcagcatgttctgggctttgcaaccgcagatcatttcgatgttttaggtttggatttctcgccaatcaaaggcggtcaagggaatattgaatttttggcgcacctgcaactggttgatcgagaaggccgcatcgcaccagaagttgacatcgaccagacgatcagcgcggcttatgcagaactgaacaagcaggattagttttggaggttttgtcaatgaaaaaatcagaacgtcagcgacacattcaagaaattatttccaatcaatacgtcgaacgtcaagaagatctggtcaagctgctggccaaatccggcattcgcgtcacgcaggctacgatttcacgcgacatcaaggatatgcagctgctcaaggtgccaagcgtaggcggcggctatcactacagcctgccagcccggcgtcaggacaataaagaagaacggctggcaaacgtgatggggaatgagttgcaggaaatgaaacgcagcgatcgtttcgtatccttgtcaatgcggccaggcaacggtccggtagccgccatgctgatcaatcagatgaaatatcccacggtgtttaccgcgattggcgatgacgctacggttttgatcgtctgtcactctgccggggctgccgttgaatttgaacgtacgctgcaggcactgcgctagactgggtgatcggctatgctacaggaactgacaattgataatttagcgattatcgagcatttaacgctggattttagcgatcagatgacggttttgactggtgagaccggggccggcaagtccattattatcgatgcggtgggtttattggctggcaatcgcggctcacaggagtttattcggcatggcgaagaaaagcttcatttgcagggccagttcacattaccggatgatcagcgcgtttttgcattactggatgatctgggaattgaacgtgatgatggcacgctgattatttcgcgcgagattcatcgcaatggccgcaacgtgatccgggtcaatggcgcgctgatcaatactgccacgctgcgtagaatcggtgctcatctggttgatattcaagggcaaaacgatcatcagcagctgatgcagccagaaaaccatctacacatgctcgatcagtttgcagccgaccaggttaagccgctgttgtccaaatatcaagaggcctatcggcgctatgccaaattgaaggcaacgctgagccgcaagcaggctgactcgcagcagtgggcccagcgtctggacatgctgcgctaccaggttaaagaaatcagtgctgccgatctgcacgccaatgaagaagatgagctgaccagcgagcgcgaccgcttagagcattttcaacagatcaacaatacgctgcagctggtcgtcggaatcttaaatgaaggcgaggcaccggttttggatcaggttgcccaggcaatgaatgaggttcaagaaatcgcaccgtttgactcggcctatgatgagttgagcaagtcgcttggggatgcctactattcgcttcaggatgctgccaatgccgccagtcgtcagttagacatgcttgaattcgatgacggccgtctggaacagatcaatgaacggctgaccattattggtgatttggaacgcaagtatggcgatacggttgaagacgtcttggcatattatgaaaagattcataaggaactgtcgacgatggagcagaccgccgattcagatgatgagcttaagcagcagctggccgcggtgactggtgagctgcaaaaactgggcggtgaattgagccaggttcgtcaaaaagccgctcatcagctcaatggccaggttcatcagcagctaaaagaactctatatggacaaagccatttttgaggttaagtttcatcaaaatgagtcgatgaccttttatccggatgggattgacaatgttgagttctatattcaaaccaaccctggcgaaagcatggggccattggtaaagattgcctctggcggggagctttcgcgggtcatgctggccttaaagacgatttttgcgcagcatgagggcgttacctcaattatttttgacgaggttgatacgggggtcagcggtcgcgttgctcaggccattgccgataagatcaagctgattgcccagcattcacaggttttgtgcattacgcatctgccgcaggttgccgccgttgctcagcatcattttctgattcaaaaaaccgtgcagaacaaccgtacgacgacgcacgttacgattctgcatcctgaagaacgaattaatgaattggctcggatgatctcaggtgaagaaattaccaagctgagtcgcgagcatgctaaagaattattgcagatggcgcattcataatccatgctaggttttgcatttgcgggtacgtcacgttaagctgctaggtgctttacatccgtgaacgtgcagaagttggattgaaatatatggatgcgattatccagctgctgccactaagattacggaattttcggttaaggatacaaatcagcttggtgaaaagtaaaaatgggactccttgtcaaacgactggggtcccattttttattggcttgctatccaatcagtgtaaaactgcttaaaatcaagctttgatcattgaattaacttgttggtcaaagaagcaaatgatgaatatcgaaatcgaattacgatcatcgagtcagtcagcggatagtcgcaaaagccgcaatcgaatatgttgttgaaatcgggttggttattagatttgggcagtatcgatcattaagcagagatgtttgagtacatcgcaatgtttatggggcaaatgatttgattttcagctgaccgttggcggtgaaccagaagaaagcggtggctattataggcggaaaatggtaatcacgtgctatccgttcttgctgaatgattcttagaatattggtgaactaaacgataaaagatcaagtgttatcggaaaagttaggaatcaactgattaaaattcagcggtatctatttgcctcgatatattatatacgatataatattataaaataaaactgaaagaggcgaaacgagagatgaaaattcaagtttcagctgatcttttggatggcttggtgctggcgctgcttgaacgcaaagattactacggctacgcgctgactcaagacatgcaaaaagcgattacgatttcagaatccactctttatccggtattgcgccggctaaaaagagatcagttcgttgaaacgtatgatcagccatatcatggacgcaatcgccgctattatcgcattacgtctgctggtgaatcacatctggcacgcgttaagcaggtatggaaagactataaggaaagcctcgattcgatttttgaggccagcaaatatcctgtaaaggaggatcagacacatgacttctgaaactgcaaagtacatgcagatgttaagacgttaccttcgcaagctgccagatgatgagattgatgacatcgttgaattctacagtgagtatttggcagatgccggcattgataccaaagcagaaattgaacaggaactaggaacaccgcgtcagcttgctttaaagatacttgctgatcactccatcaaagaagaggctgaagatcagcgggtagtctccaaaaccaagattaagacgacgtggctgatcattcttgcgctgttggccactccggcaaccttgattatcggcttgattctgctgagcgtgctgattgccatctttgcagtcgtctttagtggcgtggtggtggtcatatcgcttgccgggggtggcatcttcttaacggcggtggctatttttaccggtctgagtcttttgtttaccaacctggggacaggacttttctatctagggattggcttgattggattaggactgctgctgatcgtcattccactcgtctggggctgctctgtctggatcgttaaggcatgcacgcgcctcgttcagcacgtctattacaagtacattaaaaaggaggcggcaaaatgaaaaaaaccattgtaagcggtctggtcattacggtgattggcgctgttgtgctagcgtttggcattgggatgcatggtcagcgggcagtaatttttgacggcttgactccgcacgtgatatcaaaggccaagacaacacggacccaaacctatgccaaagctgagcggattaaggcagacgtaagcgatatgaatgtcgttatcaaatcgggcaagaccttttctgttaagtatgccggtgaaaagatcaatcagccaaccattcaaaagaaaaatggcacggtaatcatcaattctaagagtcgcaagcttaatggcttcagtttttcttcaactggcttttatcgtggcggatcaaacgacaaactgacgattacggtaccagagaacgtaaatcttaagcatttggcgctgcgggtcaatgatgccagtcaggtcagcttgagcaatctggaaattgagcaggctgatttccgactcaacgatacggatactgcttttaatggcgtaacgatcaacagtggccaactgcatcttaacgacaatgatcttgccattaacgattctactttaaccaagataatgattcagacggctgattcggatattacgatgaattccgttgccttggatggcggcagtctcagtacccaggatggcgacgttcattttaacgacatcacgattgccaatggctactcgattacagccaaggatggcgacgtggaagcactgaacactaaagcggatggctactcgacttcggtcagcgacggcgacaatcgcttattcaatcagtccaatgacaatggcggtacgcttactcaaaacgataccgcgccaaattgcctgcaggtcacggcttctgatggtgacgtaacgattagatagggggattattatgaaaaagctgacgaaatcaaacgatcggattattgccggtgtttgtggcggaattgcagagtattttggctttgacgcaacgatcgtacgactggtgactgccgccctggctcttttcaccgcgattgtaccatcagtcattctttacctgattgcggcaatgactatcccagacgcatcgccaaagaaaactgtagatgatggcccagttttctacgagtcagataaaaaataataactaaaaatgcccggtgattatcagcagaaataagctgatgatggcagggtatttttgattgaatcgattaggtaaaatttaattatgaaaattgaaaaaggcggtctattttttatagatcgtcttttaatcatcattcaatgtaattttttaacaacgctttcttttacgaaacgtgatcatacgaagactttattaaaaaaaatcaaaccagcgggaaacttaacgttattcaccataaaacggcttcagtccaaagattgatacatttttagttgattatctttactcttagattaaaagtaaataaactttgtattaacttttgattagaagggagcctgcttatgacatctttactacgcaaaaaagatatcaatgccttgattagtcacgcatcgccattaaagcgaacgctacgtacctgggatctgactttcctgggaattggtgccatcatcggtacggggatttttgttttaactgggaaaggggcccttactgctggaccagccctttccatttcatttttgatcgcggcactttgctgcggctttgctggcctttgttatgctgaatttgcatcaatggcaccaattgctggctcggcctacacttattcttacattgcatttggtgaaatcatcgcttttattattggctgggatctgatcctggaatacgcgcttagtgccgcaactgtggccgttggatggtcgggttattttgtcaacctgctcgataattttgggattcatattccaacggctttaacggtggcggctgggaccacgcctggcgttaccagctactttaatctgccggcattcttggtcgtcttgatcattacctggatcatctcaatgggaatcacgcaaaccaagcgagtcaatgatgccatggtaatcgtcaagctgctggtcatcattctctttattgcctgcacggtttggttcatcaagccggaaaactggcacccattcagtccatatgggtggtactcacatcaaaatggcacggctgttgggatcattccaggtgcatcgatcgttttcttctcgtttatcggttttgattcagtctcatccagtgctgaagaaacgatcaatcctagcaagactttaccgcgtgggattctgctctcactgattatctcaacgattctgtacttctgcatgacacttacgatgactggcgtcgttcgctacccagttttccggaaatatatcaatgcgccggtgctggcggttttggcgaagactggtcaaagctggctgtcgattatcgtgtcgattggtgctattcttgggatgaccaccgttattctggttcagctgtatggtcaagcaagaatcagctattcaatgtcacgggatggtctttttccgaagttcttcggtcaagttgatgaaaaacaccaaacgccttttaaagggacttggtttttcggcattattacttcgcttggagccggcttgatcaacttaaacattctatctgaattggttaacatcggaacgttgacggcctttatcctggtttcggcgggaatcttgatcatgcgctatacgcagcctgatctgcatcgtggttttaaagcaccgggcgttccgtttaccccgatcatttcgattattttctgcttaacgctggtggcgggacttaactgggaaacctgggttcgattctttgtctggctggctcttggaatggcgctttactttggctacggtcggcggcattcgcatttaaatccaaactacaaaggagctgattaaaatggcctacaaaaatattttagtcggaattgatgggtctaaacgtgctgatcgagcttttgagacagcggttgatctggcaaaggttttttcggccaaactgtacttggtctgggtagtcaatcgtgaccgcgggatggattcgtcatttggggtcaatgaggatttctatcaagattttgccaaacgtaccaaaaaacagctgcagatctatttgaaaaaagcacaggataaaggagcagatgccagtgccacggtgattatcggcagcattaaaaccgtgcttgcctatgattttcctgatcagcacgatattgatctgattgttcttggcagtacggggatcaatgccgttgaaaaaatgctgcagggttcgcataccgattatgtcgttcgtcatgccaaggccgatgtgctggtagtcaagtagatagattttttatcgacgcgtcattaaggaggaagtttccatgagtaaaattgcatcactggttccagaaagtttaaagtcatccaagccatcactgattcgagtgcttaacaataaatacggcagtgatccagaagtcgttaatctgaccgttggcgagccggattttaaaacggccgatcatgttaagctggcggccatcaaaagtattcttgacgatcatacgcactatccgcacaactgggggacactaggtctgcgtaaggcaatcagcgaatatctggcagacgacttggaccttcactatgatccagaaggcgaaatcttcgttacagaaggtgccagtggagccatcagtacgattattgccggtttatgtcagccaggtgacgtcgtattgatcccttgccctgcctacacgctttatcgaatcaatgccgagctgcgtgatgccaaagcggttgaactggaaactgtcgagcctgactttaaggtgacgccggaattattgaaaaaggcgttggacaaatatggtgaaaaggtaaaggtgctggttctcaactatccagtcaatccaactggtgtcacctatactcctgatgaggtccgggcactggctgatctcctcaaggactacaacgttgccattttggatgatgagatctatgccgacctgctttatgaaggtgagcatctgccaatggctaagctgctgccagaccagaccctttatgtcagtggggtgtctaaaaatgccgcaatgactggctggcgggttggttatatctgcggaccgcgtgatgttttaggagcactggccaaggtacatcaagccgcaatctcgaccaatgccacgatgaacatggatgccgctgaagaagcgctccgtcatggtaaggctgatactgctcaaatgaaagcagaatatgatcggcggcggcagttcttaatgaccgctatggataagattggtttccaatacactaagccaatgggggccttttatctgtgggtcaagattccagacagctttgatggcgattcgatggcctatgcagagcatctggcagaaaaagctaaagtagccattgttccggcagcggctttcaccaagcttcccgtgcgctactttagaatctcatatgcggcttcaatggaaaaacttaagcgggcagttgatggactggccaaagtttttgcagaagatggttcattctacgactagtgatgctgaattgccggcagtcaagccagggatgtcggcggcttgataatgcgacaataataaaggacaaaagcaaaaacaggctcgagaaaatttctcaggcctgtttttatatatatgtaaggcatgactttcaaggtattagatggttaagaaaagaaaatgactgctcttgatcttactatttttagcatagcttatactgaacgtttaactttattgtttaatacataattatacttttattttacaaaagaactatattaggtaatttgtctatagttgggaattaataactattttgagtttattaattaaactaaaagcgacattgaccgtgcatatattatgcttataattaattttattaaccaatttttgtttattagtctggtaatagattaaagaaagagcagttattcgtttggtaaattaggattttgatagtccgttgcttgaaagacgtcaaatttaaaattatttttcatgacggaatatttcagcagttttttagctctatagattattgacaatttttattaatcaacgactggtcataaacaaaactaatttttcatattgggaggatattagcgatggcagaaagttcagaagttgcaaagatcaaggagtataaggggcttcttgatgaggggatcattagccaagaagaatttgaagaaaaaaagcaggccattatggctcatggtgaccaaaaagggaattccgtcagctcaatcattaatgaggtgccaactgcgacaggaaaattaagtactaagtccaaaatcgcggctggtctctttggtctcttttttggtgcatttggggttcataatttttatctaggctacaaaaacaaagcaattttgcagctggttttgacgattgtgggcttccttactcttatcattgctattggtgccgtaattcttattggggttgaaatttggacgtttatcgaaagcattatgattctgacctctcgcaagggctcgcaatggcaccttgatgcgatgggaaatgagcttttagattagtctgattggggaagaatctatgcgaaaaatttcagtatctgctgcagtaatcctgctttctttagggcttgcgggctgcagtaatccaatcagcgaaaaaatgcaaaatgtttctgaaaaacagaccacgattggcattccatttaccaataaaaacctcacgattggcctttttagcttgcctcatattacggataaggcacctaagacggaatcagcaagcagttcagcagtcagttcatcttcaagttctgtttctgagtcaagcagcagtcattcagttaagaaggcagctgctgaatcatcatccagcagtaccagtgctacaaaaaaatctgtaaatgatgagtcgctttggaataacgaaaaggatgctcaattggaatcattttttgatgaatgggcaccaaagatgaatcagtcatacactagatatgatggtcaaacgccgattacaactaaagtaggattaacatttccagaagatttaggtcgtgtccgtgtcaatgatcaatctgtgtcagttggatggtcaccatctggcaatggtgattatgactacaacgttgtagcaatctataattatgaccggccagatgatcaagaagatgggccgatgcgggtaacgtatttctttgccttccataatggccagccggttgcactggttgatcaaacaaccaatggctattcgctaaatgcaaagccaacgtctaatcatgatgtggccgctgcgtttgagcagattgctaagtaatcaactggttccaaagatctaataacataattgaggagaataacataatgatctttattatcggttttgtaatcttagtaatgattatcatatttgctaatagtggcagtaaaaagaaccgaacgactaaaaacaatactactgcatcaggcgtttctaatattgccgaaacggttgaggatgattcactgactggctggattaaaagcttcagtctttgctttcgaattggcctttttacaagcattattggtggaataacgattgctatttctagtagtgctgcagatagtctgacgggttcatcaattaggagtggaacggcatcaactgctattcagcttggtatttcatcgggccttgtcctattgataattgctgccctctgttttattttttcatttatacggtggctctttgctatcctttttagcctagaattgaacaccaacagacatagtcttaaatttcaaaatgggtctccgcgaacaagtggagacccatttttattaagctctgtctgcttttcaagggtgcgaaatgatactggttgaggtatcagcactagccactgaaaaatggtcagccaatgaggccaatcaatggacgatcggcttgaaagcagtggcaaacagctcaaacttgacgattatgcaaaagtacttgcataaagtcatatgacaaaaagatcattacctacttttttcaaaaaaaacgatgcatagtaggtaaaaattaatgtatatcgagttaggggtccttaatactacctacaatttgataaaaatcacacaatagtaggtaattcacaaagtcggtctgacccaatcatcccttaaatatacattcttaccgatgattacctactattcggaaaaaaccgtcttaagtaggtaaagttagggaagccgaatattcatcatacctactcctggtccaaaatcagagaatagtaggtaattttagctctgtaattagaaaagactgctttttcttcacaaagcctgcaagcttggggccgttaaatcaatcgtcagttggctgctgaagaaatgcattgaacaggcgattctgaagtcggcaccaatcaatatcatggctgtgtcaactgccaacgattaagaagcggcggtggaatgcctagtatttgaagacataagaaaagagcccgccagtcagcgagctcttttgatttagacttgattaatctttgcgcttgttttgattatccttgacgtgattacggattggatagctcaagtagatcgtgctggtcatgacgattggcaagatgattaccaagatgatcagaccaacgattaccgtcatagcaacttcaatcagcgttggaatgccagatggaatcaaagcagcaaacgtaccactcaagatgatagcggcactgataacgacggtcccgatgattgcacaggcatagtagattcgctcgcctggcagatacttgttctcgtcgatttcacgataacgcgtcatcaagaagatactgtagtcaacccctaaggcaatcagcataatgaagctaaagaatggtgtattccaagccagcatgctgcggtgcatgaagatgccgaccagccagtggttgattgacagtgaggaaatgtaggccaacaacagcgaacccagaatgtagaccggctgcagcagcgaatgcgtgatcagcatcagcgcaatgccaatcccgatcagcatgatggcagcggtccggacaaagtcgccgctggccgtgttcttaatgtcattgatccgtgaagactgaccgcccatggcaaccgtggcattgctaagggcagtgcctttcaatgacttacgagccatgttggagatgttttcggcatcttttgtggctttttcatcactagggttggtgtcaaagacaatcgtaatcttggtgatcttacggttggacgacatgtagttgtcgattgctggcttaaaggtattgctgtgcagaactgacttaggaatgtagaaggtttcagcagctgccgacttctgcagacccgtcagatagctttgaccctcgccaagtccagagttcagctggttaaggccgttggtgatctgtggtgagctttgcgccagcttgttgatgccggtgttaagctgcagactgccggcactaagctgtcccatcccggcacttaactgttgactgccagagtaggcagagttgatgccgttgcttaactgtggcgatgcggctgccagcttgttgataccggtgttaagctgccccagtgcattggtgccttgaccaagtgcgctttgaatctggttgaggccgctggttaactgctgcagggctgaaacggcacctggcagcgcaacattggaggcttgcgctaattgagcaacttgagccttcagcgttgcgacctgcgtattaaggttctgcagactggaagccgaaccggcaacgttttgcaaggaaccggccagtgatttgtcggcattaccagctgtctgcaggttttgggccacgctttgcagctgactggccagctcgctggtttgactgttggtctgagaagcaatctggctttgaatgccgctaagaatctgctgcatggctccttccatcacggccttttgctggtcgttcaggttggcttgactttcagcagccttaaactgagtcatgacagaatcaagactggcggagctggaagaaccggcagatccttgaatgctctttaaggtattgcctgcctgttccagctgactgccaatgatctgagcctggctggcaacgttttgcaggttggattgaatgccggtcgtatcaatcgaggtaccagcactctgcagggcgctgttcagctgttggatgccgttattgatctgtggcagaccgctttccagctgttgaagctgtgaggcattggcgccggtcaattgagaactgagctgctgactcatcaggttcatgccgttgactagctgctgactaccggcactaagctggtttaagccgttggtcatttgattgccgccagaactgagctgtgccagaccagaagtcagttggttggcaccagtagccgcggaattgatcccgctgttcagctggttggtaccagttgcggcggagttaaggccatttgtcatctgctgactgccggcacttagtttgccaagcccgttacgagccgttgaaacgccgttgttaaccgtcttcatctggctgttgacgtaaagcttcttgatcttggaaccagatggctgagtaacggaagccacggtcttaacgcctttggtatgcttgatctgttccgtcagctggtcgatcagctttaagtctttttcattgtccagcgtgtgattggacttgatataaagcgtggcgggctcagccgttcctttggagaagtgcttctgaacgatcaggaacccttgcttggatggcgttgagtcagcaatttcggccgtgtcgtcataattcagcttgttttgataagtgaagtagaatggcgacagagcagccagaaccaagaccaacgcaatgattggatgggccagggaatgcttggaaaggaaacgccagaacgggctttccgattcaccattgaaagtcttaaccggccagaacatggtcttacccatcgtggtcataaagaacatgttcagcgtcagcaagacaatcagcaagacggcaaccccaacggcaaccccagctgcggatttgtaaactgagaaacgggccagacccagtgccgagaaaccgatcaaaatagaggatcctgacatcagaatcgtcttgccggcattccactgggcgtttttggccgcttcgaacttatccatgccgtttcctagattagccttgaaacggtcataaagcagaatgttgtagtcggtaccgatcccaaacaaaacgatcaccataaagacttgggtaaagttactgaatgggaaattaaagttcttaaccaggttggtaacgattgaaaaggcggtaatgaacgaaaccccaaccgtcagcagcgagattaatggaacaatcggtgatcggaagaccagtatcaagacgataaagataaagataaccgagatgacttcagtcttcttgattccttcttggatggctcccgaaaagtcgtcctgcaagatgtcggcgccagtaatataggttctgatgccatccgtcttaacggctttagtaagctgcttgttgatattagaaacggatttctttttagaaacgtttaactgaacaagttcggtagtcttgtcttttgagatcaggttcttcttggtagccgagttttcatatggggtcaacatactcttgatgcccagttcggatttgtgacgcttcagatagcgaatcgtctgattaacgcttttttgatccgatttggacatcgcaccgtcttgattgttaaaaacggcgacaacttgataggtattgttttgatgatgtccccaatgattgccaatcgtgctggcaacctcactttgaacgttggcaggcagtgagattgtcgagtgctcacgcgttaattgattgacgttaggcagcatgaagatcgagatcacaacaatgagaatccacgcgatcaaggatccaacgtggtttttaataaatcgcatctcaaaatttctccttacctatttaaataaaaaattaatgcaccaaaattacggcttgcatgtcctaggctttttcaacagggtcaatcagtcgaaaaagcatttgatggtagttgacagtcgcagcattttcatcttcatcctgatagagtggtgccgtttcaagaaaaatgtagcctaaaacggcacctaccaagacgtgtgacgaaattaagcggttgccatcaacgtcaacgacttgatcgaccaacttgatcattcgcttgatttcttgatacattgccgagtcggttgaaaaacgctgggcatggtacaggatcgctgataaagaagcatgggccagtaaaaaatcacgaacgatatccgcgaattttaaataggccttggaaccggaaagaccgataatgccatcaacgacctgctgatacatttgctgcatcaatcgagcaccagtcagcgataccatttcttcacggttggcgacatagttgtaaagcgattgtgagcgaatgtcgagtgctttagccagattgggcatggttaaagcttcaagcccttgttcatcggctaatttttcagcagtagcaagtaccttttcccgatcaagggttcgtcgcttggtcatgaaatccctcctttactttttttaaccagaataatataacattactaaatgtagataacaatctacactctgtagtttatttgagcaagatgttcgattatgagatatatgtcgtaaatcattccataacggcataaaaaaagacctgcaacatttggcaagtcttaggataaaggatgagcaatgtagcgtaattgatcgaaatcaaagaaataggaaagattttttgattgaaccaaatagcgatcctgaccaagcgattttaaatagccgcgtacctcaaccggctggcccgcagcagttttaggcatcagctgcagatagaccagtagatgatcagacaatgctttttggataaacattttcctttgaaaagcgggctggggatttaataaatctggaataggagcgaactcaatcggctcaaacaaatggtgcagactttgggagataattttggtactacgattaataattgactgccgctgattttgcatgatcattcctccgaacactcgtttgtgactatagtatacgaacaagcgttcaaaaatgcaagcaataattttaatacaactttttatttattgagatgagcgggccaaataccggtaaataagtgattggccaccttagttgatgttgagatgaccattgctgaaacgagatgatcgatagccgtattaataaaaagaatcgctgtaagcatggtcagaaaagatcgtttcatcatcaggtgatatttttgcaagggtagcggatgttttcaagctgtgattcaagtaagagcaaaattacgatccagctgctgattaggccgatcttgaaatttccattgaattatgaccgaatttattgcagaatatggtattattaaacattaaaagagctatgagaaaagaaggtatggaagcaatatgagcaagcgaggaatgctgattgttttgtctggtccatcaggcgtaggtaaaggaacggttagaaaagcgctgtttagtcagcctggcaatgattttcaatactcagtctcaatgacgacgcggcagccacggcccggcgaagtcaacggcaaggactatttctttgtttcaaaagaggagtttgagcagcacattcgcgaagggcagatgctggaatatgccaagtatgttgacaactattacggcactcctttaaaatatataaatgatacgctagacgaaggtaaagatgtcttcttggaaattgaagtcaatggtgccatgcaggttcgctcaaaatgtcctgatggcgtcttcatctttcttacgccgccggatctgatggagctgcgccaacgcttgatccatcgtggtaccgacagcatggaagtcatcaacaaacgaatccacaaagctttcggcgagattcaaatgatgcagaactacgactatgccgtggttaatgatcaagttgacaatgcagtcactaagatcaaagacattattcgttccgaacgcttgcgggtacctcgcgtaatgccggattaccttgaaatgttaggagattcagaaaaatgattctttttccatcagtcgatgaattgctcaagcgcgttgactctcgctactctctgattatgctggcaagcaagcgggctcacgaaatcgataagtaccgtgctgacaaatggcgtgccgaaaacgctgatcagtcaaaggacaattacgcagccgaagcattggcacaagatcatccattgctgctggatcattactactcaaccaagtcagtcgggatggcgctggaagaaatcgaagccggcaaggtaacgattgatactgatcatacggaagacttgcaagactagttgcagctgccaaagagcgacaccagacaaaagttttggtgctgctctttttatttttcatcaaggaggcaaacatgacgaagattgcggtacatatgacaggtgggattgctgtctataaggcagttgaagttgttcgcggcttgcagaagcaggggcatgaggttcgcgtggcgatgactcaaaatgcagcccgctttgtcggcccggcaactctagcggcgctaaccaagcatcccgttttaatcgatcagtgggcggcgactttaaacggtcaggtgccgcatattgaactggcagactggagcgagctgtccttagtggttccggcaacggccaatctgttggcaaaaatggcagcaggtctggccgatgacgcggtttcagccacgcttttggcaaccagcgcgccaaagatcgtggtcccagccatgaacgttcacatgtggaacaatccagctacgcaaagaaacattgcccagctcagacaggataacgtcatggtaatggatccggcaacaggtatgcttgcagaagggtatgccggtaagggacgcatgccggagccagctgcgatcgtaaaacaggtgcaggattacttaaccaatggcccgctgaaaggtaaaacgctggtagtgactgctggtggtaccagagaggcgcttgatccggttcgctatctaggcaatcgttcctctggtaaaatgggaattgcaattgcaaaagcagcggccaatgcaggtgcacgggtcgaattgattgtcggcagcgtttcggttgcactgccgcattctgatcgcattacggtgacccaagccctttcaacgagcgcgatggcggctgccgtatccgacaagtttcaaacagctgatgccttgatcatggcagcggcggttgcagattttcggccagccgttttggcagatcaaaaaatcaaaaagcatggcgatggcaccttgactctgcatttggtaccaactgaagatattttggcaaagatgggcgcacaaaaacgctcagatcaagtagtaatcggatttgcggctgaaaccaatgatcttttgcataatgccgatgccaagctgcaaaagaaaaatgccgatgcaatcgtggctaatgacgtttctgagccaggaatcgggtttggaacggatgacaatgccgttacgattctgcggccaaatcaggcaccgttgagatggtcgcgccagtctaagatgatgattgccaaaaaaatcgttgctttgacggccaacctgctgaaagtgggtgattaaatggctgaactggcccaggtaatcgttgacgtaccgacgatgcagactgaccagccatatacctacgcgattcccaaacgcctggaaagccagattcaagttggtatgcgcgtaatcgtaccatttgggcggggcaagcgcgaggtgcagggctttgtcgttggcattgatcagccgacggaatatgatggcacgctcaaatcaattattgggttgatggatctggtaccggtcgtcaataccgaactgctgcaactgagccgttggatggccgatcaaacctatgcattctggatctcgtgtttgtatacgatgctgcccaatgccttaaaagccaagagtcatcgagtggtgcgcatagtcgatgaggttgatgagcagacggccctggatctttttcaaggagctgatgagctggattttgaacggtatcaaaatgatccgcaaatcgtcagccagctgcttaaacttaagcggcagggtaaggtctcgtttgagtatcaagttgaggaccgggcccgtgtcaaaaaagaaattgccattcagccattgatgtcgtttgaacaatatgaagatgagcgagtcggtgttcgggccaacgcgcatgctcaacagcagctgctttcctatctgcagcagattgacggccaaaaagtcaagcttaagcaggccgaacagcagtcggggttgaaagctggaacgtttaacgtcggcgaaaagcgcggctggctcaaaaaaatcgcagtggagacctatcgaacgccgactggtatgatacctgatgatcagcatctggatttaccattgaaattgaatccggatcagcaggcggccgttgccaaaatcgatcaggccatcgatcaagcccaaaatcaaacctttttgctgcagggggttaccggatcaggcaaaactgaagtctacctgcaggcaatggctgaagctttaaggcaggggaaaacggctttgatgctggtaccagaaatctctttgacgccgcagatggtcaatcgggtccgacggcgatttggtcagcgcgtggccgttttgcacagcagtctttcagatggcgagcgctatgatgaatggcgccgaatcgagcggggcgaggctcaggtagtagtcggcgcgcgatcggcggtgtttgctccacttgaaaatctggggctgatcattatggatgaagaacacgaaaccagctataagcaagacgaaacgccgcgctatcatgctcgtgacgttgccgcctggcgtgctgagtatcatcatgcaccgctggtattgggatcggccacccctagtctggaaagccgggcgcgggcactggctggcgtctatcagcttttaagaatgccgatgcgggtcaatcagcggccgttgccaccagtagaagtcgttgacatgcggccggaaatgcagcgcaatggcgagaccaacttttcagaccggctgttgaatctgttgaacgagcggctgcaaaaaggcgaacagagtattttgatgctgaatcgacgcggtttttcttcatttattatgtgccgagactgcggcttcgttttgaagtgtcccaactgtgatatctcgctgacgctgcatatggactcgagaacgatgaaatgtcattattgcggccatgaggagccgattccttcaatctgtccgcagtgccaaggtcgtcacattcgctactatggtacgggaaccgaaaaagttgcggccgagctgcagcagctgatgccaagcgcgcgcgtgattcgcatggatgttgatacaacgcggcgcaaaggaatgcatgccaagctgctgaaagaatttggcgaacatcaagccgatattttgctgggcacgcagatgattgccaaaggactggactttcccaacgtgactctggtgggggtcttgaatgctgatacgggattggacctgccagactttcgggccagtgagcggacgtttgatctgctcagtcaagtcagcggtcgtgccggtcgtgccgataagccgggaaacgtcgtgattcagacctttaatccagacaactacgcgattcgctatgcgcagctgcatgattatgaagacttctttaaggccgaaatgaacattcgttaccaggctggctatccgccttattactacaccgttcgcatcatggccagcaacgaagacgaacgcgcggctgccaaggccatttatgaaatcagaaaccagctcagtgtcaatctgagcaaagagacggtcgttttagggcctacgccgcggccaattgctcgaatgaaaaaccgatactattatcagataatcgttaagtataagcatgatcccaagctgcacgtgcttttaagggacatcatgcgtcaaacgcaggccaagagccgtcaagacaccttggtcagcattgatccggaaccacagtattttatgtaattaagaaaggatttgttgttatgtcagtatcagtcgtatttatgggaacgccccagtttgccgtgccgattctgcaggctttgattgatgatgaggcctatgacgtaaaggccgttgttacgcagccggatcgccgggttggccgtaagcatgaactgcgcgcgacaccagttaaggaattggccgttaagtatggaatcgaggttctgcagcccgaaaagctgagcggcagtccggaaatgcagagtgtgatcgacttggcgcctgattttgagattaccgcggcgtttggtcagtttttgcccgtcaagatgcttgaagcggctaagattgcggccatcaacgtccacggctcgctgctgcctaaataccgtggcggcgcgccgattcaatactcaatcatcaatggcgatcaagaaaccggcgtcacgatcatgtacatggtcaaagcaatggatgccggcgatattattgcgcaaaaggcaattccgattaccaaacaggatgacagcggcacgatgtttgaaaaattgagtctgctgggccgcgatcttttgatggagacgctgcccaaaatgattgccggcgacgtacagccagtcaagcaggatccggaaaaagtcgtcttctcaccgaatattaccagtgagcaggaacgcattgactatcgcttgccagctgaccggattgatgacaaagtacgcggcttgcggccattcccaattggcaacatgattattgacggtctgcagactaagatctacgacgtcacgccattggacgaaaaaacggatctggcaccgggacaggtcgtacgcgttgaaaagcatgccttgattctggcggctggcgatcatacgacttatcggatcaatcggctcaagcctaagggcaaacgcgaaatggacatcacttcttatctgaatggtcatcaaaatctaaagcaaggagttcaggcaatcaccgatgaagaataagcaaatcaatactgcacgcgccgctgccttaaaaacgcttgatcaggtattgcagaatggcgcctattccaatctgcagctgaatcagaatctcaagagcagccagctgagcgaagtcgacaaacgcttggctaccaatctggtctatggggtcttacagcacaagctaaccctggaatactggctggcgccttttattaagggtaaaaagatcgaaagctgggtcaagacgctgcttttaatgtcgatctatcaatatcgctacctggatcgcgtgcctgactgggcagtaaccaatgagtcgatcgaactggctaagcagcttggcaatccgggaacccgtcgttttgtgaccggcgttttgcatgccgttttgcgtcaagggctgagggatgttaacgccatcgaggatccaatcaagcggcgttcagtggagttcagtctgccgcaatggctggttgatgaattgatcaaacaatatggtcagtcgactgccgatgcaatttttaaggccgtcaacgaaccagcccgcgtgtcactgcgggtaaatgaggccaagacgactattccccaggcaattgccattttaaaagagcagggcgttgaagttgagcctagccaggttgccaaggccggtctggtggttaaaagcggtgatgtcgtcaatacagacgcgtttatgcagggattggtcacgattcaagacgaaagcgccatgctggccgtagaaagtatgacgattaacccagcagatcaggttttggatgcctgtgccgcgccgggagggaaaaccgtccagattgcggctgccttggatgaaaaacagggtggcagcgttacggccttagacattcatgcccacaagatcaaattaattgaaaaaaatgctcagcggcttggcgtggctgagcgcgtccatgcttgtcaactggatgcacgcaaggtggatgaaaagtttgaggatggccagtttgacaaaatcttagttgactcgccctgcagcggaattggccttttgcgccgcaagcccgagattcgctatgataaaaaacttagtgacagtcaaaatctgcatgaaattcagctggcaattttaaatgcagttgccccaaaactaaaaaaaggcggtataatgatatatagtacgtgcacgattttgcagcaggaaaatgatggtactgtgcaggcctttttagccgcacatcccgaattcagactgctaaagacgcaaacggcgcgtaccttgaaaaacgcgcgaacgggggcaaccttgacgattttgccaagcgattatggttctgatggattctttatcagtaacctccaacgtttgtagaagggaacatagacccatggaaacagcctatcaatcagatattggacaacaacgatctgaaaatcaagatcgcgtcgatagttttgccacggatgccggaatgcagctggatttggttgcagatggcattggtggcaatcgtggcggggatgttgccgctcaaacaaccgttcagactctcggtcagcgtttcttaaagtctgcgcccaatgatgaggcagctgctaaacagtggcttgccgatcaggtgcagcagatcaatgatcaaatcattgacgaatcacgcaagaatgaaaattatcagggaatggggaccactttggtagccgccattttctttaatgatcggcaaaaaattgtaattgccaatatcggcgacagtcgtggctatatcatgcatcaaaacgtcttgacacaggtcacgattgatcattccttggtaaatgagttagtcaagaacggcgatctaaccgaacaggaagccgccatgtcaccacagaacaatattataacccgggcaattggaatctcgcatgatgcgcagattgatgtcaacgtttttccatttgaaccgggagatcaattgctaatgtgctcggatggcctgtccaaaactgttgataagcaggaattgacccaagtgctacaaagcgatgcaccgctgaaggacaagtgcagcgttttggttgaaaaagccaatgcagctggtggcccggacaatatcaccgttctgatcagccaaaatgatcaggagagataaaatcaatgaaacccggatatgagcttaatcaccggtataaaataatcgaatcgctgggtgagggcggcatggccaatgtctacctggctcacgatctggtgctggatcgcgatgtttcggtcaagctgctgcgcttggacctgcgcgatgatccgagtaccaaacgtcgctttgaacgagaagccatggcggccactcagcttaacgatcctcatatcgttggcgtttatgatgttggcgaagagcatggcattcaatacatggtaatggaatacgttaagggtaccgacctgaaaacctatattcatgatcactatccaattcccttgccgcaagtcatcgacattatggaacaggttttgtcagcagtgcagaccgcccatgctaacggcattattcaccgcgacttaaagccacagaatattttgatcgatgagaataaaaatattaagattacggattttgggattgccatggcggcttcgcaaaattcaatgacgcaaaccaatagtctgttgggatcggttcactacctttctcccgaacaggcgcgcggcagcattgcaacgccgcagtctgatatctactctttaggaatcatcctatttgaactgctgactggtcaagtaccttttgaaggtgagacagcggtttcgattgccttaaaacactttcgcgatgagattccgtcagttcgcaaattcaatccgcagattccgcagccgttggaaaacgtggtctatcgggccactgccaagcacccttgtgaccgatatcacgatgttgaggcaatggcggctgatctgcagacctcgttggatccatcgcgggctgatgaaccaaaatttgtagttggtcaacgttccagcaacgaagaaaccaaagtattggatctggatgcaattaaagaggccgccaatcttgatgagaccagcgatgaaaaggttgacgacgacaccaaacaactgacggcaacgcgacaaagccgtatgaaacgctccattcagcgccacccaattcgcaaatgggcggttattttagtgctgctgatcgcggcaatcggaattggtaccggtctttacatgcatcgatcggtcagcgttcctgacgtcgagggactgacgacggcacaggcggaaaagaaactgcaggcaaatcatctgcgcttaggcaacgttaccgaaaaaagcagtcagaccgtggctaaaaatcatgtcgtcaaagttgctggcagccagcgccacgcccatgctggccagtcgatcgatctggttgtcagccgcggcgttaagacatggaagatggctgattacgttggcgacagctattctgacacggctgatgagctgcgcgataaaggctttgtcgttaagcaggccaaaaaatattccgataccgttgcaacggggaaaatcattaaacaaagcgtcaatgccggcacgacgatcaatcccagccagcagacggtcacgctgacggttagcgccggcaagaagcaggtcacgattccaagctttaaaggcaaggatgtcagtgaagtgcaggattttgccaataagcaccagctgcagctgacgacgacgcagaaaaattcaacaaccgttgctaccaaccatgtgatccagcaaacgcctaaagcaggcagcaagctgacgcatggtgataccttgaccgttcagattgccagcaattccaacgagttaaggacgaccaatattcaaatcaacattccgtttgatggtaatggcggcaagaaggaaaaccgagtacaggtatatattcgcgatgcctatcataacctgacgatggaatatgaggatattaccatcaatcaagaaacgacgattaacgtaccatttacgctgcgtaatggtcagactggcgcctaccgagtaattcgcaatggtcagactattatgagcgcgacgaatattacaggataagttgaggtgtaaagtgcaacaaggaatcatccagcaatcgctcagcggcttttttgacgtgctttgtgacggtgcagtttatcgtacgcgtggccgaggcaacttccgtaagcgcggcattaagccaatcgttggcgatcaagtagaatttgcagacggctatctgcttaaggtgctgccccgtaagaatcagctgcggcggccgccagtagccaatgtcgatcaggcagtcgtcgttacggccgctaaacagcccaagttttccagcaatttattggatcgtcagctgattgctctggaaaaacaaaccattgaaccaatcatttatttttctaagacggatctgctaaatgatgacgaatggcaggatctgcagccgatcttagctggctatcgggcaatcggctacgcagtaattgcgcagcggccgccgtttggccaaacaacactggatcagcttcaacagctgctcagtcatcatatcgttacgatgatggggcagactggggcgggcaagtcaacgctgctgaatcacctggcgcctgaattaaatctggcaactggtgaggtctcgcaggctttaaaacgcgggcggcataccacgcgtaaagtcagtctgatgacgattggcgaggccttgattgctgatacgcctggtttttcgtcatatgaggattttgatatggacgtgacggagctttcaaaattatttccagaaatgcgtcagttggccccagaatgcaaatttcgcggctgtctgcatctaaaagaacctggctgtgccgtgaagaacgccgtcgagcatggtacaataatgaagagccggtatgacaattatgttcagtttaatgaactaattgtcagccaaaaaccaaactattgaattgaaacgagggaaaaagattatgattaaagtagctccatcgattttgagcgcagactacatgaatcttgaaaaggacatcaagctggttgaccaggctggtgctgaagaactgcacattgacgtgatggatggcacgtttgttccaagcatttcctatggcccaggctttgtaaaggcaattcgtcaaatcactgacatgtacctggacgttcacatgatggttcaaaatcctgaacacctgattccagcaatggcagaagctggtgctgacaacattggcgttcacgttgaagcaacgccgcacattcaccgtgccttgcagctgatcaagaacgcaggcaaggatgctgaagtcgtgatcaacccagggacgccggttgagatgatcaagccggttctgcacatggttgaccaagtattggtaatgactgttaaccctggctttggcggtcaaaagttcctgccagaaacggttgccaagattgctgaattggatgcaattaagaaagctaacggctatgactttgacattgaaatcgatggtgggatcaacaatgaaacggttgttgactgctacaaggctggcgccacggttgcggttgccggttcatacgtctacaatgccgaagacccactggcccgcattcaagcactgcgcgacgctactaagtaatcaggttaattaggttaaaaacgtgacaaagcgattcgtcgcgttttttgagaggctgcttatgaatgaaaaaatcaacattatggttggcgggccggaagcgctgattccttatgatcaagtcgctgatcatcgctctgagacttggctgggcgttgatttaggagcaaccagactgcttgagcatggtattgttcccgaatatgctgctggcgactttgattccagcacgcctgagcaattagcacgagtcaaagcggcggtcccaaaagtagatatctatccaccggaaaaagactataccgatactcagatcggtattttactggcaatgaaatattaccagccagcttcaatcacgatctgggggacaacgggaggccgcctggatcagctgctggccaacctgtacacgccattgatggagccatatcgtaagtacctagcaaagattcatctggttgatcgtcagaatacggttgatttttatgaaccgggcagctatgagatttataaagtgcctgagatgccgtatctggcttttgtcaatctgacgccggtaaccggtttgacgctgcctgatgaaaagtataatctggatcattttgacagcccgctgcccatttcctggtccagcaatgagtttgtcgggacgatcaatcatttttcttttgacagtggaatcgtggccgttattcaaagccgtgatgtccattcacaggggcctttcaaaggtgtcaagtgaaaatgcttgaaagaaaactattgcattgaaagcccccctatggtaaattatttaggtgagttacagcgcgcatctcagcgcggagaaaataactgatgaggagaggagggttccacatggctaaggatttcatgaccggtaagcggacgcgcttcggcaacaagcgttcacacgcccttaactcaagtcgtcgtacctggaagccaaacctgcaaaaggttaccattttggtaaatggcaagccaaagaaggtttacgtttcagcacgtaccctgaagtcgggtaaagtgactcgggtttagtccaaaaacataggctgtccgccttgcgggcggcttatttttttgctgattggtttaagcaatgcgggctaatttgctttttgacattgctgtgctatggtaagatgatagagatatcaacttgatgacaaacgattaagggaggccattgaagatggcagttaagattaaaacaaagtctggcacgatcgatattgctaatgatgtgatctcaacggtcgtaggcggcgccgctaccgataactatggcgtagtagggatggccagtcgcaatccattaaaggatggcgtcaaccagattctgcggcatgacagctacagcaagggcgttgttgttcgtcagcaagacaatggcgtttccgttgacgttaatatcattgttggctatggcacgaagatttcagaagtgtctaagagcgtccaagaaaaggtcaagtacaacctcgaatccatgctgggcgtcacggccaatgcggtcaatgtatacgttcaaggcgttcgcgttttgggcgatgattaagacgtgccacgggaggaattgattttgacagttaccaagattactaatctcgaattcggcaagatggttcaggcggcagccgccaaactgaacgctcaagccgaattcattaattcgttaaatgtattcccggttccagatggtgacacgggaaccaacatgagtatgtcaatggccagcggtgccaagtatgagcgtgaagctaccagcaccaacgttggcgacttggcgcaggcactggctaaaggtcttttaatgggtgcccggggcaattccggagttatcctgtcgcagattttccgtggctttgccaaaggctgtgccgataagcaggaattatcagccaaagattttgttgacgcctatgccaatggtgcccaaacggcctacaaggcagttatgaagccaacggaagggacgattctgacagttgttcgcgaatcagctcaagccggtttaaatgaggtcaaggctgggaatgacgatctggttgacattatggaaaaaatctatgatgccagtgaagaagccttgaaaaagacgccggatctgttgccggtgctcaaggaagtcggggtagttgattctggtggtcaagggctggtgtttgttttgcaggccttttatgaatcattaagcggcaaggttgcagaaaacgacctggttaagccggataatgcgcaaattgatgaaatgatcaatgccaagcatcatcaaagcgcacaggggaagctggatccgaatgacatcaagtacggctactgtacacagatgatggttcggattggccgtggcaagcaggtaacgcaaaaatttgactacgacaccttctataactacctggccaagctgggcgacagcctgttggtcattaatgacgatgaggttgttaaggttcacgttcatactgaattcccaggcaaggtactttcctggggtcagcagtttggtgatctgcagacggtcaaggttgacaatatgcgttggcagcaagaagagatcatggaaaaagacgaaggcgagccgacaccgcttgaaaaggccaaggaagctgaaaagccggcgctggacacagtagtgattgccgtagcctctggcgatgggattgccaaactgttggaaagtcttggcgtaacccatgtgatcaacggcggtcagaccatgaatccaagcattcaagaaattgccgaagctatcaacgaaagcggtgctaagcaggccttggtattgcctgacaatggcaacatctttatggctgccgatcaagctgccgaagttgccgatattccaactaaggtcgttcatgccaagacgattgcgcagggcatgagtgccatgctggaattcaatccagaagctgacctggcagaaaaccaggccaacatggaaggcaacctggatatggttaagagcggcgaggttaccaacgcggttcgcgatacgacgattgatggtcaaacgatcaagaaagatgatttcatgggaatcgtggatggcaagatcgtcaatacggcggccgatgtcaaaacggcagcaatcgaaatggttaagcagatgctggatgaagacagcgagatcgttacgattctttatggggtcgatggcgataaagaaacagctgaagccatcaaggaagccattttggccgttgatgacgaattagacgttcagatctatgatggtggtcagccagtctacccatatctgatttcggttgaataattatcagcgctgaattggcgtaatcaagtcgtgtcgtcagcaggcgatgcggcttttttattaccagcaataaaagggggcgtttgtttgaaaagtctgcaggatccagtgggcagcctaaagggagttggcccgaaaacggttgcggcactggcaactttagacattaaaacggttgaggatctactgacttattttccttcacgctatgatgactttgccccgactgatctgaacacggctaaggatcgtcaaaaagtaacggtgcatggcacggtaagctcagaaccgattttgacacgttatggctatcggcgcaatcgcttgagctttcggctgctggttgatcgcaacgttgtcttaacgacttttttcaatcagccatatttaaaaaacagcattatcctaaacacccatattaccgttcaaggaaaatgggatgccgcgcgccagcagattctgggaactaaattgtttactcagaaccaagagcgtgaattaggcgcgatctacccagccaacaagcatgtttcacaaaaaacactgcgtaagttgatcaaacaggcctatgatcaatataaagacgtgattgcaacgctgctgccgatttcgctgcgccaacgctatcagctgatggagcgccgcgaaatgatcaagcagatgcattggccaaccacgccttttgttgccaagcaggcgcaaaaaacagctgcctacgaagaattcttcttgtttcagctgagactgcaggcaattcgacgggcgcaccggcaagacgatggcaatcagattctgtataacaatcaagaacttaaggaatttatcaaaacgattccctttgagctgactgacgcgcagaaacgctcggtcaacgagatctgtcgtgacctgcgcgcgccttaccagatgaatcgcctcttacaaggggacgtgggctcaggcaaaacgatcgttgctgcgctggcaattgcggccacgatcaatgctggctaccaggctgctttgatggcgccgaccgagattttggcggcccagcatgctgccaaactggctgatatttttgaaggcacgcatgtcagcgtcggtcttttaaccgggtcaatgactgctaagcagcataagcagctgcttaatgagattaaagcgggaaccattaatctggttgttggcacgcatgctttgattcaagacaaggttgattatgccaatctagggctggcgattattgatgagcagcaccggtttggggttcgtcaacggcagctgctgcgcgaaaaaggcgagaatccagatgtcttggcgatgacggccacgccgattccgcggacgctggcaattacgacttatggtgagatggacgtttcgatcattgaccagttgccagctggccgcaagccgattgaaacgcgttggctgcgagaaaatcagagcggagccgcgctgtcgtttttaaaagaacagctggcagacggcgcgcaggtttatgtagtcagtcccctgattgaacagtcggaatcaatcgatgtaaaaaatgcaaccgacctctatgaaaagtttgccgagtatttcgcgcccgactaccgggttggactgctgcatggtcggatgagcagtgatgaaaaagcggcggttatgcagcagtttaaggacaatcagctgcaggtactggtggcaacgaccgtaattgaagtcggtgtcgacaatccaaatgccacggtcatgctgatctatgacgcggatcgctttgggctggcccagctgcatcaattgcgcggtcgtgtcgggcgtggacagcgccagagctattgtctgctgattgccaatccaaaaactgaggatggtcaggcccggatgcagaccatgactgaaacgacagacgggtttgccgttgctcagcgcgacttggagcttagaggttcaggagacgtcttaggaaccaaccagtcaggcctgccgcagtttaaagtcggcgatccaattggagatttgaagatgctgcagacggcgcgggctgacgcaggcgcgctcttggctgcaccgcattgggatgaaaaagatgagaatcagccgctggtactgtatttaaaacgtcatcagctggaaacgcactttgattaaggagagaaaaaatgattaaaattgctgtagatgccatgggcggcgaccacgcaccccaggcaatcgttgctggagttgaagcagcccgtgatcagtatgccgatttggaatttgatctgtacggcgatccccaaaaagttgaaccgctgattaaggatcagacgcggctgcacttggtaaaaaccaccgaagaaatcgaaatgggcgaagaaccagtcaaggccattcgccgcaagaaggattcctctatcgtgcgggccgcgcaagccgttaaggaaggacaggccgatgccttcttttcggctggcaatactggcgcgattttggcggctggtctgctgatcgttggccgcattaagggaatcgatcggccgggtctgaccagcgttttgccgattgcggaaccagtcagcttacggcacagttttgtctacctggattgtggcgccaatgctgaggccaaggagcgcaatctggttcagtatgctcatttgggccgtttctatgccgaaagcgtgctgggaatcgagaatccacgggtggcgctgctcaacaacggtgctgaagaagacaaaggcgaccggctgcataaagaagttcaccagcagcttaaggccgaagacaatctgaattttatcggcaacgtggaagcgggcgacttgctggttggcaaggcagatgtcgtagtcagcgacggctggacggccaacgcggcactgaaggctactgaaggcactgctaagatgtttttgaagctgatcaaaaatgggatcttaaatggtggtctgcgggccaagatcggctacctattcttaaagcccgtctttaaaaacattgccaagcagatgagcacttcgacctatggcggggccgtactgcttggcttgaaggcgccagtcgttaagacgcatggctctgctgatgcggttgcagtcaagaatacgattggccagattcgcaccatgatccagaccggcattataaaagaagccgttgactacttcagtcccgaggaaaacatggacaatcagcctaaaaactaatacaataggaaaagttagttcaaaataaaattgtgaggtagaacagacgatggataaaaaggaaatctttgacaaggtctcatcaatcgtagccgatcactttgacattgatcgggctaagattacggaagacctgaacttaaagaccgacctggatgccgattccatcgactttgtagaattcgttctggaagtcgaagatacttttggtgctgaaatcgaagacagcgaagccgaaaagctcagcacgatcggtgaagtggttgattacatcgctgcccatcaacaggacaaaaaataagcaaaatcaccgggaccgcgatgaagcattactttgtcggcggtctttttttcaatggaaattacacgaaaggaagtttttctcattaaagaactagaagactatcttgccaaagagtttggcattcattttaataatccggatcttttagccgaggcctttacgcaggcatcatacgtcaatgagcatccgcatcagggactgaaatactatgagcgaatcgagtttttgggtgatgcagttttgcagctgtttgtttcggaatatatctacaagcggtttcccgagctgccgcagggtaaattgacgcgactgcgggcagcaatggtgtgcgaggacagtttttccaagtttgccaaggaatgtcactttgatcaatatattcgtttggggcatggcgaggaaatggccggcgctcggcagcgggccagtctgctgtgtgacattttcgaagcttttattggcgctttgtacttggatcaaggccgcgatgccgtggaaaagtttattcaccgcgtcatctttccgaaactggatatgggctggtttgaccacgctgttgatgccaagaccagtctgcaggaattcttgcagcgcaacggggatgttgatattgaataccatctcctcagtgaagccggtactgaaaacgatccgcagtttaaagtcagcgtcagcgtaaatggcaaaccgattgctcaagggatcggcagctcaaagaagcacgctgaaatgcaggcggcacaggcagctttgaatcagctgcgcaaaaataactaaaaggcagggaatcccgatgcgcttattgtcgcttacgttggatggctttaagtcatttgcccaaccaacaacaattgaatttcgtccgggaatgaccgggatcattggccccaatggcagtggaaagtcaaatatcatcgaggccattcgctgggttttgggtgagcagtcggccaaaactctgcgtggtaataaaatggcggatgtcatctttaatggttctgaagaccgtgcgccattaaatcgggcactggtttcgattgcctttgacaacagtgatcattatctgaacagtgatttttccgagctcaagattacgcgcaagctgtatcgaaatggcgacagcgaatatttgatcaacagtcagcaggtgcgcttaagagatattgttgatctgtttgttgactccggcgttggtcgcgagtcgttctccgtgatctcacaaggccggattgctgagatttttaatggcaagccagccgatcgccgtgccattattgaaacggctgctggagtatcaaaatataaacaaaataaggcaaccgctgaaaaacgcctggatacgacgcgagaaaacctcaaccgggtcaatgacatcgttgccgagctggaagatcagctggagcctttagccgagcagagtgcgttggcccaagactatctggagcaaaaaggcaagtttgatctgcttgacaagaccaggaccgtccgtgagctggattcgaatcaagccgcgctgaaacaaatcgtcgtcaagcaggaaaaagcacagaccatggcagctgaatatgacgaacaggccaaggctgccgcgcaaacattgtcccagcaacaggcacagcaaaaacggctgttagtcgtcaaagatgagctgcagcaaaagattctggatgccacgacgatcattggcaagcttaatagtaaacagtcgctgtcctctgtcagacttgaacagcgcgaaaatgaaaaacagcgcctgcttgcccggcaaaatgagcttaaacagcaactggctgcaactgaacaggcacttctgcagcaggatcaggcaattgccgatcagcagcaggcgattaaggaacatcaaacagcgcttaatgaggccaaatcgcaaagtgcggaacagcgcgcgcagcaactggctcagaaactggaatcaatgcgtgatcagcaggttgatctgatgcagaaacaagctgcggcccataaccagcagacgtttttgcagcgcagccatgaacaggccctcaatcagtatcagcagcacagcgatgaactgaaaaacgtgcaggaacgcctggaaaatgctcagcagaatgctgagcagcaggctcagcttgtaattgctgctcaaaaagaacagcaagcaaaaacccagcagctcgatcaggaaaaagcacagcaggcccagctgcaaacgcagtatgaacaggttcaacagagctggtatcaagcgctgggggatgtgcgttcgtgtcaaaaccgcgtgaaaaactatcaagcaatggcggccgactataccggctattacagcggcgtgcagaacgtcttaaggcagcggcaccagtttaacggtttgtacggtccggtcagtgagctgatcaaagtaccgcaagcctatacgacggcactggaaacggttctgggcgggcagctccagcatttggtggtggccactcaaaacgatggtaagcagattatcaactatctggttcgtcagcgcggcggccgggcaacgattctgccattggatacgctgcgtggcggttatcagcctcgcaatctggcacgcctgcgcacgctgcctggctttgtcggtcgtgccagtgagctgattcagtatgatccacgctttcaagtcgtaatcgatcatctgctgagcaatacgatcgtggccgataatcttgatcatgccacgctgcttgccaaagaaggccagcaccaggttcgcgtcattacgctggatggtcagctgatcaataccagcggggcaatgactggtggggccagccgcagtcagcggattggtctgttaagccagcagcagatggttgaaaagatgaaacaagagctgcaggtacaacagcagcgatccagtgagctggaacaaaaagtatcgcagctggaacaggcaaggcggagcaatcagcaaacgctggctgctttgcagagtgaaactgcccaggccaatcaaaaactcagtgaagccaaggccaatcagcagctcgctgacagtcagctggctgagcttaagcgtcagttgaaagctttggactaccaagccaatgcagccggcaacccagatcagtttgcccaagagatggccgcagccaagcaaaacgaacaacagctcgctgatgaactgacgcagcttaaggtcaccatggagaagatcaagcagcagcaaaatgatctgcagaacaacgccagtgcccagcttgaacagcttcatgaaatgcagcagtggctggccgtggcgcgtgaacggctgcgtcaggctaaagagcagcgcgcggaactgcagacgcgtcaagagaatgccaatgagcagctagccagtctggaacagcaattacaggcgctcgaccatgatgatcagctgcaggccgatgatcgccagacaacggccgccgcattggctgaggctcaacagcagcttcatgacgcgcaggagcagttgaaagccagtgatgaaaaactgacgacgctgaatgatcagctgcaggatgccaatgagcagaacgatcggctgcaggcattacagcgcgcagctatcgaagatctttctggcatcaagtcgcagcgagcccgtttggagatgctgatcgatcaaggactgaatcgtttaagcgaaacctattcaatgacgcttgccgatgccagacaggagctcagtccgctgcctgatgatgaattgaaccggcagctgaagcttttgaagcgcggcctgaatgagctgggtccggtcaataccggtgccattcaggaatatgaacgtatttcggagcgctatgacttcttgtctggtcaaaaagccgatttggaaaaagccagagatcagcttaagaaaaccatggatgcgatggatgaacaggttaagacgcgctttatcaagacttttaaagaagtatcggccgcctttaccgaaacgtttgccatgatttttgaaggtggtcaggctaagctggtgctgactgatccggatgacgttttgaccagtggggtcgacatcatggcccaaccgcctggcaaacgcaatcaacagctgagcctgctttctggtggggaaaaggcgctgacggcaattgcgctgctatttgccatcttgaaggtgcggccggtaccatttgccattttggatgaacccgaagccgccttggatgaggtcaacgttgatcgatttgccaagtacctgagtcgtttcggcgaggatggcccacagtttatcgtaattacgcaccggaaaggaaccatgatgaatgccaacgtcttgtatggggtcaccatgcaggaatccggggtttccaagatggtttccgtcgatgttgaagaagcactcaatagcgatgatcgcaattaggttagaaagaaggcgtaaaaatgggattatttgatattttccgtcgtaagtccaagcagaaaaaagaagaagcccctgaatcagcggccagtgaaaatgctgaaagccaggctgctgccagtgaaagtgcagccagccaaagcacggcagctgaatctgaggtaagtgaaagtgcggccagccaaagcacggcagccgaatctgaggcaaatgaaagtgcggccagtcaaagcacggtcgctgaatctgaggtgagtgaaagtgcggctggccaaagtacggtcgctgaatctgaggtaagtgaaggcacggccggtcaaagtaccgcaattgaatccgaagcagccagtgcggcaaatgatcaaaaagaggcggctgctgaaattgacgatgcaacggcagctgccatgcaggaatcggccacggcagccgaagaacaagctgctcaatctgatgccgcgcgtcaagcagaacaggctgccattgaaaaagcacagtccgaagccgccaagcaaagtgccacggccgccgaggaacaagccgctcaatccgatgccgcgcgtcaagcagaacaggctgccattgaaaaagcgcagtccgaagcagctaagcaaagtgccgctgccgctgaggaacaagcagctcaggttaaatcggctcagtcacaagccgcatcagaagccatcagcgatgaaaaaacagcagaacaggtcgccacgcagtctaccagcgttgaaaataccagttcaactgcagctgatgagcgcgcggctacagagacggttaaaaaagccgcggcagctgaagaaaccgttgaagaatcagccaagacgtctgaaccacagtcagccgctgaccatgattcagccacggcagttctagctgaaacggacgctacggttgagtcaaacaacgaaaacaatgaagcagccgtttcgacatcccaagacgaagaatcgacgactgaaaaatatgatcgcggtctgaaaaagtcacggaccggctttggggccaaactgaatcacttcttagccaatttccgccacgttgacgaggatttttttgaagacttagaagacctgttgatcgaatcagacgttggctatgacatggcgatgaaaatctctgatgagctgcgggaagaagttaagctgcaaaatgccaagagcaagcaggatgtctccaacgtcatcattgaaaagatggtggatctgtatgaagatgctggcaaggatgaaaacccggatctgaattttgctaaggaaggcccaaccgtgatcatgttcgtcggggttaatggtgccggtaagacgactacgatcggtaaaatggccaagcgctttaaggatgaaggtaagcgcgtcctgctggcagctggtgacacgtttagagctggggccgttgagcagctggatgtctgggctaagcgtgatggcgttgatatcgtcatgggtcctgccaatggtgatccagcagccgtcgtttttgatggggtcaagaaggccaaggaagaaaactacgacattctgctggttgatacggcaggacggctgcaaaacaaggtcaacctgatgaacgagctggccaagatgaaacgaatcatggctcgtgagattccagatgcgccacatgaggttctgctggtattggatgcaacgactggtcaaaacgctctgaatcaagccaagctgtttaaggaaagcacagatgtttccggaatcgtgctgaccaaactggatggcacggcgcgtggtgggattgtcctggccattcgcaatgagctacatctgccggttaagtacgttgggctgggcgaaaaggttaccgatctgcagaaattcgatgccagcgattttgtctatggactgttcaagggcctggttgtcgaaaaataagaggtggcggccgtggatatcgaaaaaaacgagcggatcaacgcgctgtttgagttttatcagccattgctgaccaaaaagcagaacgaatatattcagctttactatgccgatgactattcacttggcgagattgctgaaggatttgaagtttcgcggcaggcggtctatgacaacatcaagcggaccgaaaagattctggaaagctacgaggacaagctgcatctgtatgccgattttgagatgcgcaatcgccaggcagatcgaattcagcgctatgtcaaggagcattatcctgatgacgccgagctgaataatctgattgccaacatggaaaacatggaagaagaataaaataagctggccggttcattttgagttggctggctttttggtataataagaaatgtttgaactataaattaaattaacctcatcgattgcgattgaccaagcacgatgaaaagaggagaaaaaaatggcatttgaaggattgaccgatcgcctgcaaaaagcgatggaaaaactgcggcgtaagcctaaagttacggaagccgatctgcgcgaaaccatgcgtgagatccgcttggcacttttggaagccgacgttaactttgctgtggttaaggactttgttaaaacggtacgcgaaaaggcagctggggctgaggttctaaagggcttaaatccagcacagcagatcgttaaaatcgttaatgaagaattaaccaagctgatgggtgaggaagccgtcccgctgaataaagcaccgcacattccaaccgtaattatgatggtcgggctgcagggtgccggtaaaacgacgacggccggtaagctggcactgcgtctgaaaaatgaagaaaacgctcggccaatgtttatcgcggccgacgtttaccgaccagccgcaattacgcagctgcagcaggttgctgaccagattggcgtgccggtatttgaagaaggaaccgaaaaagatcccgttgatatcgttagagacgggatggaacaggccaagcagaatcataacgactatgtaatcatcgatacggctggacggctgcagattgacgagcagttgatggatgagctggtcaacatcaagaacctgacacagccaaatgaaattctgctggtcgttgatgccatgactggtcaaaacgcggttaaaacggcgcaaggctttaacgacaagctggacatcactggggttgtcttgaccaagctggatggcgatactcgtggtggggcggccatgtcgattcgagccgttactggcaagccgatcaagtttgttggtgaaggtgaaaagatggaggatctcgacgtcttccatcccgaccgtatggcttcacgaattctgggcatgggggacatgatgaccctgatcgaaaaggcccagaagaattttgatgaagaaaaagcccaggaaaccatggacaagatgcgggccaatgagtttgacttcaacgactttttggagcagatggaccaggttaccaaaatgggaccactggagaatattttaaagatgatgcccgggatggccaataatcccgctttaaagaacatcaatattgatcctaaacagtttgcgcacatcaaggccattatcttgtcaatgacgcctgaagaacgggaaaatcctgatctgatgaacccgagtcggcggcggcgattggcagccggttctgggcggccaatcgttgaggtcaaccggatgattaagcagttcaatcagatgcgcaaaatgatgaagcaggttaccaatggcaattttggcggcctgcagaacatgatgggcggtcagatgcctggcatgggcggcaaaatgggtcaaatggcgatgaatcgcatggcgcggcaggctaagaagcgtcagcagcaaaaactgcggaaactgcgcaacaagcacaagcgccgctaaaatcagccaatcaaaacttggttggcgatataattcaatcctgagcagttttctgttcagttaataccctgtctcgataatgaggcggggtttttattttggtaatgagatatttggtgctcacagactggcaaaagagattaccaaatcaattcactaaaaaatctgtctccaaaaactccttgtgtgccaaggctttaggcagattgatgaaattattttatttttagagcttgcaaaaaacaaaagctttggtattatttagttagtcacttatgtaattaactaggaggatgaatagggagggttggtcatgcaatttgaatttgaccaaacggaaccaatctatcaacagattgccgatcagctggaggacatgatctttactggtctgttgaaggaaggtgaacaggcgccttcaaccacgcagctttctcaagaactgcacatcaatccggcgaccgtgctcaaaggaatgcggcagctggttgatcggggactgttggaaaagcatcgcggcttgggaatgtttgtcgcagcgggggcccaagccaagatagtcgaaacgcgtaaggacgcattttatgaaaactatattaaaagcctgctggaagaagccggtaagctgggaatcactgaagagcatctaatcgaattgatcaaacgggggtatcaagatggaaacattaaaggttagtcaaattaccaaaaaatatggtcggcagacgattttagacgacatcagtctgacgattcacccgggcaagatttacgggctgttgggacgcaacggtgccggtaagtcaacgctcttgaatctaatcgtcaaccgaattctgccaaccagcggcacgattaaattgggcaacgatgagatcaatgacaatgacgcggcattaacgcagttttatctgatgagcgaggtcagtctctatcctaaacacgtgactttaaagcagatgtgggaaatggcagacctttcttatggcagctttaactttaatcgggcacggcggctgctaaaggagtttgatattcaagacgagaacgtaaagctgagcaatctttcgacaggtctgcagacggcggccaagctcatcgtggcattatcggtcaacgccaattatattttcttggatgaaccgattttggggctggatgccaaccaccgcgatgttttttatcaagaactgctcaaggcctatgaagaaaacattaagacctatgtgctgtcaacgcacctgattgaggagatccagcagctggttgagcatgtcttcattttggataataaaaaaatggtcgttgatgctgacgttgaagatctgttagacgagatgtttgtaatcagcggtccggcaatgctggttgaagagtatgttaaggatcaaaacgtactggggacacgtgatctggcaggtatcaagactgcttttgtccggggcgtacttagtgaaacaaaagcgattccggatcaaatcaaaattcagcatccggatctgcagcaggcatttgtctatctgacgaacaaatagggggagcattatgatttcagcaaaacaaaaactcgtgattcgaactgacctataccgctgcggcaggggctttgtgattgccgcaatctggctggccgcaattcaagctttctttgccattgtcaacctgatctttggaggaattagctttggtgacttattggatgatctgcgcgggatctttagcggctggacgtttattgccagcgttacgccatttgtttatttcttgatcacgccatacagcaattttaaatggacgattcaaaacggtatctcacgcaagactttgtggcgctcgcaaatgatcagcgccgtagtaatcacattgatccaagaactggcaattattattttcaacttcttggcaaacggttcgctatctgagaaaatcatctacaataactcaacttcaatttggtggggtctgttgtttgagctgctgctgctgtttgaaacaaccatgacggcaatggcaatcggttatttctttagtctgctgaatcgcaagtggaaagtaatcgttgcaatcggcggcccgattctagcggtattctgcatctactacctgacgcggttgctgatcaaactgggggtcttccagtttattggatcaaactggtcaatcgatttgactggtcaggcagctaaaacggcaattattgttacgctggttgtctcagcaatcgtttggacgcttttgatgatgctggtctcacgcatcagtgccaaacacatgcagctgcggcgcgactaatcattaaacgatccctgccgatcaatcaagcagggattttttgattgatagtaaataaaaatcggatcgtgctacctagataaaacttgaattgcttggcgtgaaatgccgtgatttcaacggttttgattggctgaggacttatggattcaaggaaaagaagacgaagatatgcttaaaaaagatttttttgaaaaaagtttagcctgtcaagaaaaaatactttacattcacttgaatgactggtatattattagctgttagaaaaaatcaaggaggtgtgaatcaatgtcagtaaagatccgtttaaagcgtatgggttctaagaagcgcccattctaccgtatcgtggttgccgactcacgttcaccacgtgatggccgcttcatcacgacgctgggtacttacaacccactgaccactccaaaggaagttaagttcgacgaagacgccgttatggactggctgcaaaagggtgcccaaccttcagatactgttcgcaacatgttccaaaaagcaggtatcatgaagaagctccacgaagccaagtacgcttccaagaagtagtggtaaatagtcatgactgagacaaatctagagacactgattcgtaccctggtcacgccgttggtcaagcatccggatgcagttcgcatcaccgaatcagagactgatcggtatcaccggtacgtcctcgacgttcatccggctgacgtcggtcgcgtgattggtcggcagggacacgttgcttccgcgctgcgtaccgtagtcgaaggcatgcgttctaagcggcccaactctaagaaagtccggttggtgattaatgaccatcgacattaaataaaaactcccacaccaaccctgtgggagtttttctattattcggaggatttttaaatgcaatattataatgttggtaaaatcgtcaatacgcatggtattcgcggcgaggttcgcgtgattgccacgactgattttcctcaagagcgtttccaaaatggcgccatcctttacctaaagcagtctgccggtgagccattacgcctggaagttgccggcgcgcgtcagcataagggaatgtggctggttaagtttaaaggctacgacaacatcaatgacgtgcagagtttccgtgaccacgagctgatggtgactgaagacgagcagcagcctttagaagaaggtcagtactactatcatcagatcattggtttgacggttaagacgctggaaggacgcgaattaggcgtgatcaaagagattctttcgccaggtgccaatgatgtctgggtcgtcaaacgagccggtcaaagcgatcttttattgccggtaattgatgatgtggtcaaaaacgttgatctggacaagggcgaagtcgacgttgaattaatggaaggactggaataatgcgaatcgatgttttaagtctgtttccggacatgtttaagccgacgctgggtcagtcgatcgtggggcgggcccaagacgatggctttttggatattcatgtaactgattttcgtcattttacgactgacaagcacaatcatgtcgatgacgcgccgtttggtggtggtgccggcatgctgctgcaggctcagccgatttttgatgcgatggcggccattgatgaagaagcacaaaaggaaaactatccgaaaggccgtgtcatcttaatggatccggcgggacgcaagtttgatcaggactatgctcaggaattggcccaagaagaacacttgacgtttatctgtggtcactatgagggctatgatgaacgcattcgccagctggtaaccgatgaagcctcattaggtgactacgtactgacgggcggtgaattggcagccatggttatgattgatgccacggttcgattcgtgccgggcgttttgggcaatatgtcttcttcaatgggcgactcgttcagcaatggtctgctggaatatccccaatacacgcggccagctgagtttcgcgggatgaaggtgccagaagtgctgaccagcggcaaccatgaaaaaattcggcagtggcggatgtatcaatcgttaaaacgcacctgggaacgccgaccagatctgattgaacagtctaaactgtcccgtgagcagcagatcatgcttcaagacattaaattgggtgaagacccaacgatgcagtaggcgacgcgcatgattaagaataagtttttaaaacgactgctggccaaagaagatccaaccgtctatcagctcaaggatgcatcgctggaaccttcattgacgactttggatctgatcggtctggggacggggatggtcgtaggcacggcgatctttaccttgccaggaatcgtagctgctgagcataccggaccagccgtgccattagcgtttatcgtggcggcaatcggagcgggactttctgccttggcctacgcggaaacagcctcagtgctgccgtttgccggttcggcgttttcttggatgaacgtcttgtttggcgagttttttggctggatcgcgggctgggcactgctggcggaatattttatctccgtagcgttcgttgcctcgggctggtcggcgtatatgcagggctttttgggcagtttcggcgttaaattgccagttgctctgactggtggctttaatccggctaagggctcgtatgtcgatattttggcggcgattgcgatattgatcgtcggctgcttgatcgcacgtggcattcatcaggtcagccgcgtcgagaatacgatcgtggccgttaagctgatcgtgattatcatgtttgtcgtgattggcgcgactgccattcatccgcaaaactatgtgccgtttattcccgcgcaccgaccaggaacgacttttgggggctggcaggggatcttggctggctcttcgcagatttttattgcctatgttggctttgatgcaattgcggccaatactgctgaaaccaaggatcctcagcacacgatgcctaaaggattgattggcacgctgctgttggggactggctttttcatcgctgtctcactggttttggtagggatgtttaaatacagccgctatgctaataacgccgaaccggctgcctgggcgctgcggcattcaggtcattatttaacggccaatctgctttcggtagtagccttgattgggatcttttcagccttgatcgcaattctgctggcctcatcgcgtttgatctatgcgtttgggcgggatggtctgctgccaagccggctgagtcatattgatgataagcatgttcctgatcacgcattatggctgatcacggtgctggcgatgattcttggttcggtattcccatttacgtttttagcgacgctggtttcggccgggaccttgattgcctttatctttgtctcgttggggatctacgcgttaaggaaacgggaaggcgtcgacctgccggaagccaagtttaagatgccgggctatccggttttgccagccatctcggttgtctattcaatcgttatttttgctggtttgaatattgatgccaaattactgatgatcggctggttcgttattggtttgataatctactttgcttatggaatcaagcattcaagcctgaatcagcagctcaaaaaggttgtcaagtaatttacccttgcagtcgccaggggaatatgttatattatgtcttggctttttatggccataacaacggtattccgctgctgaaatcgggcaagaatatcgacgaaaggaaaaaatattatgcgtcaaaaccaattgattgaaaagatcaccgccagccaactgcgcgatgacattccagaattccgcgccggtgacacggttcgcgtccacgccaagatcgttgaaggtactcgtgaacgtatccagatcttccaaggtgtcgttatcaagcgtcacggtgcaggcatttctgctacttacactgttcgtaagattagtaacggtgtcggtgttgaacgtactttcccagttcactccccacgtgttgctaagatcgaagttgttcgttacggtcgcgttcgtcgtgctaagctgtactacctgcgtgaacgtactggtaagtccgctcgtattcctgaacgccgtcgcgacgttaagtagtcgagtgtcgaccaaaacccttgctgtgcaagggtttttctttttgccagatttttaaaatgctgattgagtttgtgaatttttgccctgtttgcagttctaagtagccaataagtagccaacttgtcacaaattttccaattgatcacgatttttcacaagcacttcgtgagtaacatgagtgtagatttcttgagtaacccggctgttagagtgaccaacccgctgctggatgacatacatcgatacactgttctttcaatctcaaatgcagtgtatcgttttttgttttagcatcaatggtctaatattactgttgataaaaaacaaaagcctatgaactagattatgctgaagagatgactactcattatgaaagtgcaacgtataaatttattttaggtgctatcgagcgggacaattatcctaaatttgcttttgatggctggtgttaattgacggggtacaacaatccgctttttaatttcttataacctggacatattgttaaactgttctttctgtatgcaatcaattctcgcgggtcgtaactgaatcaacagttaatgacaaacagatcgcaatgaaaacgaattaacaatcacgtcaataccacatttgatagtcagtatatattggcacgatgctatatgggcaaagaattaataattagttttagtagatttggtgattattatgaatttaatccgatctattggcatctgtgcagccattaacggtaaaaatactgatgctactaggatgaaagcccaccaatcaaagaaaagatgtcatgcagtgcctgccttgccaaaggagttgccgaagaatgaaaataacaccgaaaactaatctaggggatgttaataataattttgctggttcatgggtggctgttcatatgaaagatggacgcacattgcatttatacattgtaaatacggatgatgaattccaacgcaacgatgaagatgatgagcctaaattaaatgccattatctataacacaactggcagcaattcgtatggaaatggaatagcttttgacgatgtcgattcgattgagttagatgataatcactaatattgacagacatctggtaatgaagttaaggaaacggaacaacttaggaaattgtatgagcgtaagtctaaagaatggagtgggaaaaatggaagtgattgataaacaatttttttctcaaaagaatatcagcgtgattacaattccatcgattaatattaaagctggacaaactttaagggatgaacttggcaatacgtttgaagtttctgaattggttcctaatggtaagttggcattgtctggtaaaagctcattgatagttaatggggaatttaaaggtaatacattagaaattgtttaactgaaccaagttttagaagaaaggcaggcaaaaatccgtggttgaatggtacctagtatctaatacagacaatgaggttacgtatcgtatggttaatggcgacactcacaaaactataggaaatatgactgttaacaaagaaacaaaagcctataaattggattatgctgaagagatgactattcattacgaaagcatgacatatgattttattttaggtgctatcgaacgtaacatttatcctgattattcttatgatggttggtgctaatgacttatgtatctatcgcgggtcgtaaccgaatcaacaattaacgctaaacggatcgcaatgaaacgtgaattcctaaaagatcttgggtaagcacacagtaacaacacgtattccaaccgccacacggaccacctatacttgaggaaactcatatataggaggccttttttgatggctcaaaatgaaatcgttgaagtcagcgccgcttcaacgatcgcaagactaatcggtgcgtattagtagcatcacttttgattcagaaggtacggctcaacatctatcaagatgctgggtctgctaatacggctgtcagccaagcttaagagcaaacaaaaaagcccacagcatgatactgtgagataataaaagagcgcccagccagcttgtaagttaggaagcactcactgcacacggcttagtatttatcacaaagtcattataacatactctgattatgttacattaataaagcacacatgagcaggcttaggaaacctaacttgtgctgaaaggagacaactcccaatgtggcatttgtgcttagtatttatcatcgtgcctaataagcacgttaaaaattaattaagcgactgtccaagtagcagtcaccagcgctcatcagtttggatactgattgggcgctttttgcttatcaaaattctggtaatgtaaatgacaagcaaccggtactcaacgattagaggtagtgatattatgacgatatctgcgactactcataaatcgccatcttaaactgccataattgtacattttcaaattgccatttctatacaatttttaactgtccctgacatctttcacttgatggtaagtatgatgttcatattcatatttcccagatgaaagaaatgcaagcaaatatttggacggaaaatcgtactaagaagtatcatgcttttgacaatctgattcagcaaaagctcaaactggatctgcatggtcaaaaagtcggtgtcgcgattggcaatggtcaaaacggtgagatgctcaaagaagtcgtgaaaagctaccatgggaatcccaagctgatcgacgccttctctggcaaacgcaagacgctgcgcaaacagaccaagaatctggacatattgattttggtaacggcctatgcctcgcatccatcttcttgggttttgaatgaagcctgcaaggactatggcattaagtttgccgtcagtcccaagctagccgtttaatcattcagcaaggtactttaccgggctgagcatcatctgacggcttttgagcaggaaaatcaggaagttgcgtattcagttacttaagcaaaatagtgcaaaatgaaaatggctcaatcgtggttgagccattttcggtctttattgataattactgagcattttttgcagagtcgtgatcatctgttccctaaaccaatctggctcaagtaccgtaaccatgtctttttgactaagcagccacatcatcgcgccggtatcataagcttcgacttcaatgactgctggctgctgatcagttttttcttgaactatttttgaaagcgggaatttatccagagctgcttcaacgacaccgcggtattcaaaaagaatcgtaacgtttttaccgggatacatcagctgcagctttttcttggtcagtccctcattccattgatgagcctgccattcggattgtgggatgcttttttgtgaaatgtgataatcaatgatgcgatccaaacggtagataatgtttttttgatatgtattggtgtagccgatgaggtagaaatagttgtcagaaaacgtcagcgccaacggaataatagtgtgcgttttgatatggccagcctgattgcggtagtcgatacgaatggttcgatgcaggagagtatattccgaaaagttccagatcagattcatcaagtctttattttgaagattgcgcagcggctgatacgtgcgttgctcgcttctaatcaattgtttgactttttgagcatcttttgcgtcgagaattttcaaaagacgattggaaagctcggttagctggtctttggggagggcacgactggcggttagaatcttgatgagacaaagacactgcgccttatttaagccgatcccgttggcagacagccagtaggaattgttttgacggtcataattcagcgtgtattcgggcagatattcgtccataaacgctcgcaggctggcaaaatctcgctgaatggtccgcgcgtcaacggcaaactgtgtagctagctgtgatttttgaatatgacggccggcagtcaattgctgatagatgaaaagctgccgttcactgaaagctattaggccggaaaccctcgactttagtcgggggaggaaggccaatttataagcaccaaaaaggtgcttttttatttttaataatcagatattttctcagctttttataatataatgtttgcagtgaaagcgaggtgagaaatatggaaagtggtgtgacaattaaaataaaactcaagcttccaaatgttgaaactgctgcaagttttgaaaaaaccatggaacagttccgtttggcttgtaattttatttctgaatatatctttaatcattctttaggtgaactaaataaaaataaaatccaaaaagcaatttatcgagatgttcgaaataattttggcttgaagtcgcaaatggctatttcggctatccgttgcacagttgatcgatacaaaacagttagaactcagcttaagaaacaccctatgcggtataaatctgatgatactgattcgcagactggtaaaagagtttggaagtgtatttcgcgtgatctttattggctatggtatcctatcaatttcaagcgtccacaggttgatttgcagcgtgggaaggactggtcttatttaaaaagtggtcaattgtccattaacacgcttgataaacgtgtcaaagtagattttgattgtcatggttttgatcaatatcttgacggtacttggaagctgggcgttggtaagctgcttaaaagccaaggcaagtggtatctgcacatcagctgtaccaaagaaattgatgaatttaatgatcaaaacattgaacatgttgttggtattgaccgtggtctgcatcaaatcattgctgcctatgatgaacaaggtagaagtttgtttgccaacggcaaacagatcgccaagaaacgcaaccattattatcaattgcgtcgacacttacaaatgaaaaacactagaaattctaaacgtcgaattcgcaagattggtaatcgagagaaccgttggatggatgatgtcaaccattgtctgtctaagacactcattaaccactatgggaaaaatacgctgtttgttttggaagacttaagcggtgtttcatttgatgaagacaatcaaaatagtaaagactttaatcgtgacctccactcttggactttctatgatttagaaaccaagctaacttataaagctcagctcaatcacagtaaagtaattgagattgatgcccactataccagtcaaagatgtcctaaatgcggccgaattcgaaaagaaagccgtgatcgtaatttgcacatgtatatttgtgataagtgcggttataagtctaacgatgatcgaatcgccgcaatgaacatctataatttaggcacattttatgtcagcggtgtagaacacccaacttaccagaataaattagaaaaaattaaaaataattagtctagtacgtatacgtgttagactgccgtatctgtcaacgtgcggaagtgctttggcacttgagaagcgataacgtagaagtcttcaagcttcgactttgggagaactcctttggaaattcgtctgtaccacagttagttaatcgcaagccaccggttttaaccggtggtagttgattggtagttgatttatatgttttcatggaatttccctaattttttatttatattttcatgtagacaaaatctgtctatgcgatttgagataattataaatagaaagtggaatgtaagcacatcatagtaacaaggggattatagccttccataacgatatatctgagttgagcatatcaaaacggccctgacgcaaaacttgcggcagggtcgtgctgttttagatgaattttgagacagccagctttaaaattcaattcgcttctggaaaatcggctgttgacgcaggtcgtaaatcgaaccggcaattggcgtaatggcaaatggtcttaaaatgctgcgccgttcagaatggtttgccgaaatctgctgcatttccggtcgagcggtaaaaatctgctccagatactgctgatcaacctcagctgccgtgccggttaaggtgaagccaacactgtccagagtttcgctgccttttaaagccgtgatcgagatgcgggaatgagcctttaaacgttgataaaatggtttttgataggtcgtcgcaaagatcagctgtttgccgtctaaaacctcgatatcagcgacgttggtgtggggatcgccattttgatcaaccgtaccaaacacaacggactgaaaactatcgacaatcagcttgagaaattcatcgcctgacagctggcggtctaacatgggaactggtttgcgcattgtgatacctgctttcttttatatttttgcgttaattgtaatcaaaaacattacatttgtatataatcaaccgcggcaaatcgtatcaagatttcttgctaaaagcacaaggcaggtgatttcagaaaaaatttgccatttgccaaaaaaagtacttacgaaactgggttaatctttgttagaatggcaaacatgctgattaagattaagagttagcgttaattgaatacattaaattaagtctgcttgctgtttggtctttaatcaagtgaatttgattaaaggagcaaattatatgcaaaacttttctgaacctgcttttcgcgtcaaacatccggggctgacgatggccagtctgcttttaggcgcttttgtcggcatgtttagtgaaacgtcactgaacattgcgctgccaaagctgatgatcgtctttcataccagtacggccgttttacaatggctggtgactggctacatgctggttattgggatcgtcttgccgctgtccagtttgattgccaagtggtttacgactcgtcagattgtgatttttgccctgctggatttcattatcggtgcggcaatttcagcaatggcgcctaactttgcggttctattggcgggtcgaatgattcaagggattggaaccggtctgattctgccgctgatgtttacgattgcgatgcagattttcccaccaaaaaagattggtagcattatgggaatctgcgctttggtaatcatgtttgccccggcaattgggccaactttgactggtttgattctggccaagctttcctggcgctggatcttttggtcgtttgaaattttcttggttatcgccttgtgtctggcggtaagtgctttggaaaacattggtcagccaacgcgtcctcacattgatctgctttcaatcgttgaatccgtgcttggcttttctggcctggtagttggtgcaagtctgtccagtctggatggctggggttcttggccagtcttaggctcgtttgcagttgggattttggtattgattgcctatgtaattcgccaattgaagcttgaaacgccaatcttaaatctgcgcgttttcaaggttaaggcatttacgattggtgctgtattggtcatgcttgattttggtattattctttcggccatgtatctgatgccaatgtatctgcaaaatggcttattgttagcagttgccttaactgggatcgtcatgttgccaggtggtctggtaaatgctttggtttctgcgtttgctggacggatgtatgattcaatcggggccaagcgtccagttatgattggctttgtgattgccattgtagggatcgtcatgctgcttttgacgacggctcattccgcagttgcctatgtgattgcggctcacgtgatattgatgattggctgtccattggcaatgtcaccagtgcagaccagtgctctaaacgcattgcggggaccagcttccagtgatggtagtacgattttgaatacgatgcagcagatcgttggggcattggcaactgctctggctaccagtttcttggaattaggccggcatgcggcagctggcagtcaagcgatgcgttttacgtccggggtacacacgggactttactttacgctggctttggcaattatcgcgctgatcgtatcgtttagtttgcctaaacaaaatgcagattagtagtaactgttgaaataacaatattattttttaactgaaattgaccctcatcttcaagttttttactgaactttgaagatgggggtcaaattattttagccatcaatatttgacgataacgacataaagtgatattctattttatgttgataacgacatttatgaaaggcggaaataattatggcaaacttaaatcatatggacaaacaattcaaaacgctggatgacttcttgggaacgcatttcatctatacatatgacaatggctgggaatacgaatggtatgctaaaaatgatcacacggttgactatcggattcatggcggaatggttgccggacgttgggttaaggatcagccagcgcacattcatcaattaactgaaggaatttacaagattgcgtggaccgagccaacgggaactgatgtcgcattggatttcgttcctaatgaacataagcttaacggtacgattttctttccaaaatgggtacaggaacatccagaaattacggtttgcttccaaaatgaacacattgatttaatgcatgaatcgcgtgaaaagtatgaaacctatccaaaattagtggttcctgagtttgcaacgattacctacatgggtgatgctggtcaggataatgaagaagtcatcaatgaagccccttatgctggcatgactgatgatattcgcaatggccgcttctttgacgaaaattaccatcgtctggctaagtagcttgttatataatgttttgcagaatcagataaggaaggatgctgcaaaatgccgcaaaaaaggatactgccctacgttattatggggatcctgctcaataaagactgtactggaaagcagattatggatgagtttcgctttgatattggggaattttggcaatcatcacatagtcaggtttatccagagctaaagcgtatggaacaagatcgttggattgaaagctactcaaaagaagataatgataaagagatacactaccatttaacggcttatggtcatgaaattattaatgactggttgatggaacccgttgataagctgccggtatccaaagacctattttctttaaagacttttttcatcaatgatcgtaatgatccaagactggaaaaattgtttaagcaccagatccaactggttagcaacagccttaatcatctgcgcgagcgtcgacaagcattattcagcagtcaagaacagattgatcaacaatatggtcattatttgattttggcccgcgcaatcagtcgccaagaaaatcaattggtttggctggaagataaattgaataatcgttaaaaacaatgaaaagaacaatcgcgtgctaccagttttttcgcagctggtggcgtgcgattgttttttattttgccgcaatctggtcgacaaacgctgaaattcatcaaaaataaaaatgcatttccgcttaaaccgtctaaagcatttataaggacactgatagatgatttgagaaaggaagccggaaaatgagaaaaaagctccaacaacttggtccccaaatgcgacacgtgttcatcggccggtttgagcgcgttggctataaaaaaagctaccgttactgtcggccaacgcttttgctcacccacgttgctttagccgaaactggagaactgattactgatcatttatggctcaattatacgaaaggctttttagatttaggcgaactgttaactggtgacctgctgcgattcaacggtcgagttgccagctacgtcaaaggttattttggcacgtcgcaaaaacttgactacaaggtagagcggccctcgcaagttgcgctgcaggccaaaattgagggaccacgccgcttgctgcctgacactgctaccaaattcggtcgtcaagcactgattggctacattatggaacgggagcgcgcgttttacgaggccagctgtcgtccgattgatccgtactatatcgagcagtatcgagtctggctgaccaatcacgttatgaaaaatgcgcaaaactatgatattgtcttgcaaaaacaacttactggagcatctaaaaagcactgagccgcattgagcagttcagcgcttggagatcaaggttgtcagtatttgattagtttagggcgttgatcaagttgtccagactggtcagaatttcagctggcagtttttcgcccgtgtgctgagcttcatagttcttaacccagtcgcgccggatttcaaaacgcgtcttgagcttggttgcgtattcagcatcattaaagtcaactggatagccgtcgtaagcaatgtattccatgttggccagctcgccaaatggcttaaaggcggcctggttttgggcaatgtcttccaaagccttcaaggtcagttctttagggatgtccaagccgttaaagttggcggtattgacgatgtagcagtcaacgtggcgttcttcaaacagtgccttaaagtcttgatagtcctcgtttaatgggtaggcgcggaatgggtcggcaaatggttcgataaccaaagcgttgcggtcagcgcccaccacgttttcggccgtggaacgcttggtagccaacgtcagaccaaacgtagccgcggtaacgggatcggtcagtttaacgactggcggcagactgtcatctttcataatccaaaagacggcattgattggggcaatttcgcgatccacccggttggtagaggcatagcgcgtcttaatggtccggccattgccgttgcgcagatcctgggttaccagtactttttggccggcttcgttaagcgtgacgccaacgttcatcaccgtagtaaagtactgcatttcgaggctgcccggcagataatcgttggtcttgtcaaaataggcgggttcaagagccgtggagctgccgtcctcacgattgattacgaacgcatcgtcatgcagcacggtaatgtcgaacttgccaccatgcttagcgtgggtcagcgtagacttgcctgatccagaaagcccatagaaggcaaaagtctgatcatcacgatcgctgaagtggaaagtcttttcgccaccgtgacaagccgtaaaaccatgtcggtgcgcggttgcccaggccagcgtcaaagtagacttcttaagctcgccaaagtagcgcagccccaaaaccgcggccgcattgtgctgagcatcgatgacaaccaggccatgtggatagtcaagattgctccagtatgggtcgcagtacagatagatgtcgccttcgtcataggcccgtgaatcggcatagcgcttcagccaattttcggtagctgtttggaagttgagcatgtaggaaagcagattgacctcaaagccttctgccagagccaagtgcgcctttaccataaagtcttcatctagccccacgattacgtccgtcgtgtaaaagtcgcgttcgtggccttcatagatagcttcgcgcaagacgccatcgattttttcggcatcaacgtctggtgaaccgatcaaacgccgtgctgccgcggtccggcccacgatctgaccatggttgtcgaccagcatcttggcatcggctggcagccccagttcttcggtatgcttgattggcaggtcggtaacgatggtattagggttgtcggctgccaaacgataagcagtcgcggtatcggcaatatgtgtcatattgttggcataaaatgccgattcgatcgtcgtccgcgtccgtgagaagatcgggttggtcttaacgatgtctttttcagaaaattttgtttgagtactcattgaacagccacctttctgataagttatcgtgattaaagtgcttacattcctattataatgcaaaaaccaagtaataataggattaaatttcgctatttgtcgaaaagcttgctaaatgtcaaaaaagcgctgaaattgactttttgatgaatttattaaaggcaaaaattaagaaacgcaaaatttatatcgtataaaatttacattttgtcgtttctttattcaaaacttctcctaaaaggattcgcaattcttttttaactttgcatatcagctttgatggtcgggctttcgatagagtatcaatcaaggcagaatattaattcaatttaaggaaagtgattgtttgcatcacaaaaagggacgctggctggcactgattgcggtgctgctggtattatgcggcgttggcggctggtttggctatcgtcgttattcgctcggagtgatttctgataagcagattattaagaacatcaacagtcatctgctgaagaataatccaacatccaagcagaccaaaagctacgctaaaatcgtcaaaagtactacgcggacgctgaataatgcttacgtcaaggttaatccatatggcacctcgccgctgaccgccttgatgatctttaaaacagaccaggtcgctaaggtaacttacacggttgtcggcaagacggataacacctcgattaccaatacggttaaggggtataagactacgcatcaggtaccgatcgtggggctttatgccaactactccaaccaggttcaagtcacgcttacctacaaagatggcacgacggaacaaaaaacgtttaccattaaaacgggcaagctgcctaagaacctgcgccagactaagatcacggtttcaaagagcaataagtccaagatgcagatcggcaataacgagctgacctacatcaacaagacctctgaggaaccatttgctgtcgatgctgatggtaatattcgctggtattcaacgctctacagccggcacacgtttgttcagctcagtaatggtcatttgctgattcaaaaccggacgaatggcaataaggggtcctacaacgtcttatctgaaactgattaccttggccgcatctatcggcgttatcgtttcagcgacaagcttggtaagagctcacttgaacaatacattaccgcggttcatcatgacgcgcttgaattgccaaatcataatctgttggtaacgatctctggcggtgacaagtacgcggaagacgtgatcgccgaaattgattacaagactggtaagacggtcaaggtaatcgactttaagaaattgctgccttcaagcatgtaccgcaactacagcagtactacaaccaagggcggtaagatcgactggctgcacatgaactcgctttactatgatcaaaagacgggtaatctcttggtttcagcacgtaatcaggatataaccatgtcgatcaactataagtcgggtaagattaactggatctactctggtaaaaagaagagctcatggccaaagaagtatcgtagcaaactgttgacaccagccaaaggtacgacgattaccggtggtcagcatgatttgacgcttttgagcagtaaaaatgggaaactaaaagtattgctttatgacaacaacattgatgtcacaaatggtaatgcgaagacatctggcaagtactcacaagcggttcagtacacgattgatactaagaagaaaactatcaagcagacttggtcttatggtaagagcctgggtaaagataactttacacgggtgatcggctcggcacagcgtttaagcaatggcaataccttgattgactttggctacaagcatgatggcagtcaaagcaatattatcgaagttgataagaacaacaaccaggtatttaacttgacgatcagttcatcgaagactgaccggacatatgtttatcgtgcttaccgcgtcaaattcacgccatctaattttgtatttgatgcaaccaaatagttttgtgcttgatttaaagaagcgtcggcagcttttgtcggcgtttttttattgattaaaaatttttcaataataggttgacgactaattccacatataatcgtaagaatattcgaattttacagaatgaattaaagttaatggagcttaatattcatgctttttaaaataattgaaaaacttttgataagtcgttgacatatgatgacaatctttgtatattagataacgttgtcgcggcgatgagttgctaattacttgagatcaacggcttttcgccaaattgccaagaaaaattaattaaaaagttcttgacagatagttgacaatttgttaaactgattgagttgcttgtttaaaaagaacaaacaacggtagacctttgaaaactgaatacagtttcgacgaacacaaatgtgcagggtcatcaatcattacgattgatgcaaaaacatttgcgaagtcaattcgcttaatttaaatttgagcttttcaagttctatattttatatgagagtttgatcatggctcaggatgaacggccggcggtccactatggcctatacatgcaagtcgaaacgcgttggcccaactgatggacgtgcttgcacgagacttgacgtggtttacagcgagtggggacgggtgagtcaacacgtaggaaaacctgcccaaagcggggataacagttggaaaaagattgctaatacccgcataacaatttgaatcgaatgattcaattaaaaagatggcttcggctatcactttgggatggatctgaggtagaattaggtctttggtggtatgtaacggcctaccaaggctgtgatgcgtagcccgagttgagaggactgatcggccacaaatggaactgagaacggtccatactcctacgggaggcagaagtaggaatcttccaccatggtgcgcaagcctgatggagcaacacccgcgtgagtgaagacgggttcggctcgtaagcattgttgttagagaagaacgttgcgtgagagccacgtttacgccagtagtgacggtatctaaccagaaaagtcacgctaactacgtgccagcaagccgggtggggttaattacgtaggtggcagcgttatccggatttattgggcgttggtaacgcgagcgcaggcggtttgatagttagtgaaagcctttggcttaaccaagaagtgcatcggaaactggttcagattgagtgcatgaagagacagtggaaacactccatgtgtagcggtggaagggcggagggttaagttaaaggtgggatatatggaagaacaccagtggcgaaggcggcttgtctggtctgcaactgccgctgaggctcgaaacatgggtagccgaaaagggatagataccctggtagttccatgccgtaaacgatgagtgcatgggttggaggttttccgccctcagtgccgcagctaacgcttaagactccgctctggggagtacgaccgcaatggttgaaaatcaaggagattgacggggggcccgcacaaagcggtggatggagcattgtggtttaattcgaaagtacgcgaagaaccttaccgggtccttgacatcttgcgccaaccagagatagggcgtttattcggggggggaacgcaatgacaggtggcgcatggtcgtcgtcagctcgtgtcgtgagatgttgggtaagtcccgcaacgaggcgcaaacccttgttactagttgaccagcattcagttgtggcactctagtgagactgcggtggacaaaaccggaggaaggtgggggacggacgtcagatcatcatgccccttatgacttgggctacacacgtgcacagagatgggacgtacaacggagtcgcgactcgcgaggcaagctaatctcttaaaaccgttctcagttcggaccgcaggaagaaatcgccctgcacgaagtcggaatcgtagtaatcgcggatcaggcattgcgcggtgaatagtcccgggcctggacacaccgcccgtcacaccatgagagtttgcaacaccaaagctcggtggggtaacccttcggggagctagcgcctaaggtggggcagatgattagggtgacagtcgtaacaaggtagccgtaggagaaccgcggctggataacctccttttctaaggcaattaatcggaaaacctgcacaattcgttgaaatgtgttccgttttgaggggtttaccacctcatctcaaaattcgttcgctgtgggtctatagctcagttggttagagcgcacgcctgataagcgtgaggtcggtggttgagtcacaattagacccatatgagggaagtagggctcagcggggagagcacctgctttgcaagcaggaggtcatcggttcgaatcccgttattctccagtggccagtaatttgactggtgcttgtactttgaaaaactaaattaatattatttatttattcacattaaccgagaacaccgcgttaatttgcgtgtattaacgaaaattatccgccataatcaataactgagtgatcgtaagatcactcacggttaagttatgaagggcgctgtgcgcctttgtataggagccgatgaggacgggacaacaccgatatgcttcggggagcggaaagtacgcttgaccggagatttccgaatggggaatggaggaaaaccaatcatcgtagtcgatgattgctgagcagtgatacatagcgtcaggcggtagacgcggaatgaaaaacattaagtagctgcaggaaagagaaagaaaaattcgattccatgagtagcggcgagcgaacgggaaggagccaaaccaacgagactttgcttgtttggggttggagactgaacagttgagttaccaagtgcgaagtagttgaagtcgttgggaagcgacgccaaagatgggatagcccagtacaaacgaaaaacgtaacacttatcaggttcaggatcctgagtacggcgggacaccgtgaacccgtcggaatcccgcgagggaccatcttcgcaaggctaaatacttcctagtgaccgatagtagtgaaacagtacagtataccgtgaggaaaggtggaaagcacccctggaggggagttgaaacagttcctgaaaccatgtgccttacaagctgtttcggagcacatttacgtgtgacggcgcgttgctctttggtagaatcacggcgagtcatgattgcgtgccaggttaagggggaaaaaccggaacgcagtaagcgaaagcgagtctgaaaatggggtacgaagtacgcattatgttaccgaaaccaggtgacctcacccatgtccaggttgaaggtgcggtataaacgcactggaggaccaacccgtcgatcagttgaaaatggttgggatgaggtgtgggtagcggtgaaaattccaaaaaagaacttggagatagctggtttctctccgaaatctctttcgggggagcctcgaggggggtggtttagatcatggaggtagagcactgttttgggactagcggcccgtcatgggttactgacttcagataaaactcgaaatgccatgattgtgactcgggagtcacacgtgagtgataagatccatcgtggaaaggggaacagcccagatcatcagctaaggtccctaaatatatgctaagtggaaaaggatgggaatgcacagacaactaggatgtctgtggctcagagagcagctcatttaaagagtggcgtatagctaactagttcgagtgactctgcgccgaaaaatgttaccgggtgctaagcatattgaccgaagctatggatgcatccattaggattgcgtggtagggagagcgttccacgggcgatatgaagtcaggacgtaaggactggtggagcgcttggaagtgaggaatgccggtatgagtagcgaaagacaggtgagaatcctgttccaccgaatactaaggtttcctggggaaggctcgtcctcccagggttagtcgggacctaagtcgaggacgagaggcgtagacgatgcgacaacaggttatattcctgtacaggtgattggttgagtgatggagtggacgcagaaggctaagcgatacggacgaattgggaagtgccgccaagcagaaagtcagttgatagtcacaaatgcttatcggcgttgacaagcgtgatggggagcgaaatgtcgtagcgaagtcgttgatgtccatgccgagaaacgcttctagcgaataatcaactgccaagtaccgtgcaaaaccgaacacaggtagtcgaggagagtatcctaggtgagcgagcgaactctcgtaaggaactcggcaaaatggacccccgtaacttctggagaaaggggtgatgatcggcaagatcagccgcagtgaaaaggcaaggcggactgttttatcaaaaacacaggtttctgcaaaatcgtaagatgaagttatagggctgacgcctgcccggtgctggaaggtttaaaaggaagagttagctcggcgaaggccctgaattgaagcccagtaaccggcggccgtaaactataacggtctaaggtagcggacattccttgtcggggtaagttccgacccgcacgaaaggcgttatacgatctgggcactgtctcaacgagtgagactcgagtgacatttgaattgctgtgaagatgcaggcttaccccgcgacaggacggaaagaccccatggagctttactgtagcttgatagtgagtgcttgtactgcttgtttacaggtaggtaggagcaatagaagcagggacgctagttttgggcagaggcgttggtgggatactacccttgcattatgatcactctaacccgcaccttgatcgaggtgggagacagttgtcaggtgggctagggtttgactgggggcggtcgcctcccaaagataacggaggcgcccaaaggtttgctcagaatggttggaactccattcgcagagttgttgtaaaggcacaagcgagcttgactgcgagacagacaggtcgagcagggacgaaagtcggggtattaggtgatccggtggttccgcatggaagggcatcgctcaaacggataaaagctaccctggggctaacaggcttatctccccccccaagagtccaatcgacggggagggtttggcacctcgatgtcggtcatcgcattcctggggctgtagtcgcgatcccaaaggttgggagttcgcccattaaaagaggttacgcgacagctgggttcagaacgtcgtgagacagtttcggtccctatcccgtcgcgggcgtggaaatttgaggagacctgtcttcgtaagagaggaccgggtggacattaccgcggatgattaccaggttgttctgcagagcatcgctgggtagcatgtatggatgagataaacgctgtgaaagcatctaagcgggaaactctgcctccaagatgagatttcccattccttatgagtaagaacctcaaagatgatgaggtgataggatggaagtggaagtgccccgctgaggcaggagcggaccattactaatcggtcgaggacttaaacccaagtttaaagttgtcttgattgaaagttgagaagaatgaatatttgtttagttttgaagagtgcaaagctctcaatcctgcaagggattagtggtgtgatggcttgacaggatacacctgttcccatgccgacacagaagttaagctcaacgcgccgaaagtagttgggggatagctccctggaggctaggggccattgccatgcaagcatggaaagggttgagcccattggttgatcttttatttttggaggattagctcagttgggagaggcaatgccttacaacaagagggtcacagttcgaggccctgtatcctccattttgttctattgggctatgacaagtggtaaggcaacggtttttggtaccccgtatgcgctggttcgaacccacgctagcccaactgattaacagccagattgacatctacgtcgtctggcggtgttttttgtaaataaagtattttgtccaatttgtattggtgagaaatccttccttgaggcttcaaaaatgaagtggggatttttaataaagaattgcattcaatgcgccaaatgcagattttctcaaatttatgaagcaacagtgattgcgtttggttagataatcataagagaagcatttcatatatcactgtagagataataccgtatttgattgacagtggagtggactgccatatgtatagatttgagattaccgttattatacatttttaaacttgcagtttttagaccattttgaaattgcacttgtattataaaaaatatatttctttaggaaaacctctgtaagatgctcattaaaagcgccaaccaaaaggttatcaatttattatgtatcaacaaacttatttgggaagggaattatgaagagcaataactcagcaggtaattagctatttgaagatgaattgattgaatatctacagatgttgtataaaaagcaatggaaatatgcagcagatattaatgagcatcttacagaggttttcctaaagaaatatagttatacagtggcaatttcaaatgttataaaaaaaggcagttgaaaaaatgtctaataactggaatctcaaattatacaattatggcagtccactccactgtcaatcaaatactgtattctctacagtgatactatgaaatgctctcttagattatctaacaaatcgctaatcacgtggattccataactttgaaaaatctggcttggcgcattgaatgcattctattaaaaaaaatccccattaattgaagcaggaatagattcttcaccaatacaatttgacaaaatacttattttacaaaacgccagacgacacgtaatgtcatttggcggttaatcagttgggctagctgggttcgaacaggcatgaaacggtacccaaaaacgttgccttaccactggcgataggcccaataaacaaaaatggaggatacagggctcgaacctgtgaccctctcttgtaaggcagatgctctcccaactgagctaatcctccaaaaataaaagagtcaacccaatgggctcaccctttacattacttgacatggccaatgcctatcctcgcagggagcgatccccaactacgtcggcgcggtgaagcttaacttctggttcggcatgggaaacaggtgtatccttcaagccaatcatcaaccacactaatccctttcagattgagagcttggcactctccaaaactaacaatattcattcttatcacgtcaatcaagacacctttaaaacttggttaagtcctcgaccgattagtaatggtccgctccatgcctcgcggcacttccacttccatacctatctacatcatcatattgaggggttcttacttccataaggaatgggaaatctcatcttgaggcgagtttcacgcttcgatgctttccgcgtttatctcatccatacatagctacccagcgatgtctggcggaacaactgagtacacccgcggatgtcatccggtccctctcgtactaaggacaggtcctctcaaatttcctacgcccgcacggatagggaccgaactgtctaacggacgttctgaaaacccagctcgcgtaccgctttaatgcgaacagccaacccttggggaccgacttacagccccaggatgcgatgagccagaacatagaggtgccaaacctccccgtcgatgtggactcttgggggagcggaagataagcctgttccccagggtagctttatccgttgagcgatggcccttccgcggaacaaccggatcactaagcccgactttcgtccctcgacccgtctgtctcgcagtcaagctcgctgtgcctttaacactactgcgaatgtttccaaaccattctgagcaaacctttgggcgcctcgttatcttttggaggcgacccccgcccagtcaaactgcccacctgacactgtctccccacccgatcagaggtgcgggttagagtgatcataatgcaagggttagtattccaccaacgcctctgccaaaactaagcgtccggcttctatggctcctaccttatcctgtacaagcagtacaagcaccaatatcaagcttacagtaaaggctccatgggtctttccggcctgtcgcgggttagcctgcatcttcacaggtcaattcaatgtcaccgcggtctctcgttgagacagtgcccagaatcgttacgcctttcgtgcacgccggtcggaacttgaaccgacaaggatttcgcttaccttagggaccgttatagttacggccgcccgtttactggggcttcaattcagggctcgccgaaggctaatcttcctttaaccttcccagcgccgggaaggcgtcagcccctagacttcatcttacggatattttgcagaaaacctgtgttttgataaaactagttgcctggggccttttcactgcggctgatttgcgatccggcaccccttctcccaagtaagttacggggtcattttgccgagttccttaacgagagttcgctcgctcacttaggatactctctcgatcccctgtgtcggttttgcggtacgggcagtttattattcgcttagaaacttttctcggcagtgtgactcaacgacttcgtactataattcgctcccatcacagcttgttcaactcgtgataagcatttgactcatcaactgacttgctgcttgggccggacactccaatcgtccggatcgcttagccttctgcgtactccataactcaagcacaatcaatggtacaggaatatcaacctgttgtcaatcgtatacggcctctcggcctcgacttaggtccccgaataaccctgggaggacgagccttccccaggaaacttagtcattcggtggacaggattctcactgtctttcgtactactcataccggcattctcacttccaatcgctccaccagtccttacggtctgacttcatcgcccttgggaacgctccataccacgcatcctaatggatgcatccatagcttcggtaatatgctagccccggtacattttcggcgcagagtcactcgactagtgagctattacgactctttaaatgatggggcttgagccaacatctagttgtctgtgcaattccacatccttttccacttagcaatatttagggacttagctgatgatctgggctgttcccctttccacgatggatctatcactcacgtgtgactcccgagtaaaaaatcaatggcattcggaggttatctgagtcagtaaccatgacgggcccctagtccaaacagtgctacctccatgatcaaaactcgaggcttcccctaaagagatttcggagagaaccagatctccaagttcgtttggaatttcaccgtaccaacacatcatccaaccattttcaactgatacgggttcggtcctccagtgcgttttaccgcaccttcaacctggacatgggtaggtcacctggtttcgggtacatactgcgtactttcgtacgcccattcagacgctcgttcgctacggctccggtttttccaccttaaccttgcacgcaatcatgactgccggttcattctgcaagaggcagccgtcacacgtaagtggctccgacagcttgtaggcaaatggtttcaggaactgtttcactccctccggggtgcttttcacctttccctcacggtactggttcactatcggtccctaggaagtatttagcttgcgagatggtcctcgcggattccgacggggtttcacgtgtccgcccgtactcaggatcctgaactgagaggtggacgttcgttactgggctatcaccatcttggcgtcgcttcccacgacttcaactacgtcgcactttggtaaccaaatgttcagtcctacaacccaacaagcaagctcgttggtttgggctcttcccgtttcgctcgccgctactcagggaatcgaatttctttctcttcctgcagctatagatgtttcagttcactgcgtctaccgctgacagctatgtattcactgctcaggcaatcatgaataagatgattgggtttccccattcggaaatctccggatcaaagcgtacttaccgcccccgaagcatatcggtgttagtcccgtccttcatcggctcctagtaccaaggcattcaccatgcgcccttcataacttaaccttgatgatcttacgatcacctcagttattgagtatgcgattaatttcgttaataaaactcaaataacgcggtgttctccggtttaattgtgaataaagaaataaatatattagttttcaaagtacaagcaccagtcaatcgaaaactggcaaggagaatacgggatcgaaccgatgacctcctgcttgcaaagcaggtgctctcccagctgagctaattccccataatgggtctaagtggactcgaaccacgacctcacgcttatcaggcgtgcgctctaacaaatgagctatagacccaaaacagcgaacgattattgagatgatggtggtaaacccctcaaaactgaaacacgtttcaacgaatgtgcaggtttccgattaattccttagaaggaggtgatccagccgcaggttctcctacggctacctgtgtacgactttaccctaatcattgccccaccttaggcgggctagctccgaagggttaccccaccgaattgggtgttgcaaactcttatggtgtgagggcggtgtgtacaaggccgggaacgtattcaccgcggcatgctgatccgcgattactagcgattccgacttcgtgcaggcgagttgcagcctgcagtcgaactgagaacggttttaagagattagcttgccctcgcgagttcgcgactcgttgtaccgtccattgtagcacgtgtgagcccaggtcataaggggcatgatgatctgacgtcgtccccacttcctccggtttgtcaccggcagtctcactagagtgcccaactgaatgctggcaactagtaacaagggttgcgctcgttgcgggacttaacccaacatcttacgacacgagctgacgacgaccatgcaccaccgtcattgcgttcccgaaggaaacgccctatctctagggttgggcagcaagatgtcaagacctggtaaggttcttcgcgtagcttcgaattaaaaccacatgctctcaccgcttgtgcgggcccccgtcaattcctttgagtttcaacttgcggtcgtactcccaggcggagtgcttaattgcgttagctgcggcactgaaggggcggaaaaacctccaacacctagcactcatcgtttacggcatgactaccagggtatctaatcctgttcgctacccatgctttcgagctcagcgtcagttgcagaacagacagccgccttcgccactggtgttcttccatatatatacgcattccacgctacacatggagttccactgtcctcttctgcactcaagttgacagtttccgatgcattctttggttaagccaaaggctttcacatcagacttatcaaaccgcctgcgctctgcttacgcccaataaatccggataacgcttgcacctacgtattaccgcggctgtggcactagttagccgtgactttctggttttagtcgtcacgcgtgaacagtgctctcacgcacgttcttcttaacaacagagctttacgagccgaaacccttcttcactcacgcggtgttgctccatcaggcttgcgcccattgtggaagattccctactgctgcctccgtaggagtatggaccgtgtctcagtccattgtggccgatcagtctctcaactcggtacgcatcacagcctgtgtaggccgttaccctaccacaagctaatgcgccgcaggtccatcccaaagtgatagccgaagccatcttttaatttgaatcatgcgattcaaattgttatgcggtattagcatctgtttcaaatgttatcccccgctttggggcaggttacctacgtgttactcacccgtccgccactcgctggtaaaccaacgtcaagtcgtgcaagcacgtccaatcagttgggccaacgcgttcgacttgcatgtattaggcacaccgccggcgttcatcctgagccaggatcaaactctcatataaaatattagaaacttgaaaagctcaaatttaaattaagcgaattgattcgcaaatgtttttgcatcaatcgtaatgattgatgaccctgcacatttgttcgtcgcgaaactgtattcagttttcaaaggtctaccgttgttttgtcttttaaacaagcaactcaatcagtttaacaaattgtcaactatctgtcaagaacttttaattaatttttcttggcaatttggcgaaaagccgttgatctcaagtaattagcaactcatcgccgcgacaacgttatctaatatacaaagattgtcatcatatgtcaacgacttatcaaaagtttttcaattattttaaaaagcatgaatattaagctccattaactttaattcattctgtaaaattcgaatattcttacgattatatgtggaattagtcgtcaaactattattgaaaaaattttaatcaataaaaaaacgcgacaaaagctgcgacgcttctttaaatcaagcacaaaactatttggtgttgcatcaaatacaaaattagatggcgtgaatttgacgcggtaagcaagataaacatagtccggtcagtcttcgatgaactgatcgtcaagttaaatacctggttgttgttcttatcaacttcgataatattgctttgactgccatcatgttgtagccaaagtcaatcaaggtattgccattgcttaaacgctgtgccgagccgatcacccgtgtaaagttatctttacccaggctcttaccataagaccaagtctgcttgaagttttcttcttagtatcaatgtgtactgaaccgcttgtgagtacttgccagatgtcttcgcattacatttgtgacatcaatgttgttgtcataaagcaatacttttagtttcccatttttactgctcaaaagcgtcaaatcatgctgaccaccggtaatcgtcgtacctttggctggtgtcaacagtttgctacgatactctttggccatgagctcttcttttaccagagtagatccagttaatcttacacgacttatagttgatcgacatggttatatcctgattacgtgctgaaaccaagagattacccgtcttttgatcatagtaaagcgagttcatgtgcagccagtcgatcttaccgcccttggttgtagtactgctgtagttgcggttacatgctgaaggcagcaatttcttaaagtcgattaccttgaccgtcttaccagtcttgtaatcaatttcggcgatcacgtcttccgcgtacttgtcaccgccagagatcgttaccacagattatgatttggcaattcaagcgcgtcatgatgaaccgcggtaatgttatgttcaagtgagctcttaccaagcttgtcgctgaaacgataacgccgatagatgcggccaaggtaatcagtttcagataagaagttgtaggaccccttattgccattcgtccggttttgaatcagcaaatgaccattactgagctgaacaaacgtgtgccggctgtagagcgttgaataccagcgaatattaccatcagcatcgacagcaaatggttcctcagaggtcttgtgatgtaggtcagtcgttattgccgatctgcatcttggattattgctctttgaaaccgtgatcttagttggcgcaggttcttaggcagcttgtgccgttttaatggtaaacgttttttgttccgtcgtgccatctttgtaggtaagcgtgactgaacctggttggagtagttggcataaagccccacgatcggtacctgatgcgtagtcttataccccttaaccgtattggtaatcgaggtgttatccgtcttgccgacaaccgtgtaagttacctagcgacctggtctgttttaaagatcatcaaggcggtcagcggcgagggtgccatatggattaaccttgaagtaagccttattcagcgtccgcgtagtacttttgacgattttagcgtagcttttggtcctgctggatggtggattattcttcagcagatgactgttgatgttcttaataatctgcttatcagaaatcactccgagcgaataacgacgatagccaaaccagccgccaacccgcactaataccagcagcaccgcaatcatggccagccagcgtccctttttgtgatgcaaacaatcactttccttaaatgaattaatattctgccttgattgatactctatcgaaagcccgaccatcaaagctgatatgcaaagttaaaaaagaattgcgaatccttttaggagaagttttgaataaagaaacgacaaaatgtaaattttatacgatataattttgcgttcttaatttttgcctttaaaaattcatcaaaaagtcaatttcagcgcttttttgacatttagcaagcttttcgacaaatagcgaaatttaatcctattattacttggtttttgcaatataataggaatgtaagcactttaatcacgataacttatcagaaaggtggctgttcaatgagtactcaaacaaattttctgaaaaagacatcgttaagaccaacccgatcttctcacggacgcggacgacgatcgaatcggcatttatgccaacaatatgacacatattgccgatacccgcgactgcttatcgttggcaagccgacaaccctaataccatcgttaccgacctgccaatcaagcataccgaagaactggggctgccagccgatgccaagatgctggtcgacaacatggtcagatcggggccggaccgcggcagcacggcgtttgatcggttcaccagacgttgatgccgaaaaaaatcgatggcgtcttgcgcgaagctatctatgaaggccacgaacgcgacttttacacgacggacgtaatcgggggtagatgaagactttatgggtaaaggcgcacttggctctggcagaggctttgaggtcaatctgcttttcctacatgctcaacttccaaacagctacgaaaattggctgaagcgctatgccgattcacgggcctatgacgaaggcggacatctatctgtactgcgacccatactggagcaatcttggactatccacatggcctggttgtcatagatgctcagcacaaatgcggccgcggttttggggtgcgctactttggcgagctaagaagtctatttgacgcggcctgggcaaccgcgcaccgacatgggttttacggcttgtcacggtggcgaaaagactttccacttcagcgatagtgatgatcagacttttgccttctatgggctttctggatcaggcaagtctacgctgacccacgctaagcatggtggcaagttcgacattaccgtgctgcatgacgatgcgttcgtaatcaatcgtgaggacggcagctccacggtctgaacccgcctattttgacaagaccaacgatatatgcgggcaggcctcgaaatgcagtactttactacggtgatgaacgttggcgtcacgcttaacgaagccggccaaaaagtactggtaacccaggatctgcgcaacggcaatggccggaccattaagacgcgcttgcctctaccaaccgggtggatcgcgaaattgcccaaatcaatgccgtctttttggattatgaaagatgacagtcttgccgccagtcgttaaactgaccgatcccgttaccgcggctacgtttggtcgacgttggctaccaagcgttccacggccgaaaaacgtggtggggcctgaccgcaacgctttggttatcgaaaccattgccgacccattcgcgcgcctacccattaaacgaggactatcaaggactttaaggcactgtttgaagaacgccacgttgactgctacatcgtcaataccgccaactttaacggcttggacatccctaaagaactgaccttgaaggctttggaagacatgcccaaaaccaggccgcctttaagcctttggcgagctggccaacatggatacattgcttaagacggctatccagttgactttaatgatgctggaatacgcaaccaagctcaagacgcgttttgaaatccggcggcgaatgggttaaactatgaagctcagcacacgggcgaaaaactgcagctgaattgaccgtctggacaacttgatcaacgccctaaactaatcaaatactgacaaccttgatctccaagcgctgaatgctcaatgcggtcagtgctttttagatgctccagtaagtgtttttgcaagacaaatataatagtttgcgccatttttcataacgtgattggtcagccagactctgatactgctcgtatagtacggatcaacggacgacagctggcctcgtaaaacgcgcgctcccgttccataatgtagccaatcagtgcttgacgaccaatttggtagcagtgtcagcagcaagcggcgtggtcctccaattttggcctgcagcgcaacttgcgagggccgctctaccttttagttcaagtttttgcgacgtgccaaaataaactttgacgtagctggcaactcgaccgttgaatcgcagcaggtcaccagttaacagttcgcctaaatctaaaagcctttcgtataattgagccataaatgatcagtaatcagttctccaggttcggctaaagcaacgtgggtgagcaaaagcgttggccgacagtaacggtagcttttttatagccaacgcgctcaaaccggccgatgaacacgtgtcgcatttggggaccaagttgttggagctttttctatttccggcttccttctccaatcatctatcaggttccttataaatgctatttagacggttaagcggaaatgcatttttttttgatgaatttcagcgtttgtcgaccagattgcggcaaaataaaaaacaatcgcacgccaccagctgcgaaaaaactggtagcacgcgattgttcttttcattgttttaacgattattcaatttatcgttccagccaaaacaattgattttcttggcgactgattgcgcgggccaaaatcaaataatgaccatatgttgtcaatctgttctgactgctgaataatgcttgtcgacgctcgcgcagatgattaaggctgttgctaaccagttggatctggggcttaaacaattttccagtcttggatcattacgatcattgatgaaaaaagtctttaaagaaaataggtctttggataccggacagcttatcaacgcggttccatcaaccagtcattaataattcatgaccataaagccgttttaaatggtagtgtatctctttatcattatcttctttgagtagctttcaatccaacgatcttgttccatacgctttagctctggataaaacctgactatgtgatgattgccaaaattccccaaatatcaaagcgaaactcatccataatctgctttccagtacagtgtcttattgagcaggatccccataataacgtagggcagtatcctttttgcggcattttcagcatccttccttatctgattctgcaaaattatataaacaagctacttagccagacgatgggtaattttcgtcaaaaaagcggccattgcgaatatcatcagtcatgccagcataaggggcttcattgatgacttcttcattatcctgaccagcatcacccatgtaggtaatcgttgcaaactcaggaaccactaattttggataggtttcatacttttcacgcgattcatgcattaaatcaatgtgttcattttggaagcaaaccggaatgttctcggatgttctgtacccattttggaaagaaaatcgtaccgttaagcttatgttcattaggaacgaaatccaatgcgacatcagttcccgttggctcggtccacgcaatcttgtaaattccttcagttaattgatgaatgtgcgctgggctgatccttaacccaacgtcggaaccattccgcatgaattcccgatagtcaacctgtgtgatcatttttagcataccatcgattcgcccagccagtgtatatgtatagatgaaaaaaatgcagttcccaataaagtcatccagcgttttgaattgtttgtccatatgatttacgtttgcataattatttccgcctttcataaatgtcgttatcaacataaaatagaatatcactttatggtcgtatctcaaatattgatggctaaaataattttgacccccatctttcaaagttcagtaaaaacttgagaatgagggtcaattaagttaaaaaattatattgttatgtaacagttatactaatctgattttgtttggcaaaataaaacgatacgatcagcgcgataagcaagccagcgtagtaaagtccgtgtgtacccggacgtaacacgccgttgactgcagtgccggatgccggcctaattccaaagaaaatgagtgacgctaggagcggaacgcgggatagtcggcggagcgacctgcgtcagagtgggcgacctgcacattcaaaatcgtactaggaaccgacatgcctgatgtagtagaccctgtggtataggtattgtaaacgttagtgggtcactggcagacttttgggtgaacgtgtgcctcctggtgtccaccggcttgaatcattctatcacgtattgagccgcaatcatgtcaactgcggaactgagccgtgtcccacctgttccccccaaatccgatccgctagcaagcacaaagccaatcataactggaaccgcttggccccgatgaatccatacatccgtccag

SEQ ID NO: 696 - DNA, 570927 bp, Unknown
  Metagenome-assembled genome
caacgcgttcgacttgcatgtattaggcacaccgccggcgttcatcctgagccaggatcaaactctcatataaaatataagaacttgaaaagctcaaatttaaattaagcgaattgacttcgcaaatatttttgcatcaatcgtaatgattgatgaccctgcacatttgtgttcgtcgaaactgtattcagttttcaaaggtctaccgaacatcgaatatgttactgcttcgatgacgtgtttaattttaacatactgattattttaagtcaagaacttttttaaatcaatttgttaagtgagttgtcattcatcaatcgacaacttttatagtttagcaaaattaaatgaatctgtcaacaaccaatttaactttactgatcgttatcaacaacatcttgctgtgacaacggtatttaactatacaggttttaatgagtatcgtcaatagtttttcgctgatttatcaaatttcttttcatgctaacaaatttactcatcatctgctgcacagttattccgtatgatcttacagcaggcgaattatttacacgggcaatttgagttatatagagaaaatattcttctgtatactggtgacacagtcagcgattcaaaaataaaacccaatccctgaatactcaagaatcgggtataacctattaaattaatgatgcgatgccaattgtaatctgtcgacagctattggttcttcttttgcatcaggtacgtattccttgcgcgtaactgactcatataagcaaattaccgctgttccagtaacaatccaggtaaccgggtagatcaaagcaacttgggtaaaattcgtaaaatgcggcagcataaccgcaatatagacaacacgtaaaatgcagcaaccaaccagtgtaataatggcaggtgccagagaatggccaattcccctgagactccccccggcaatctcataagttgccgtcaaaggctctaacaacgcaataaaggttattcgaataattgcataatgaacgacagcttggttggtcgaaaagatatcatcaaccaatggatagcgaaagacgtaaaaagtcatcgagacaactgctgtaaacaaaacagcactgatcattgcaatccgtgcaattttacgacaacgctggtattgatgagctgcatagttttgactgataaaagtaaccgttgcctgggcaaaaccattaacaaagaaatagctgatatattcaaaattcaaaccagccgaattaccagccacacaggccgcgccaaaatggttaatggctgcctgaataacgatattggatactgagaaaatcattccttgcaggccagctggtcccccaattgcaatgattcgtttcagataggtacgatttaatgccagctttttccaatcaaagtgcagcatgccagtttccttaaccaagaggcggtagattaaagccgcactgactgcattggcaatggtcgtagcaattgccgttccatccgaactcatctgaaagccaattaccaaaatcaggttcaaaaccacattgaccattcccgaaaacattaaacaaaacaaaggtcgcttggtatcgccaactgctcttaaaactgcattgccaaaatcataaatcattaaaaacggcataccaagaaagtacagttttaaatagctgaccgctaacggcataatactggctggtgtatcaagcagacctaaaatcggcttggcaatcaggcagccgaccgtcagcataatcagcccactgatcaatgccaccgaaaaaccagtatgcatcgccgcgttgactcgttctttcttgcctgccccaaccaaaccagcaatcaatacgtttgagccaattgaaagtcctgtaaacagcatcaccacgatattgatgactggcgcattggaacctaccgcggccatagcattacttgaggcaaaacgcccagctaccgccatatcagtcgcgttaaacagctgctgcaaggtactcatcaaagcaattggaatcgctactttgcacattttaccgaagatgccaccctcaagcatattgagttggtgagaaggtctcgtcgcttcttcgtccattagataaattcactctcttttctctacaaaattgcacaaaggctagtgtaacgcttattttgacgcaataaaacccaaaactgacaattggcacgattccttcaaatctaaagcagccgccaattgaaaatcagtaaatatttttatctgccgctacattttaagcacaccccggcataatcattttgaaggcaattctaatggaagtgagtctaatatgactaaaaagataaaaggtaaaacagagtgtttgtagaaaagagtctgtccattaacaactgccaaacattcaacggcagtcatctcattttgcaggaactgattgacgacatcttcaacctgggcccgaaacagttcttttaaagccgaatcgtcatctgccagtagcgcggtaatgataaatcttccatggggaaagcctccgtattctgattggtttttgcgatttcaatcatacggggagggctttccctttttcaattcctcctttaaatttacacaaacaattttatttacactccctacaattacctacttctggaatcaaatcagccaatagtaggtaatttattcctctttatgctgttcactcaagctttccttcacaagcgcagcaccaaatccacttaatttttctcgttcgacacctgcagatcaattgaatcttattgtcatcaagcttctcagatttgatcagtcattgaatcatatcaacttcgatcttccaatagttccggtgtctgctgtcagtatgagttagcagccatactttgataatagatttccctagtttttgactccctgattgcattcaaaaaatccccacttcatttttgaagcagggaatcaatcctcatcatcaatacagtttaacaaaggccctcaaaaaccgatgcgacaaaaaaacgccacgatcatctgaccgtgacgtttttaatttgcatggcaatgccctatcctcgcagggagcgatcccccaactactttcggcgcgttgaagcttaacttctgtgttcggcatgggaacaggtgtatccttcaagccatcatcaccacactaatccctttcaggacggatgcttgcacttcctcaaaactaaacactatcctattcttctcacgttcaacgcaaaacacctttaaacttggttaagtccctcgaccgattagtaatggtccgctccatgcctcgcggcacttccacttccatcctatctacctcatcatcactctgaggggtcttacttccataaaatgggaaatctcatctgaggccgagttcacgcttagatgctttcagcgttatctcatccatacatgctacccagcgatgctcctggcggaacaactggtacaccagcggtatgtccatcccggtcctctcgtataaggacaggtcctctcaaattcctacgcccgcacggatagggaccgaactgtctcacgacgttctgaacccagccgcgtaccgctttaatgggcgaacagcccaaccttggacccgactacagccccaggatgcggatgagccgacatcgggtgccaaaacctccccgtcgatgtggactcttgggggagataagcctgttatccccgggtagcttttatccgttgagcgatggcccttccatgcggaaccaccggatcactaagcccgacttcgtccctgctcgaccttgtctgtctcgcagtcaagctcgctgtgcctttacactctgcgaatgatttccaaccattctgagcgaaacctttgggcgcctccgttatcttttgggaggcgaccgccccagtcaaactgccccacctgacactgtctcccaccacgacatcagtgtggtgcgggtttagagtgatcataatgcaagggtagtatcccaccaacgcctctgccaaaaaactagcgtcctggcttctatggctcctacctatcctgtacaagcagtacaagcactcaataatctaacagtaaagctccatgggtctttccgtcctgtcgcgggttagcctgcatcttcacggcaattcaatttcaccgagtccttcgttgagacagtcccagatcgttaccctttcgtgcgggtcggaacttacccgacaaggaatttcgctaccttaggaccgttatagttacggccgccgtttactggggcttcaattcagcagggcttcgccgaagctaactcttcttttaaccttccagcaccgggcaggcgtcagccctatacttcatctacgattttgcagaaacctgtgtttttgataaacagtcgcctgggccttttacactgcggcttgatcttgcgatcagcaccccttctcccgaagtttacggggtcatttgccgagttccttaacgagagttcgctcgctcaccttaggatactctcctcgactacctgtgtcggtttgcggtacgtgcagtgtatattcgctagaagctttctcgcagcgtgacatcaacgacgttcgctactataatttcactccccatcacagcttgtcaactcgctgataagcattgactcatcaactgacttgctgcttggccgacactttccaatcgtccggatcgcttagccttctgcgcgtcatactccatcactcagcacaatcaactggtacaggaatatcacctgttgtccaatcgtctcgcctctcggcctcgacttaggtcccgactaaccctgggaggacgagcccttccccaggaaaccttagtcattcggtggacaggattctcaccctgtctttcgctactctaaaccggccattctcacttccaagcgctctccaccagtccttacggtctgacttcatcgcccttggaacgctctcctaccacccatcctgatggatgcatccatagcttccggtaatatgcttagcccggtacattttcggccgcaagagtcactcgactagtgagctattacgcctctttaaatgatggctgcttctgagcccaacatcctagtttgtctgtgcaattccacatccttttccacttagcatatatttagggacttagctgatgatctgggcttccccttctttccacgatggatcttatcactcaccgtgtgactccaggtaaaaatcaatggcattcggaggttttatcttgaagtcagtaacccatgacgggcccctgtccaaaagtgctctacctccatgattctaaaccctcgaggctccccctaaagagatttcggagagaaccactatctccaagttggttggaattcaccgctaccacacaaaaactacccatcacaacccaccttttaactgatagggttcggacactatgccctccaagtgcgtcttttaccgagcacccttcaatcatgaatgggtaggtcacctggtttcgggtacataaacctgcgcacttcggacgccacatttatcagactcgctgtttccgcctttcgcctgcgcggtccggttcttttctttctccaactaatatgaaaaccttgcaaagtcaatctcatgactcgctcccggttatctccattcctcgcaagggcaacgccgtcaccgttaaatgtgccccgacgcttgtaggccacattgtttcaggaactggtcaatcctttcgtgacatgtttgccagactttcatcctcagtgggtgcttttcatccttccctcacggtactggttcactatcggtccactagggagtattaggatagcaccttgcgagatgtcctcgcagattccgacggacgggttcacgtgtccccgccgtactcaggatctgaactgaagttgtgacggtctcgttaatgggctatcaccatctttggcgtcgcttcccaacgacttcaactacgtctcaactttggtacctccaaaatgttcagtcctacaaaccctcaaccagccagccgttggtgtttgggctcttttcccgtttcctgcctctggcatcgccgctactcagtggattcggaatttttctttctatcttccctctcttctgcagctacttagatgtttcattcactgcgtctatacccgcctgacagctatgtattcactgctcaggcaatcaatcgactattagatgattgggtttcccatcccacgtcggaaatctccggatcaaagggacgtacttaccgctacccgaagcgatatcgggtgttgtcccgttcctctcaaatcggctcctactgtcccaggcattgcaaccatggctccttcaataacttaaaccttgatgtatcttaaaatacgattcactcagtttattgagtatggcgattacacttttcgtaataaaactcaaataaagcggtgttcctcggtttaatgtgaataaagaaataaaagtatttaggtttttcaagtacaaagctgaggtagacccctcaaaactgaacgcagtttcaacaaacgaatgtgcagttttccgatttattccttagaagagaggtgatccagccgcagtgttctcctacggctaccttgttacgacttcacacctaatctacttgccccacttaggcaggctagcatcccgaaggtgtaccccaccgactttggggtgtgcaaactctcatagggtgacgggcggtgtgtacaaggccgggaagtagttcaccccggcggcatgctgatccgcgattactagcggtttcgactttcgtgcaggcgagtgccggcctgcgtccgaactgagagttttttaagagattttagcttgccctcgcgagttcgcaactcgttgtccgtcacttgtagcacacgtgtgtagccccaggtcataaggggcatatgatctgacgtcgtccccaccttcctccgtttgtcacgggcagtctactagagtgccgcccaatgaatgctgcaactagtaacaaggttgcgctcgttgcgggactaacccacatctcacgaccgagctgacgaccgaaccaggacaccacactgtcattgttcccgtaaggaaacagccctatctctagtgttggacgcaagatgtcaaagacctgtaaggtttctcggtagcttcgaattgaaacccacatgctccatcaccaaccgcttgtgcggggcccccgtcaatttccttttggagtttcaaccttgccggttcgtactactcccaggccggtatgtgcttaatgcgttagtgtagctgcggcactgaaggcggaaaccctccaacaacctagcatcatcgttacgtggcatggactaccaggggtaatctaatcctgttcgactaccatgcgcttgttcgaggcacaggttcagtcgtgcagaccaacagccgccgccttcgccaccgtgttccgttccattatctacgcatttccgtccaccgctacacatggagttccactgtccctctttttgccatcaagtctgacattttccgatgcactctttgggttagtgcacaaaggcgttcactcagggacttatcaaacgcaactgcggctcgctttattatacaagcgcaccaataaatcaatggataacgcttggccaccatacggtattacccacccggcgtggctggcaacgtagtttagccggacctttctggtttagatccgtcactctctgcctgactacgacgtgaacagtgctctcacgcacgttcttctctaacatttttctctaacagagctgtaacgagccgaaacccttcttcacctcacttgcggtgttgcgctcttcagtcaggcagttggcgcccatgttggaagatttccctactcactgactgcttgcccacgtaggagtaatggacacgtgtctccggtttccattgtggccgatcagttcctctcaactcggcgctacgctcacagccttggtagcacgtttaccccctcccaacaaagctaatgcgccgaggccatcccaaaagtgatcgcccgaaggccatcttttaaccatttggaatcatgcgattcgaattgttatgcggtattagcattctgtttccaaaatttatcccccggcctgtgggcagttacctacgtgttactcacccgtccgccactcgcctggtaaaccacgtcaagtccgtgcaagccacgttcaatcagttggccaacgcgttcgaacttgcatgtattaggcacccgccggcgttcatcctagccaggtcaaactctcatataaaatataaggaactgtgaaagcgacttcgcaaatgtttttgcatcaatcgtaatgattgatgaccctgcacatttgtgttcgtcgaaactgtattcagttttcaaaggtctaccgttgcccgcttgtttcaagcaagcgacttaatcagtttaacaaattgtcaactacctgtcaagaacttttttgaataacttttcttgatggttagacgaaaagtcgtcaatctcaagtgatcaacagttcatcgccgcgacaacgttatctaatataccgaggttacaatcaaatgtcaacgacaaattcaaactttttcaaaaaaatcaataaagcagaacggctttgttaccctcccggcaaaacgttgtatgattgccgaaaattgtaatcgttatccatttttaaccatcgttagatttcataatcacaaacctgtgtttttaaatcagctgcttcatttcctatcaaatcacctaaaattaaattcttagcaaataaaaaacgcgccatcatgattgatgacacgcttaagattatttttgattttcgacaatcggctcacgatcgtcaactgctattggctcatcagcagcatcgtcataagcctcgccagtcaatacctcaactggcttgaaggtcttaacgaaagcatcctcaaccgaaattggcgattgcggcttgctttgttcataaaattgagccgttgccaggtagacaactggagcataggcgcaaaagcccaacagcatgatgatcaaaccagcatacataacaaagtaggttgccgtgtaattgccgtagtaggccaatccaccaaagatcgcaccccataccagcatcggcaggaagctgactaccaattcaaccgtgaagaatgaaagcttcttgccacccataaagcgacgactagctgtcaaagcatggcgcattgactgtcccaaaaaggctggctgctggtcgcggtacagcaatggtgcctgcgagtattccaaagtcttccagaacgtaatcaagaagttggcgatccgaactgcaattaccagtgcctggttcttggctaccaagcctgccacgatatccaacggcagcgtccataagaagatgaacagactgctgtaaagcgtcagccgcagcagctggtttttattcagatgcttaaagtgcttccagatcgtcgttgcactgacttttagattaggattcttgatttgatcctggtagctgtaaaggatgctcatgttgacaaagtacatgccaaacgttaccaagaaccacaaaatcaagatacctaatgcctcaaccactgcaagcagcacttgactgatcatgccgtacataatcagcatcgtggcataccccagcatcatagcgctgcgagtgaacagcagtgccaaaagagccgtcaacgccaggtaaagcagcgtgatgccggcaatcggccaaaccgcggcgttatatttgcccttcagcgtactctttaattgattgatgaattctttgagaggcaagtgattgcgtttcattaattcaattctcctctttttaattaattatgtttaaaaatgttcttcgtgtatcttaacacatctttgagattgtaccaccgtcaacgtctatgctttacaaagtcttcacaaaatcacgaatcggcttcttaaataacaaggcttttttaactgatccaacggccaagcaccgttactgggctaaaacgggtaaattcagtacgattgccattattaagtgcaaaagccggactgttttttgcttggtaagtcaaccactcaactctttttattgaccgataaagaaaaaaagacccgcgagcgattcgcgagtctttaaagaacgtttaagaaattattagtacttttccttgctcaaaacgttcagcttttcatcgaagtcgtaaacaactggttggccagtagccatttccaggttcatgatgtcttcgtcagaaatgttttcgatgtatttggaaagggcacgcaacgagttaccgtgggcagcaatgataacgttcttgttgtccaacagctttggtgcgatttcgtcttgccacaatgggataacccgttccagcgtaactttcaggttttcaccaccaggaatggcgcgtgggtccaggttggcgtagcgacggtccttagctgcagagccttcgtcatcggcgctcagcagtggaggcagcacgtcgtaggaacgacgccaaatgtgcacttgttcgtcaccgtacttttcagcagccttttgcttgttcttgccttgcaaagcgccgtagtgacgttcgttcagacgccaagtcttgaattcaggaatccaaagctggtcgcattcttccagtgcgtagtgcagcgtcttgatcgcacgcttcagaacggaagtgtaggcgtagtcaaattccagaccgtgctccttcagtgccttaccggcagcctttgcttgttcaacaccttctggagccaagtcaacgtctacccagccagtaaattggttggacttgttccattcactcttaccgtgacgaatcagtactaatttagccattgttcgtttgacctctttcttcttttagtgagccgtatataaaatacacaacaattcaagctatattttaaatcagatttttgctcgtgccaatagaaagcactcatttattgtcatgatgttcgcgattgttttgccaatgcatcaagatctcgccaataatcaaggccagaatcgccaaactggtcagtatgttttgcgttggcgtgccatgttcggcaatcagccctctcaacaacgccgtgattcccagactgatcaaaaaatcggctgccagatgaccatgattctgcatcgccgcggctgccatcgccaaaaactcaaacagcagaaagaaggtaatgatcttttccaatactgggtcaaatgaggttaggtgcccggcaaaaagcggcgatagcttaaccagctgccacagttcgacaaaaacaaagccaatcagacacagcccaaagacagccattgagatttcagcaaagcattctaaaaaattaccaacgcgctttgccagacgatcgaatttttccattgtcaccgctccattgttattttttgaccttatcgtatcaaaattccaacggctgtggcagtttttttatggctttcaccgatcgactccggacagctggaattgatgacggtatttctggttaatgcgttgccgattccgtaagatgccaatgctctataaaacactgataaacaactgctcttttggcattcttttaattcgtcatgattttaaaaccggcttaagatcgccgcaaacccagccggcctggctaatggcagcttacggtcttgatcgcccacctgttttttagtcatcaccaaaaaatccttggcaatctgcaggtagatctgatcagcctgcagatattccgcaactgacaggctttcgtcaacctgatgcgacatttcttcccgacccggcccccattcaacgattggaaaacggtgctcatccaatacgtagcgcgaggcatccgtggcaccgtgcgaaacggcaagcggcagcgattgcccggcaacggtttgatatgactgctgcaccagggaaacgaacggatcagccggatcagtcgccattggcataaaactggctacgacctctaattcaaactgaccatccatctccgcgttcaaacgatccaccagcgtctggagccgattctgtaccgccgtattgtcaaattccggaatcgtccgcacgttgccttccagataagcgtagtcaggaatcgagttgagctggcgaccgccgtgaaagaccgtaacgctgtgaatcaggctgcccaggctggggcttgcctttacgtcatcaaacgcatgccgctcatattcaaaaaagcgatccagattggcaacggcattaatacccagactgggatcggaactgtgcgccaggcggccatatgatttcacacggtagtcaaacgagccgctgtgtgcgtattccaagcggttggtcgtcgcctcgcccacaatcatggcatcaacatcgcggaccagtccttgccgcgtcagttcaagcgagcccagaccgccaatttcctcgtcaaccgttgccagcaggcgaaccttgccatgtttgggcagaccggcttccttcagctcaatcaaggtgttgaccattgctgccaggccgcctttcatatcgacgctgccacggccatagatagcatcatcaattacctgaccgcagaacggattatgctgccatttgtttgaatcgccaacgtctacggtatcaagatgtcccgccaaagccagcaccgggccttcctgttcgccaacctcagcaaccagattcgtacgaccagctgccagggcaatcagatcagattcaataccatgatcgctcaatacctgtttaagatattcagcagccggctgctcatgaccattgaccgtattgatttggatcagttcctgcaaaatgttgagcttgacgctgtcttccattttttccacgtccttttactctcattttattttaatctatttttaattttaacacaaaaagccaaaaacgccaatgatcaggcagtccctcggccaatcacaaactggttaaccagcaccgattagagtcacgggatttccggctagcaataattaaacaagcatcctgacttggcaacgatcttgataaaatgcgtcaaacgaagaccatccagcaatcagcttccgtttcaccctaagcatgcattgaccttttcaaagcaaacaatcgggcagcagcaatcgaatcatcagcgcctcatcaacaggccagcagtcaaatcaaaacggccggcagctcagactgagtcgccgaccgttttcgctattttaattaatctttcaaggctttgtcgccaatgtcatgacggtagaagcattccggctcatctaatttagccagatagtcataaaccttgtcttgggccttttgcaaatcgacatcctcgccaatcaccatcaaaagccggccgccgtcaccatgcagctcatcaagatgtcccttaacgttggcatagtcaatggcaatgtctttagcagctgggaacggaccaagcgcctgaccatgcaccggctttttaggatagcccttagaagccagaatcacgcccaatacggcaatgtcacgttcttcaatggcaggcatcggctgatcattgacgttggcatcgatcagctcaaccaggtccgttttcagtcgtggcaagacgacctgcgtttctggatcgcccagccgcacgttatattcaatgactttagggccatccgccgtcagcatcagaccaatgtagatgatgccatggtagttgtagcctgcctggtgcagcccgctgacggttggttcaacgacatcatgaatcatgcgttgacgttcggcatcgctaagctgcggcagtggactgtaggcacccataccacccgtgttgggacccttatcgccatcgtaggcccgcttgtgatcctgcgccattggcaaaatccggtattgatcgtcttgaactacgacaaacatggagtattccggccccaccagacattcttccaagaccagtttttcttcgcccagctcaaacatttccgtaatcgtgtcctcggcttctggcgtcgtctgcgcaatcacgactcccttgccgccctgcagaccattggctttgatgactacgggacgtgcaaagtcgtttaaccccgccaatgccgactttagatccgtaaacgtctcatgcttggcagttggcacgtgatacttgttcataaaattcagcgcgtagtccttagagccttccagctgagcggcttcttgattggggccaaaaatcttcaagtcggctttttggaatgcatccacgaccccagcacacaaagcatcttcagggccaacaaacgtccaggcaattgattgatccttagcaaattgaatcagtgcctcaaaatcgtcttcggcaatgtttaaaggcacgattcccgccgtcaccatgccgatattgcccggtgcacaataaaccgtgtcgacatgaggactttcgttgagcttcttggcaatggcaaattcacgaccaccggcgccgattaccagcaatttcatcttttccattctttaaacctctttcacccaaaaaagcccgcgaaaatcaatccgcggacctgcaaacgcaattagtggcggaagtgacgaacacccgtcattaccatggcaattcccatttcgttggccatgtcgatcgattcttgatcccgaaccgaaccgcctggctgtacgatggccttaatgccgtgttcaccggcaaacttgacacagtcgttgaatgggaagaaggcgtcagatgccattaccgtccgatcatcaatggcatcgccggcatgcttgaccgcaatcttcaaagaatcgattcggttaggctgaccagagcccacgcccagcgtccgttcatcgttggcaaccacgatggcattggacttggtgtgcttaacggctttccaggcaaacatcatcgtcttgagctgttcttcagttggcttgacgtccgtgacgcattcccagtcatgccagtcttctttaagcgtatcctgttcctgcatcagcaccccgcccatgacagaaacgacttcatgccgcgttggctcgtccttggctgagaagtcaaccttgagcaggcgaatgttcttcttcttggccaaaacggcataggcatcttcgtcaaagtcaggcgcaatgatgatttccaagaagatcttacgcattttttcggccgttgccagatcaaccggccgattcaaagcaataacgccgccaaaaatggagactgggtcagctgcataggcacgatcccaggcttgttccagcgtttcgccgcggccaatgccacaagggttcatgtgcttcatagcgacaacggttggttcatcaaactcgcgtacgctgcgcagcgcttcatcggcgtccttgatgttgttgtaggaaagcttcttgccgtggagctgttcggcttccaggattgagaacttcttaggaattggatcttcgtacagccaagccttttgatgactgttttcgccgtagcgcatcgtatccttcaagtcgcaggtcagcgtaagcttttcggggtcttccaaatccaggcgcttggtcaggtattgcgagatcagcgcatcgtaggccgccgtagtccggaatgccttggcccccagcatcgtccgcgtttccagcgtcgtgttgccgtgcgccttgatttcgttaagtaccgtttcgtaatcgttgatatcagttacgatcgtcacgtcgcgatagttcttggctgctgaacgaaccatggaaggaccgccaatatcaatgttttcaatggcatcggccagcgtaacgtctggcttttcgatggtttccttgaatgggtacaggttgacacagaccagatcgattggcgtgatatttaatttgtccaacgtgtccatgtgttctgcaacgtcacgacgcgccagcaggccaccatgaacatatggattcagcgtcttaacccggccatccagaatctctgggaagtgggtaacttcttcaatactgatggtcttgatgccggcttcgtccagcgtcttcttcgttccaccagtcgaaacgatttcaaagccattttcactcaggcccttaacgaaaggcaccaggttggtcttatcagatacgctaactaatgcacgtttcattggttgtttttctcctttgcaatgcgttcagtcaaaattttcttaacggtttctggatacagttcatgctcggtttcgtgaacccgcgtctccagcgtgtcgaccgtgtcatcaggatagattggcacatgccgctgggcaataatcgtccccgcatccagatttgaatcaatgtagtgaaccgtaacgccggtttctttgcgatgatcggcaaaggcccgctcaatcgaatgcaggcccggatattccggcaaccaagcaggatgcaggttgacgatgctgccttcgtatttatcaagaatcgttggtccgataatgcgcagataaccagccaaaacgataaagtcaatgtcgtattgcttcaacacggccatgattttttcttcataggcctgcttggatccgcaagacttcacggtaaaagtttcatatggaacgcccagtctttgagcgcgtttgattacgtaagcatcggggtgatcgcaaaaaagcagggcttccttgccgggaatatcaccattttgaaaatgcttggtcagcacctcaaaattggtcccgttccccgaggcaaaaattgccacgttcatgttcttgcctcttttattcaataatcagtttttcttcatcagctggtcgatcctgcagtcggccgatctgccatgagtcttcgccagcctgctttaaagcatcctgaacagcagcaacgttttctggcgccacggctaaaatcatccccagccccatgttaaacgtaccgtacagatcatcagcatccaagtcgcccatcttttgcagatagctgaaaatcggcagcttgggccaggtgctggcatcaaccacagcctgcagcgagtcagcaaacatccgcggcagattttctggcaggccgccaccagtgatatggctaaccccgtgaatcaggccctttttgatcaacggcagcaccggcttgacatagatacgcgtaggcgtcaacaatgcctcgccaaccgtttggccattcagttcggccggctgatcactgagcttaacgtcattatccttaaacagtacctgacgcaccagcgagtagccgttagagtgaatcccggatgaggccagcccgatcaaaacgtcgccggcttttggcaaggccgtcgtcagcatcttgtcttgatcaacgacaccggtagcatagccagccagatcgtattcatcttgactgtacatgtcaggcatctcggccgtttccccgccaaccagggctgccccggcttgacggcagccttctgccacgccagatacgatctgggccatcttgtcaggcgtgttgtggcccgttgcgatatagtccaggaaaaacagcggttccgcgccctgggctagaatatcgttgatgcacatggccacgcagtcgataccgatcgtgtcatgacgattcagcttttgggcgatcaaaagcttggtccccacgccatccgtacctgaaaccagaattggatgcgtcaagccggcaaccgcggtcagatcaaacatcccgccaaagctgccgatgccgccgacaaccccgggacgatcagttgaagcaacggcatccttgatcttttttaccatttcatagccggcattgacgttgacgccggcttcttcataacgtttccgcttcatttggagagtcgttcctttcgcgcgcgcttttcttgttcgttcaacgacttaagatagccttcttcaaaatcatacagcggcgttgggtagtcgccattaaagtaggccaccgtcagcccgccatatggtgcatcaccggcatccggaacgttaatggccttaacgacgccatcaacgctcaagaatcctaatgagtcggcttccatcaatttacacatctcagggacggaataatgggccgccatcagttcagctcggttggaaacgtcgatcccataaaaacatgggaaacggaatggcggcgaagcaatccgcatgtgaaccgacttagcgccagcttctttcagcatccggacgatctgcttggaagtcgttccccgcacgatcgaatcgtcgactacgactacgttcttgccggcaacgaccccgcggacagctgaaagcttcatcttaacgccttgttcccgcaatgcctgcgttggctggataaaggtccgggcaacgtattggtttttgatcagccccatttcataaggcagaccagctgcttccgcataaccagaagctgcagaaagcgaggagttcggcaccccaatgaccatgtcggcatcaggtactggctgttctttggctaacagccgccccatctgcttgcgggcactgtgcaccgtcacgccatgaataatggagtcgggacgggcaaagtagatgtattccattgaacagatggccagcttggtatcatcagtataacgatcctcatgcagaccatccttgttgatcaccagcagctcgcctggctggacatcgcgaatcagcttggcgcccacgatatccaaggcacagctttcactggttacgacataggcgccatttggcatctgacccaggcaaagcggccgaataccattaggatccaaagctgcaatcaaccgatccttttgcaggaacaagaaggcaaagccccccttgatcatgttcagcgtcttttttaaggccggaataaagcccatgtgaatgttttgccgaatcaagtgaatcagaatctcagtgtctgaatctgattgaaaaacggcaccgttgtcttccagcttgcggcgcagcgtaacggcattggtcagctgaccattgtgtgccatcgcaatgtcgccatcatgaaaatggaacaaaaatggctgcacgttgttgatcgaattatggccactggtaccgtagcgaacgtgaccaatcgcggcatccccgatcagacgctccatatcgcttggatcggcaaagacttccgaaagcaggccacgatcccggtgctgataaaggtgctcgccgtcagtcgtgacgatcccggccccctcttgtccacggtgctgcaggttgtgcagaccaaagtaggtgacccggttggcttctggcacgccaaagacgccaaaaaccccgcactcttcatttagtcctttgatttcattgcgcatggcaaagcttcctcccaaagtttttgcatttgagccactggcaagttgagctcagcatcagccagatggatttccagccattgcgttgctgcaacctcaccagctggcatcgcgtcgtcttgcatgatttcttcaaaggccgctgcattttctggtgccacgctgaccagcatccggcccggcgtttcgctgaagaactgcttcttgtccaatgcgcggaaatcagcgtttaagcctagttcagtcttgaagaccgtttcagcagcagctacggccaaaccaccttcgcttaagtcatggtcactggcaaccagaccgctttgttcagccttcaacaggcggctcagatagtcatgaacgtgttccagatcaaagtcagccaacgtaccggcaatctcgcccgtcatcatcttctgcagctcggaaccggcgtagtcatcgccagtcttgccgaccagatacagcttgtcgcccgcatgctgaacgcgggatgggatgacgtacttggcatccttgatcagtcctaccatgccgaccattggcgttgggtagatggctgagccgttgttttcattgtaaagcgaaacattaccggaaataactggcgtatcaaagacgcggcaggcctcagccattccttcgattgagtgatgcagctcccagaagatttctggatcggttggatcaccgtagttcaaacaatccgtaatggccaatggcaaagcacctgaggcaatgatgttagaagcggcttcaaccaatgcaatcttaccgccaacgtatgggtttaagtagaccaggcgaccattgccatcagtcgtcatcgaaagtgcctttttggttccgcgtacccgaataaccccagcatcagaacctgggccaaccaccgtggaagtccgcacctgcgagtcatattgacgcgtaatccatgacttgtcagcaatcgttggctgcgtgagcaattcttgatagactgctgcgacgtcatcgatttcagggacccagttggcagttttttcggcatcaatcagacgttgtggcttcttttcttctgattcaacttccaaaacgtcatccgtcaaggttgagactggaatatcacagactacctgaccatcatggtgcaagacgtattggtggccttccgtgatccggccgatcgttacgacttccagatcatagtagtcaaagatcttcttaacgtcttcttcgtggcccttcttaacacacaaaagcatccgttcctgagattcactcagcatgatctcataagctgacatccccggttcgcgctgtggtaccaaatcaagatccaggtccatgcctgagttaccttcagaagccatttcggcactggaggaaacgatgccggccgcacccatgtcttgaatcccgaccagccattctgcatgatcttgaatcagttccaggcaggcttccatcagcagcttttccatgaatgggtcgccgacttgaacggccgagtgctgtgactcgttgccggaaccaaagtcagccgaggcaaacgttgccccgtgaatcccgtcacgaccagtcttggccccaacgtacatcacggcattgccaaccccagaggcattcccttcctgctggttcttttggtccatcaagcccacactcatggcattaaccagcagattacccttgtagcaaggatcaaaggtcgtttcaccagcgacggttggaatccccatgcagttgccgtagtcgccaatcccgcgcacaacgccatcgactttcatccgtgtctcggcatcgcttaattcgccaaagtgcagcgagtctaaggaagcgattggccgagcacccatactgaagatgtcgcgtaaaatcccgccgacaccagtagccgcaccttggtatggctcaaccgttgatgggtggttatgactttcggccttgaaaacgactgcctgaccgtcatcaatgtcaacgacaccagcaccttcaccaggcccttgcaaaacccggtcattcttgttggggaacagtcgcagcactggcttggactttttgtaggaacagtgctcggaccacattgccgagtaaaggcccgtttccgtgtagtttggcaaacggtgcagcagcttttcgctgatgtagtcatattctttttcagacagactccagtcgagatatggtttcttttccttaatttcttcaggggtcattgcttgcttcattctaattatgcctccgtcttaaccgtaccgttttccaataaagacttgaacagccgcaaaccgtccgtcgaacccaagagtgcttccacggcgcgctctgggtggggcatcatgcccaatacgttgccgcgcttgttgacgatccccgcaatgttgcgtaaagagccgttgggattttcgcttgcgtagcggaacacgacttgatgattggcttccagctcatccaagattttttcatccgcgtagtagctgccttcaccgtgtgcaattggcagggcaatgcgttcgtgagcctggtactgcgtggtaaaaagcgtgttgttgttaacgacttccaaaggcaccgtttcacagacgaacttttgactgtcgtttttcttcagagcacctggcaaaaggcccgcttccgttaaaatctggaagccattgcaggtaccaaaaaccggcttgccttcattagcgagcttgatgacagcgggcataacgttggcgaaccgagcaatcgcgccggcccgcagatagtcgccataggaaaagccccctggcagcatgaccgcatcaaagccatccagactcgtggccttgtgtgaaacgtattcgacgtcggcattgcagacatcatgcagcgccgagtacaggtcgatgtcacagttcgagcctgggaattgaatgaccgcaatcttcatttatttcgcctccagcacttcaaacttgtacgtttcaatgttgaagttgaccagcagcgattcagctacttccttaaccgtgttttcaacggctgcttgatcgccttcaacctgcagatcaaagaacttgccaaccgtcaaatccttgacttcttcatgacccaactggtggatggcatttaaaacggattcggcttgggggtcaaaaacagattgcttgtaggtaacgtaaatacgaacggtagtcatttgattagtcctccttaacggcttcttgcaggcgtgcgtaaactttatcataggtcgtggtcagatcggccaggttcttgcggaagacgtccttgtccatgtgagcgttggtcttgatgtcccacagacggcagttgtcaggcgagaattcgtcagccagcaccaatgagccatccgaaagcttgccaaattccagcttgaagtcaaccagcttcatgccagccttcttaaacaatggcgtcaaaagcttgttgcagcgacgggccagttcccagcattgttgatattcttcatgcgtgcaggccttaatggcaaccgcgtcggattcattggcgaatggatcgtccaaggcatcgctcttgtagaaggtttcttcaaccggttcgtccagctccatgccatcctctaagccgaaacgggaggcgaagtggccggcgcagacgttgcgcgtaacgaattccagcgggaacatgtggcacttcttaaccaattcttccttttcagaaaggcgcttgatgaagtgagttggaatgccgttatcaatcaggtattcaaagaccagcgttgagatgtcgttggctgcttcgccctttccgtcaaagtggtccttacgcttaccgttgagcatcgttgcctgatccaggtaaacaacccgtaaaacgtcaggatcttcggtttgccacatttgctttgctttgccggtatataacagcttttccatttttgattgccctccttataggctaaaaacgaattgatgaattggttaacggaaaattgttcgttaaatcctgctattatcgtacgcatatttttaaaaatcgtcaagcgtacaaccgaacctttttcagtttttaatcataaaataatggtttttctaagtttaacgtttaactaaagctggtttttaattttatagttcgtgttttaatcgatttcaagtcaaacaaaaaagcaccgatcatttcaatcgatgctttggtttaatgataactaatcgtctaagccaacccgcttgaagatgtcgtcaacatgacgcaggtgccagtggtagtcaaaggcatcatccagatcttctttagtcagctgcttttggatggttgggtcagcttccagcagtggccggaatggtacttgttcggcccagcacttagccgtgtatggctgaatcagatcataggcattttcccgtgtcatgccggacttgaccagcttgagcagtacccggccagagtagatcaggcccagcgtcttgtccatgttcttcttcatggtttcagggaagacgtccaggtttgccaggatgcggccaaaacggtgcagcatgtagtccaacagtgccgtcgtgtctggcagaatcatccgttcagcactggaatgagaaatgtcgcgttcatgccacagcgccacgttttcgtaggccgtaacgacatggccgcgcaatacccgcgcgcagccgcagatgttttcggagccgattggattgcgcttgtgcggcattgctgaagaacccttttgacccttggcaaagtgttcttcaacttcatggatttccgtccgctgtagggaacgaacctcagtcgccatttcttccaagctggtcccgatcaaagccaaagcggcgatgtattcagcatgcagatcccgtggcagtacctggctggaaacttcttgggcccgcagaccgagcttttcgcagacgtattgttcaacccgcggatcaacttcagcaaacgttcccacggccccagaaatcttgccagcttcaacgccagctgccgcgtgttcgaagcgttcgtagttgcgcttcatttcagagtaccagcgggcaaccttgaggccaaaagtcgttggctcagcgtgaattccgtgtgtccggcccatgcagaccgtgtacttgtattcattggccatctttttcaggatttccatgaagtccttgatgtcttgacgcagaatctcgttgacctgcttaagctggtagccttgcgccgtatcaacgacatcagtactggtcaggccatagtgcacccacttgcgttcgggacccagcgacttggaaacgtcacgcgtaaaggcaatcacgtcatggtgcgtaacggcttcgatttcttggatgccttcaacggtgaacttggcgttttgcttaattttttcaacgtcttcggctggaatcttgcccagcttgctccaggcttcatcagccgcgatttctacggccagccaacattggtagcgggtttcatcgctccacagcttcttcatttctggacgggtataacgatcaatcattaatcttttctcctattcatcgtcccaaacatgggaatctttaatttgctttaacgttgcttctatatcatcggtcaaaatggtaacatgccccatcttgcggttgtggcggctctcagccttgccgtaatcatgaaaatgccattgcggatattcatgaatcaagcgccgcgtgccggccacgtgctgccccaagacattgaccatcacgactggactcatcaatttgatcttaggcagcggccagttgcagattgcccgattgtgaaccgcgaactgcgagaagttgcaggcctcgattgtgtagtggccagagttgtgcggccggggtgccagttcgttaacgtagagctgaccatctgcaccgacaaacatctcgacgcccaagatgcctttgagatcaatcgcttcggcaatcttttcggccatctgctgagcgcgctgctgccattcaaccggcatgcgggcgggcacgatgctcaaatgcagaatttcatgagcatgaatgttttcactgactggaaagacggtaatatcgccatcggtattgcgcgctaccataactgagcattccatcttaaatggtacccagccttccaagatgtcatcaccatactgcagtacttcttcagtaatcggatcatccaagtcttgcgcactctttaataccatctgaccatgaccatcatagccgccttcacaggtctttaagacacagggatagccaagtttttccacggccgcgttcagatcagcccgattcttgaccgctgcaaatggcgccgtctgcaggcccgcgtcgcgcaaaaacgttttttcgcgaatccgattcttggtcgtgtacaaaagattggtcccctgaggaatggcgacttgatcagcaacgtcttttaaggcttgcagatcaacgttttcaaactcataggtcaaaacgtcagcccgccgcgccagttccttgatcgccgccacgtcggcatagggcgctacgatctgatcatcggctgcctgagcggctggacactgtggtgtggggtccaaaataataaccttcattccggctgccttagcagaaaaagccatcatctgacccagctgaccaccgccaataatcccgatcgtcttgccctgttcaatataggcttcttgatgcttagtcaagttcggcattgctggccaccgccttgtcatgcatttctttacggaaagccacgatcttgtcttgcagggcttggtcattgatgcctaaaatctgaatggccaataaggcagcgttcttagccccagcattaccgattgccgtagtggcgaccggaattcccgctggcatctgcacgatggaaagcagcgagtccatgccgcccaacgccttggtctgccctggaatcccaatcaccggcaatggtgtgttggccgcgatcatccctggcagatgagcggccccaccggcacaggcaataatgaccttaacgccattttctgccgcgtgctgggcaaaatcgaacatttcatttggcattcggtgcgctgagataacctgcttatcgtacttgacgccaaactgatccaaaatatcacatgcttgcttaactgttggccaatcggacttgctgcccatgaccacgctgatttcactgctcacaatggcacctcctaaaaactgtctctagcatagcaaaagttttcggcaaaaacaagatttttcacgaaccagaagaaataagagaattataatgttcgtctttatcataatgatcccaacgcaaaaaagagcgcccgccgcgcccttttctttagtaatcttagaacaaaccggtaatgttgccttcaccgtcaatgtgcatgttaacggcagccggcttcttacccagaccaggcatcgtcatcacgctgccagacagtgctacgacaaagcccgcgcccagcttaggaacgaattcgcgaatgtggaacgtaaagtcggttggcgcacccagttccgtttgatcatcggtaaatgagtactgcgtcttggcaatgcagaccggcatgttttcccagcccatttcatggaacttcttgagctgtttttgagccttcttggagaattcaacgtccttagccccatagatggtcttggcaatcgtgttgaccttgtcttcaattgagtcgccctcaacactgtagagctcatggaattcactcggctgatcagccagcttaacgacttccttagccagatcaaccgtaccttcgccacctttagcccaggcatcagccagaaccacgttgacgcctaattcgtggcaattgtcttcaatggtcttaatctcggcttccgtgtcaaaggtaaagtgattgatggccacgacaaccggcagaccatagcgctgcatgttcttgatgtggcggttcaggttggccagccccttcttcagtgccggcagctgttcatctttcaggtcagccagtgccgcgccaccgttatattccagtgcccgcaccgtagccacgattaccaatgcgtcaggcgtcttgcccagtaccgaccgcttgatgtccaagaacttctcggcccccagatcagcaccaaagccggcttcagttaccgtgtagtctgccagctgcaaagccgtcttggtagccagaaccgagttgcagccgtgagcaatgttggcaaatgggcccccatgaacgatggccggcgtgtgagccagcgtctgaaccaggtttggctttaaggcatccttaagcagaatcgtaatggcatcgctaaagccaagctcgccaaccgtaactggcttttggtcgtaggtgtagcccactacgatcttggaaatccgctgcttcaagtcagccagatccttagaaagacaaaggatggccatcaattcagaagccgccgtaatgtcaaagccggtttcacgcggtaccccctgcattacgccgcccagaccggttaccacgtgccgcagcacccggtcgttaacgtcagccacccgcttccagataatgcggcgtgggtccaggttcagttcgttgtcccgcatgatgtagttatcgatcaaagctgccagcgtgttgttggcactggtcaaggcatgcaggtcacccgtaaagtgcaggttgatgtcttccattggcacgacttggctgtagccgccgccagttgcgccacctttgatcccaaagactgggcccatggatggttcccgcattgcgattacggtttggtggcccagcaggttcagggcatcccccaagccgaccagcaccgttgacttaccctcaccagccggggttgggttgattgaggtcaccagaatcagcttgtgctttttgtcaggggcttctttgaccggcagatcgattttggccttgtacttgccatatggttcgatctcatcggcacttaagcccagtttttcagcaatcttggtaataggttccatttcggcagcgttggcaatttctagatcagtcattgatgcggttcctccatttcgtaaaaagcgaacattttagcgtatgatcagctaaacaaacttcaaattaagtacattcataacaataacgactttagtatgatttgtaaaccgtaaattgtcaaacttaataaaaaagctccatcctgaatgaacggaacttttctactattatataccattattaaagcgcttttaagctgattcgccaagataggcccgcttaacctgaggatcgttcaatagcttttcaccgctgcccgttaactggatctcacctgatgcaatcacatagccccgatcggcaatcgcaagcgcttggtgagcattttgttcgatcagcagaatcgtggtcccctgcgcgttgattttttgaatgatgtcaaaaactttttgaatatagattggcgccagtcccattgacggctcatccaaaagcaagaggtctggattggccatcattgcccgcgccatcaccaacatctgctgctcaccgccggaaagcgtcgccgcgtcttgatgctggcgttcctttaaaatgggaaacatttggtagatttcttgcagacgggcttcaacctggctgcgatccttttgcagataagatcccagctgcaggttctccatgacggtcatggccggaaaaacatgccgcccttctggaacctgagagatcccagctgccacgatctgcggcgcttttttgcccaccagcgattcattttgatattcaattgatccggactgcggcttgacgattcccgaaatggttttcagaatcgttgacttgcccacaccgttcgccccaatcaaagttacgatctcgccttttttcacttcaaaatcaacgtgacggactgcttgaatcgcaccatagctgatacttaagtccttaacctgcagcattggcattacctcccaaatatgctttgacaacggctggattctgactcacttctttcggcgtaccactggccaaaacctcgccttgatctaaaacgtaaatccgttcagccaggctcatcaccaatgacatatcatgttcgattaaaagaacggccagattgttctcatcacgcagctgccgaatcatcttagttaattccgcggtttcttcagggttcatcccggcagccggttcatccaaaaagataatcttggggttggttgccagagcccgcacgatctcgacacgccgctgcatcccataaggcagcttattggccggactatcggcaactgccgtcaaatgatagcgatcaatcagtttttgggcttcatcgttcatctcccgctcggtgcgataatagcccggcgtatgaaaaatcgtactccagaaattttccttaaattggttgttcaaagctgccatgatgttttcccacaccgtcatatcaccaaacagccgaatattttgaaacgtccgcgagatgccgtgctgggcggcgctggtggctcccttgccgctgaccttgtagaagcgcccatcatgacgaatcgcgatcgtgccgctggtggctggcaaaaggccgctcaacatgttgaacaaggttgtcttaccagcaccattgggaccgattaaagcgaccaactcattatcatagatcgtcatcgaaacgtcattgaccgctgtcagcccaccaaactgccgcgtgacgttgcgaacggttaacaatttctctgccatagttgctcctttctatgattcagcggccgcctgctttttggccgtacgttttgccagccatttgccaattgaaaactcgcgccggcccatcaaaccacttggcttagcaatcataatgacaatcagcatgaccgcgtagataaccatccgcaacgagccgaagttttgcagaatcgtgtcgattgcgcctaagacgacggcagcaattacggatccagtaatgctgccaatgccgcctaaaaccacgataatcagaatcgaaaccgactccatgatgttaaagttgcttggggcaatactctgcaagtaggaagcatagagcgaaccgcctacagctgccagtgacgcgcccattacaaaggccattaatttgtacttagttgcgttgatgcccatggccgtggccgccagctcgtcattgcgaacagcgcgaatcgcccggcccgtcttactgtgaacaaaattggcaacgataataatcgtcagacacatcataatgtaaacgagcggccaagtggcaagctggggaatgttgtagagcccagccggtccattggtaatctttaagttattggcgatcagccggataatttcggccgcccccatcgtcgcaatcgctaaataatcgcctttaagccgcaaggttggaaccccaacgatcagagcaatcacaatcgtaatcacaatgccggtaatcatggaaaagatcagtcctgcaaatgttgattcagtttgcgtcataattcccgttgcataggcgccaattgccataaagccggcatgacccagcgaaaactgaccagaaaagcccacgatcaggttcagactgacggccaggatgatgttgatgcccatcataaccagcatgttctcgataaacgtatcaaccacgccagtcatttcaccagcatagataatgccgtatccggctgccatgcagacgaaccagatggcaatggtctgccaacgtgttttcatcttcgcgcctccctaaaccttttctggctgcttgttgccaaacagacctgctggcaagaacagcaatacgataattaaaacaacatagacggctgcatccttgaaagctgagaagccaatcgcctgcatcagtgattccagacagccaataatcacggccccgactgccgcccctggaatggagccgacaccgccaacgactgcggcgacaaaggctttgatccctggcgtcagccccatcgttggttcaatcgagttgtagtacagaccaatcaaaacgccggccgcgccagccatagccgagccaattacaaagacaaatgaaatcgtaccgttgatattgatccccatcagttcagctgctactggatcagccgcggccgcccgcattgctcgacccatcttggtcttcttaacgatcagctgcaaaataatcatcaaaataatcgtggttgcaaagatcaacagctggatattggttacccgaatgccgaaccattcatagttaacctgtttgatcacctgaggaaagtcacgggtgtcgccagagaacaggaccgacatgccgttttccaaaaagtaagacaccccaatcgccgtaatcaaaacggcaatccgtgatgaatgacgcagcggccgatatgcgacaaactcgatcagcatgcccaccagagcgcagaagatcattgagccgaacagcgccatgataaagttgaaatgccaaacgttgatcgtatagtagccgaagaacgcccccagcatatagacgtcaccatgcgcgaagtgaataatcttgataatcccatagatcatcgtatatcccaaagccaacagcgcgtagatgctgccgagcgagagaccgttgatcagttgctgcataaagatttgcacggttggtgccccctttctttaattacttaacagtgtagccggcgacaaccttaccattggtcatttgttcaaccgacatcttcatttgtggatcatggtgcttgttaactgaaatcgtaccagtaactcccttcatgttcttggtcttagccaaggcttccgtaatcttgttggaattggttgagtcggccttcttgatggcattggcaaccatcatcgtcgcgtcgtagcccaatgcagagtaggttggtgcagtttgaccgtacttagccttgtattccttcataaacttacgagcttcggcattgttcttagccgtaatcgtggagaatggcgtcgtgtaataaacgttggttgcgtttgaagcaccggcaatcttggcaagctttggatctgccattccaccagaaccaatgattggggcattaattccggcttcacgagcctgcttaataattacaccgacttcagagtagtagcccggaacgtagatggcatcgatcttcttgttcttgatagccgtgatcaaagagctaaagtccttgtcgccttcttggaaatactgcgttgaaacgatcgtacccttaaagttcttcttaaatgctttggcaagtcccgtcccgtagtcactggagttatcagccaagatagctacgcgcttagccttcagatgcgtgttggcgaagttggcagccacttgaccttggtagttgttttgtgcctgggcccggaagacgtacttttgaacgccacccttcttagtccgcgtaaagctaggatcagccgcggttggtgaaaccagtggaacctgcgccttagtctggtttggaatagctgccgtagccgcgttggtcgttgcggggccgaccgtagcaataaccttgtccttggtggttaattgtgaagcaaccgaagccgccgttgaagttgaggtcttgttgtcgcgggtaacgatcttaaccttcatcttcttgccgttgaccttgataccgccatttttattgatgtcatgaacggcaagcttgatcccattttcttcttgttgaccatagccagcggccgcgccagacagttccatgttgaccccaaccttaatcgtattgcctgaagctgagttgcctttttgcgaaccagttgcggaacatcctgctgccatcatggtcatggctgccatcattatggcaatccccgttttcttatttttaatcttcataagcctgactccccttgtttaatttttctcatcattcaatcaatcaaatattttgctgactgcatttgatcaaagaaaaaagccctcatccgcaatggaatgagggcttttctcaaccggtatcgatcggccctcatgccaacagaaagaagggctcaatcgctgatcagcaaaaatgcttaatcacgcaaccgggtccttgacctgcagtagcagtagggcgttcaattgaagagccatgttgttgagttgtacgaataattgctttttcatgatccatggctcctttcttttgccgtagtaaatatttgatgtgtcttagtctacgagttgatcattagaaagtcaacacgttttttaattcgtttttaattttttattaatcaacaatttaaaacgattgcttttgaatgagaatgacaatccacaactatctcgcattgcccaacgccgcccttcttaaatttcgaagcgcccacgccggatgccctgttgataaataaaaaccagcaccgattttcatcaatgctggtcattaaacctattcactttgtttttggtccccaatcgactttatgcccatgatgtcaagcaggaaagtaaagatcggcacgccgacgatcaagccccaggtaccaaacagcttttcactgaccagcagcacgacgaacgtataaaagatcggcagttccgtacgactggacataaacttgggattcaagacgtacgactccaaggcatgaattgcaataatcataatgatgatgtagatcacatcgcgaatgccgccaaccgaatagccaaccatgctcaaaggaatcagtgagatgattaccccggcaaccggcaccagactgaagataaagaccatcaaagccagtgccagaatctgcggcatatgcataaacatcaagcagatcgtcgtcagcgccgtgttgcaaagcgcgatgaagaactgcgcctctaagaccacgccaaacgtattgacaaacttcttaccaaaaaagtagatgtcctcaaacagccagctgaacaattcactagttaaaaacaaacggctaaatgaatacatctgcttgagctcaatcgtgtaaaagaagctcagaataaatgacatgaagaacgtcactgccatcttcgtcaggctggttaaagttgaaaaggccaggttgatgccatgcttgacctgggctgtgacggttttggcactaatgtagtgattgagctgtttgatcagccaagaaccatcctgcgattgatagaattttaagaccgaattgaccatctttacaatctgcgtgatcagcagcggcaagtatttggttaccgcaaagtagacagtcgcaatcaaaacggcataggttgccaggaccaccagcagcgagggcagtctgggaatccagcgctgtacgaagcgaacccagtgcacgacaatgtatgtaaagataaacgtcagcagaattgcgctcagcattcctcgtaccaaatagagcacccagatcaacagcgccaacactgcaaaccgccttaatggtacgttatcgatgaatcgatgccatgcattgaccatccaatccctcctatttttagacaatttagcctaagtatagcatgcaatgatgcaaattccgcctaattttactgcctggtgtataataacctgcatacggattggaaagaaggaaaagcacatgttggaaaagacattttataaagtcctgctgagtcgctcatttaccatccccgtcaaaatcgtattctgggatggttcctcagtcgtttacggcaatggcgagccgcaagcaacaattcggttcaacgagaagatcccagtgcgcgacctgaccaaaaacgcttcaatcgctttaggcgaggccttcatggataagaaaatcgaaattgacggcagcattcaaaaagtcattgaatcggcctacgaaagcaaagacagctttatgcgcagcagcaagttccgccatatgatgcccaaacagagtcatggtgaaaaggaaagcgccagtgacgtccaaagccattatgacgtcggcaacgatttttataagctgtggctggatgacacgctgacctattcatgtgcctactttaccaatggcaaccacgatgacctgacagctgctcaaatggccaaggtgcaccacatcatcaacaagctccatccgcaaccaggtaagacgctgcttgatattggctgcggctggggtaccttgatgctgacggctgctcgcgaatacgggctgaaagttaccggcgtcacgctgagcaaggaacagtatcggctagtgcagaacacgattgaaaaagaacacctgcaggacgtggccgaggtcttgttgatggactatcgtgaactgggcgatcggcaatgggactacatcgtttctgtggggatgttcgaacacgtcggcaaggaaaatctaggcctgtactttaaagacgttgcccgctacctgaccaatgacggcgtggcactgattcatggcatcacgcgacagcaaggcggggcctacaacggctggatcaacaagtacatcttccctggcggctatgtccctggactgcaggaaatggttggccatatcgttgaaaacaacctgcagattgctgatatcgaaatgctgcggcgtcactatcagcgtaccctggaaatctgggacatgaacttcaacgcgcaccgggcccacattcaagacatgatgggtgagcggttcacgcgcatgtgggatctgtatctgcaggcatgcgcggcctcgtttgaatccggcaacattgacgttatgcagtttctgattaccaaaggcgcatccggcaagaacctgccaatgacgcgcgactacatgagcaacaagcactaaataaaaagatccgtcacgtcagcagcgtggcggattttcgtttttgaagattaaggcagtctggggcttgcaatggatcttataagaatgccagtgcaggaaccagtcagtcaacaccaccagttacgaaataatgcttgtcgaattgaatctggcaagtgccatccagtcagtcaacgccggcaactcgcttcagttccgtcaatgccagcggaaattccgtaaagccatcgctggttaggaaatgaccgccattaggacgcacaatcagcttagcccctaactgattggccatggcaaccccgaattggtaaggcgcgatcggatcattttgcgctacgatcacggtcgcgcggctgatctttggccgtacctggcgatagtcaacgctttcctgcatgaatgcatccagtccggcatagtttggcagcggctgatcaaacgcccccaccaaaagcaggcccacgttcttgacgtcatgacgagccagccagcgcactgccgttatgcagcccagactatgcgctaccagcgtaatcccatcttcggccttgatttgatcatcaactgcctgattccatgctgcctgttgcggggcaaacggatctggcaaccagagacgatccagctcaattgccggccgggccgctttttccagccatgggaaccagtcatcatcacgagtagaggtcccatgaatcaaatatgctttcttcatcaaattgctcccctcattttatcggttcttggtccaattataagctgattcgccccatccagcctaactcaaagtgaaaaagcaatttcaaatcgaaccaggcaatcacgcaactatttggctaaccagtgacggattgaatagattgaccgaattgactaaaagatggcaaattaactggtgcggacattctgacagccgccaatggaatactatcggcagtccaaatggcaggtaatcaccaatgagaccttacccgtagtcgagcagcagccgatgcgtcactacatttagccgatcagtcaccgatgcattgctcatagcactcgctttgcccaaaactgaaattcgaacacgtcaatttggcaaagccattatgatgcaccacaacgactcaatgatcaaaccgcaatgaaatttaaaaagcgccattttcagccggcgcggacagttccgacgcaaggcagcccatgatgattggtctcagaacccagccatcatacacttgaaaatgacgcttcaattatttgcaattattttaaattaccaaagaaatcagccataccgcagccagcccgccgattactgaaacggccatggaacgcgtaaagtaggcaacgatcattacgataacagctgccaggatttgactgacatgaccaaatggcacaaaggcgtaggtcttactcataaagatcgacttaacgaccaatgccgtaaacagactgaccggcacgtacttcatccattcgttaaaccacagcggaatcttccggttggtaaagaaacgcattggaaagtagcgcgggatgaatgccgcaatggccgcgatcacgatgacgatcaaatgataggtcagattgtgatgactgggcaccaacgacagcaccggcataccagttaataaatcactcatgtctatttatctccactcgatttcttgctctcctgcttgaccgctgccgaatcactagctgcttcatcggttttggcatcattttgcagtttttctttcaactcggctttcagctcggcctcaacctcagcttcccgatccttttcctgccggtcgctgatcgtatcacgcgatgaagccggtcggaacagtttgcgcatgatccaggcatcatcgggatgatcagaacgttgacgaaccgtattttcgatcatgaaaccgataaacgaggcaatcaaagtagcaataatgattcccagcgtactcttggtcaggctcaggaagatgactgccagtaccgctgaaaccagactgatcaacagtgacaagtgattgcgcacctgcattacgatcatgtacaagaacagcgccgtcaaggcaaagtcaacgatttccagatcgatgtgcacggcactgccgatcagaccgccgaccatattgccccccgcccatgataaaagcgaatagtgctctaccaacaaggcatctttaggcgtccagtttttgtcggtcgcaaatttcagatagttgacggcatagttttcgtcgttcattgaaacggaaaacagccaaacgaagcgctgcgactcattttgcatatacttggaaagactggatcccagcaatgcatagcgcagttccaagaaaaacagcgtcataaaaattgaggagatgggtgcatcaagcatcaacagcgaagccaagatgaattgagccccaccggagaaaaccatcaccgaaacaagaaacgtcagcaggaagttcatccccgcggagtgtaacaaaatcccacaggcaacgccaattggcacgtaactcaggcaaagcggcatcgaaacgcctaagacctgcagccatctggcaccttctggattgatttgctgtgctttagccaaaaagtatatcccccagcatttaaatgtttttcatcttttatctcgtattcctttgaacacgatgcaattccagtctaacatatttaaattttaaagaataccagaatagcccgatttagttcggtttttgctgatcgttaagcaaaactgattttccgactgcctaaatcattgccagcacgtcagcccaacgattcagccgactgcgctttaatagatactcaactactcagctggctgtgctttagctgcgtctccattgaccgctgcttctgatggcgcggtttgactggctggcagcaccacggtaaaggcagtttccttttcatcagaggctaccgagacctgaccatgatgccgatccacgatgcccttgacgattgccaggcccaggccagtcccgccagtcgctttggaacgcgatgactcaacgcggtagaaacggtcaaagacgtgcttgagcgacttttgcggaatcggttccccgttgttggcgactttgacgataatcatttcatggtagcgcgaggccgaaagcttgatccaggttgctccacgaccatacttcaaggcatttgacaccagattgctgaaaacccggcccagtttttccggatcggcttcaatcatcagcggtttgggatcaacatgcgtggaaatctcaattccttttttctcggcttccagctcaaaactggcgctgacctgttccaacagcggatctagatcaaccttcattaagttaagcggggcgccatgctgctgcaccttggtaaattcaaacagatcatcaaccatgcccttcatctgcttggctttttcataagcaatgtggttgtactgcaaaatgtcctgctcactgcggtactgcttatcttcaatcaagcccaagtagccgataatgctggtcagcggcgtgcgcaggtcatggctgatgttggtgatcagctcatctttggacttttccacctgccgctcatcatccattgactgaacgacgctatcgaccagcgtattgacactggtgatgacgtcttgcagcgaaccgttgagcttaaatggaatgcggtgatccaaatgtccctgcgcgatgtaatgcagctctctgataatgtgatcctgctggtattgccggtagcgccgcatcaatcgccaccagaggacccagacatcgatcaccagcatgatgccgatcacgatacgctgatagctccaaatgcgaatctccatcgggccaaacgccaaggactgcttaatgatgaaaatcccactgttgacgccaggattatgccgcacgatccattgcagaatcacgatgatggccagattgatcatggccagcaagatcactgttgagacgccctcgaaaaacagcgagctcttttcacgcgtagttaatttcaaactttacccccctaaccgcccacggaaatgccgcgagcctgccgatcaaacatgataaaaggcccaatgcccattcatctgagcgccggacctcatctatcaaatcaaaactagtggctttcaaccttgtagccaacgccccagacagtttcgatgaccttttcgccaccggtagcggcttcgatcttatcgcgcaggtggctgacgtgaaccatgaccgtcttggccgaaaccacagactcctgctgccaaacccgttcaaaaatatcatccgcactgaaaacgcggttgggatgactggccagcaggtacaaaatcccaaattccagtgccgtcagctgaatcgtatcgcccttgagcgtcttgacctcgtgcgaatctttgttgatcaccagggggccaacgttcaagacatctggctcatcattggtcagatcgcctttactccgccgcagcagggacttgacccgggccatgacctccagcggattgaacggcttggtgacataatcgtcagcccccgtgatcaagccttgaatcttgtccatgtccgttgtcttggccgaaaccaccaaaattggaatggatgaatccttgcgcacctgcttgataacttccatcccgtccatttctggcatcatgatgtctaggattaccaggctaatatcagggttggtgtttaatttggtcagggcttctttgccgttgtaggccgtgattggctcatagccttcattgcggacatagatttctaataattgaacgatgtctttatcgtcatcaacaatcaaaattttcataagccgtactcctcattttttcgtaatttaacttctttcattataacgagcctaaaagaaaaaagctcgcatcaggcgcgggctttagaaatgtttaaattacagttgttccagcgcgtggtacttcaaaatatcatcatcgctcaacaaggtgttttgcccttttgcatgcgcgatgctccaaggggttcccggccgatacgtcagattatccgtctcatggttccaggcatcgtgctgctgatagtattgaccgtatttttgcgccgtttcgttaatgacgtcaataatgtgccgggcatcatcaagcgcgacgacctttggcatgaagtcatagttatctgccagcttatcggtatatttgttgtcgcggtataccgatcgctcaactggacctctgtcgtaggcctcaaattcggctttgaagattgggcggccatattcagtcagcagctcggcatagacaaagtacagcgttttttgcagaacgaatgatggaaaggcataccgtcgctgcaggtagctggcaacgtcaatggcatcaaattcgatatcgccctgcagctcttttaagaaatcatgatagtccatgacttgtctgacatcgcggaaataaggatccattttttgaatatctttgaatgttttagtcttgccgttgaaaaaatgggttgagaagtatgaaaataactcagatgggatttcttctgccattctttgactaaaatcaatatattcttggcgattttcagttgaaaaacagtaggcgtactgcttggatgaaattttcgccagcatcactaattgatacatctaactattctccatcagttttcttattgacataataagcggcgatttcttccattacggcccgcggaatctcaacttggtcatcgtctttttctgaaacgactgcaacgcgaaacgggatggctttttccttggcgacccgcttaacgaagatattcagcagtgccgatgaagacagtcccaattcctgagcaacttcatcaaactgctttttgctttcggcgtcggttttaaaattcatagatacggttgccatcattaagacctctttttaacatttttgttatactgatattatatattattaaccaacattaatccaaaatatttcgcttagtgattgccatttgcagccaagtttaaaagagtttaaaataagatcagaagtttaaaagagtttaaaagagaggggcaattatgaatccatttaaccctacttttggtgatgttcctaaaatcttaattgacaacgatcctaaaacaactgacatctataaattagttcaacaaagtccgttcgcccgttcattttttatcaccggggttcgcggctcgggaaaaacggttctgctttctcatctaaccaaaatgtttcagcaggatgctgcctgttactgcatcgatctgctaaataatgacgagattctgaccagcttggcccagcagctttatgatcaaactcattctcccgctgccaaattttttgacgagttgggcagcatctcaattggcggcttcagcgttgagcgccatttcaacaaatcaagcctggccctgacaatcgataaaatgatggctgagattcaagccaagcaccactatgtcgtaattacaattgacgaagtatccaacagcgagtcgattcgtgactttgctcagctgttcagcgcactcaagcgtaaacaatatccaatttatgttattatgaccggcctgccagaacttgtcttagatattcaaaatgacgacaaactgacatttttgctgcactccgataaaatcgtcatgacgccgctccaaaaagctgaaatgatcagtacctatgcccaagtgttcaattgctcaacccagctcgccagcaaactagcccaggccactgctggctactcatatgccttccaattgctcggatatctgctgtttgagcattgccagggtaaaacacctactatccatgactatcaagccgtctttccccaatatcagctgtatcttttcgacaatgcctaccaaaaaatctttgccagtctttctgaaatggatcgacgctatctgatcgccattcaaggcaaccaaaagctgcagacggtctgcgagataatggaaaaagataagatctatgtttctcaataccggcggcgagctattgaacgcggcttagttctgccaagcggtcgtgggttcgtcaaatacacgctaccctgctttgatcagtacgtcagtgaggtgcagaatcctgactcagcctattatctgggatattgatcgatttttccaactgaccatcgcccaaaataaaaaccggatcgcagtccagaccgcgatccggtttttagtctgctatttatttttcggtgcaatttgagctgattttgcaccgaaaacagaatcaatgcaccgctgaattttgattgtccttggttttacagatgacgcttgcttagccttgcgctaaaatcaagacatatcgttggcagtctttgccacattcgtattaatttctacaatatatttattaaggagttttccatgaaccaaaaatggcgttcctacttcaacgcgaccattctaaagcgtggccgtgattacgttgctaatgactgtgtcaaatcatttcatatttcaaaaaacgataacaacgtgctgctcatcaatgcgaaagtaatcggcagcaaggcttaccgtgtttcaattacccacgatctcgccagcgggcaatggaacatggaatgcagctgtccttttgctaaaaaaggcaattactgcaagcatgaagccgcggtcctgtatgaatacgaaaatcaggctaatcggcccaagtcccatcagtcggctgatcgaattctatggcaggagtatctggataaagtctacaatgctcgctgtgctaacggccaattctattttgacattcgcgccatcctcggtgatttggaaatgccaatggccaagtggctgagcacgcctgatctgccatatgatgatatctttgactactctgatctgcagccaatgtacagcttttctactgccgaccgcgaaccagaagcggcttttaaacgatcctttcatttctcattcaaacctggcaaaaaagcaatcggctcgctcacatgtaccaaaaacaagctgcttaccctgcagtgtaccaatccagctcaccgcgatcgaatctgctctcataagatcacgctgattgatgccttcattgaattcgtcaccatcattaacatcaacgacgcaaccagtgtctcggccgaaaactttattcaattcgttgatcagcatctgcttagcaatcggccgcttgaagaaaatcaggcatcacgccagctgcagattatcccgaatatcgttatccaagactactgggacagttgcgagctgcgggtgggactgcccgatggctttaagtataagatcacttcatttccacgcttcttagcggcctggaatcacaaggaaagcttaaagctcggggctaaactgacgatcaattttgccgcggatcaatttgatgctccatcactcaaactattggatgagttttataccgcttttggctatgaagcactgttgaattctgacacgggttatggcgttgaaaccaaagacattccaattaatggccgcattgccgacgtgctgtatcattacgcacaggaaaacaatggtatcccggcaactatcaatggtgataagacgattctgcaggcgaccgttgaaccgctgagtaagcctaacctgatcattaagacatcctttgacaagcagcagctggaaggcatcaacatcacccatccaaagactgatgatttccgaaccgtaccgcatgcacatggttttgaagctgaatatgagatcgcggacgatgaattcattaaacttaccccgaccagcagcatcaccaatgaactggtcaatgaactcgacaagccaggcgagccatttacgattggccgtgtccgcgtgccagtcttcatgaacgacaccttaccggatcttaagcaaaacgccaacgtggacttccaagacgaagaactggtgcgcagcaagatcttgccgcggcctgaatttatttttcgctttaatgccaccagccatgaactgcttttaaaggcgtttgtaaaatatggcaagttcacgctgcctttaagaggacgatttgaaggggaaatgatgaatcgcggcttatttcaagacgtccccgctgaaacacgcatccttgaacagcttagcgaacttggtctgggaactccgctggataatgaacattatgaaaatacctatgtcctagagcgcacccctgtcaacacctatcatctgcttcaagaagtcatccccgccctcaagcgacttggccacgttgaaggatcggctgccttccgccggctcaaggtcatgccagtacctaatttcagtattgaggccgcttttgaaaacgatctgctgaacctggaatttgttggcgagggattgaatgccaaacaagccgtgaaaatcttgcaaagctatcatgaaaaccagtcatatgctgagcttgacgatggcacgattcttgatctgacgaaaaaagcgcagcagctggctcagattgaaaaattagttgctgggctggagctgacgccaacccagctggctaaaggaaaaattcagctgcccggctaccgtgccgtctacctggataccatgctgcaaaagcaacacgaacttgactaccgccgcaatggccgtttgagcgagctgatcgaaaactttgatcatgatgaccagcagccgtttgatctgcctgacgacctggcttcaacgctgcgcgactaccagaaaaaagggacggcttggctgataaagctggctcattatcagtttggcgggattctggccgatgagatgggactggggaaaaccctgcagatcattgccatgctaagatccatgccaaccaagcagccagccttgatcgtcgcgccggcttcattggtactgaactgggaagccgagtttaagaaattcgcaccgcagaccaagctcacgacgatcatcggcaccaaggctcagcgacgcaagctcattgcccaggctgatgatcatgaagtcgtgctgacctcctatgatctgctcaagcgcgacattgagctttacgctgatcaggccttctcatttgaaatcattgatgaggcccaggcgatcaagaatcattccacggccgtcgccaaagccgttaaagcagtcacggctcagcatcggttcgctttgactggaacgccgatcgaaaaccgtttggacgaattatggagcatctttgactttatcatgccgggatacctgttcaatcaccgccagttcggcaagcgctttgtcaatccaatccaggcgggtgatcaagcggcccttacgcagctgcaggaaatgaccgcgccatttattctgcggcgaaccaaaaagcaggtgctcaaagaaatccccgataaaatggaagaaacctattttgtggggatgagtaaggctcagcaagatctatacaacgcgcatgtggctcgcctaaaggatcggctgaataatactgacgaagccgaattcaaaaacaccaagctggagattttggctgagttcacccgcatccgccagatctgctgcgcgccacagacagcctacgaagacttcaaggggtccgcggctaagctggatacctgcgtggagtttgtcgaaaacgccttagaagaagatcacaagctgctgatcttttctcagttcacctccatgctggccctgattaaagaacggctgcagaaaaaaggcatcccgacctatgaaatcattggccagacgccaaaagccgagcgcttaaaacgggtcaacgactttaatgcaaacgatgacgtcaaagtctttttgatctcgctgaaagctggagggaccggcttgaacctgaccagtgccgataccgtactgttctttgatccttggtggaatgccgcggctgaagaacaggcaatcggccgtgctcatcgaatgggacaaaagcacgtggtttcggtctaccgtctgattgccaagggaacgattgaagaaaagattctggccatgcaggaacagaaacggcaattggctcaagatctgctatcgggatcccaagttgccaactcaaaacttactaaacaagacctggtcaaaatcttggcctaaataaaaccggatcgctgttcaggctgcgatccggttttttagtctataatttatttttcggtgcaatttgagctgattttgcaccgaaaacagaatcgatgcaccgctgaatctaatcatgatatcattggcggtctcaaaatgctcaaaaatggcaatctcaaattgaacaacaatgattgccaaatgtctttaatttgatcatgatttgaaaaacatcccctttgttatgaagaatcattgatatacccaagtgttacctttaaggagattgtagttgaaaatcgcttcagctaaattgttccttattttagcaggtcatagattgcatgctccgatctattcttctgctttcgatactgctctaaaacatcgataagtctgtcaaaatgtagattccaaaagtcatagttttcatcatatgcttttagattttggacatcatgatagttcttcttggcaaaagtactgggcttatctgtctgattagcaaattttgaatagtcattatggtaaagaatatacagaatttctatctctggccgcgtatatatattagtaatagatgacactttcttctcataagctttcggaagtttaaagttttcagcacgtgaatccaaaactcggtatatatcaatcttagactgtaatcccttattaagatatcttttagcaaataaccttcctgcacgaactctcaacacttcttcttgtaataagtcagtacggtgtcaatggcagtcttaaaatgtatgaaaatggcaatctcaaattgtacattttcgtacatttttttgtatactcacttaaaaaattagaggtgacgtatacatgagaaaagatatttttgaaaggatgcgattcttcgtgaaggaggacatcaaaccaaactttagtcagattgccagacagtatggcgttgatcgaagaacggctaaaactttatatgataaagcaggccaagttaaggaggttgtaagaaagaaaagaaacattcatggaaagctcgacgactttaaagagatcgtcaagctcaaatacgaagctggctgcacggccatggcaatctaccggttcattcaaaagaaaggatatacaggcggctatacgttagtaaaaacgttctgccgaaactataaacaggaggagataaagaaagcgacgattagagttactcatacgattggccttagcgctcaagtagactggaaggaggaagtcaaactacgcgataagtatggaagggtacatacattcaatatttttctatacgtactgccttactcaaagttaaagtttattagtttaacaatggacaaaagccaagatacgctgtttgagatgctttacaaggcatttcaatacactaatggcgttccaaaagaaatttggtttgataatatggcaacggttgtagaccatcattccagttatcctggacatgttaaattcaatgaaaaatttctttcatttagcaaagatgctggatttaaggcgattgcctgtcagccgtacagaccacaaacaaagggagttatggaatctctagcgagaacaactagccgactagctccttacgatggtgaatttaaaaccttaaaggaacttgagggcatagttgatgagatttgtcgagatttgaatttagaggaatctcagagcacgcataaaattccaaaggaattatggcaaaaagaaaaggagtgcctcaatcccctaaacgatgacatcgatagatactttaacagcgtgcagactcgaaaagtatcgaaagattcaatgattatgttcaggaagaatcagtactccgttgatcctaagtatataggaaaaacagttgaaattaaactaagtcccaccaataaaagtatcaaaatttattatatgggagtggaaattagatctcataacctaaccgataagcaattcaactataacgaggatgattacaaagcaattttaaagacggatctttttaaggaccgctcagaagacgagctcaataagtatatgagcgagaatcttaaagcgtacgattgtctgtaaggagttgaatttatgacggactatgaacagcttatctcaaatttagcacaattaaaattaaacaatttcagtgaaaattatcaaaattatagtatggaggtcgatcaacagcgaatcagtttcggtgaagcattattaaaattaaccgaaagtgagctgcaataccgacgtgatcaagaaatcaaaaagcgaatccagcaagccaagtttccgatcgtcaaaagaattgatgagttcgactttaacttccagccttcaatcaataagcaggagattctggagcttaaatcgttaggcttcttaaacaatcaccaaaatattttactggttggcagtccaggagtcggcaaaacgcacctagcgattggcttagggctgatagcgtgtgaacatggctttaagaccttgtttatcaattgccatgaccttctactggctttaagaacggccgacagtaaaggaactctggaaaggcagatgaagagatactcaaattacgagctgttaatcatcgatgagattggctatttaccaatgaagccagatgatgcgaacttattgtttcaactcgttaacaatcggtatgagcagcattcaacaatcatcacaactaacgtaccactatctggatggggagaaattctacataatccggctgcggcagaaaccattttggatcgcctggtctataagtcgcatatcattaaaattgcaggcaagtcatatagattgaaatcggcgactaaccataaatcgccatcttaaactgccataattgtacattttcaaattgccatttctgtacaatttttaattgcccttgacatacggttgaatttcaatacatcatgatcaagcaacacattcaaaatcgcttgttctgtacttccttcagcgagtaaagcaatcacttacttcaccgccttttctgtagccttgagcagtttcagataggactcgtattctggtgcggtgccacctaaataatccgaatcaaagacatcggttttattcagatccttccttacatccgcatctgagtaccttagtagtgaaatcttaggatcacggcgcgtaatatagatttcatcgcttcggtcaatatcactcagtagctctgaatagtgagtactgtatattaatgtagcccgctttttattaattcttggattcgtaaaatactcaataaagctctgcacaatggcatgattaaaatgattttccaattcatcaataaaaataatgccaccagtttttaaagcaaataaaacattgccatacaaggtaactcccttagcagtacctgatgaaaggtagtgttcaatattcgtaaagttcgtctcaacgaattcttccggctgatttttaaactttaatcggtagacaagccgattttggtcatttatcgatttagtttcaacctttaaatattcaatagtcggatccaaaaacttcaggatttcttcaggtacgttttctttggcataaatcaaggcattaaaattggtaaagatcaacgtatcaacaatcaactgaaccgtgtatttttcagtagcaatcaccatccgaaaaatcgaatcatcatttgccagcacagatgccgttattggatcaagtgcattccgatcgtattctggcttaagagtttcgggaaaatcaaatagtttctttttggaagtcttgctatcaatcttttttacatagattttttctgaatcaacatgccaccgctgaccatcatcagtagacttaaaaaccgtgacgtctttatagattttacgatcttcaccatagaaaaaggtagtaatggttattggctgcgtaccaagcaaaacatcagccaactgggtctgttcaattgatttatcattgagcagaaaagtcagcattccaataatagttttcataatagtggtcttaccggtagcgttttttccaacaatcgttattacgttgtcggtccaaaggcgctggtagagatgggttaagtcattgttctgatcagttatcgcgactctagtatcatttaaaaccgaaaattcaatctgcttgctaaataatggatgattctcaattattatctttaaaaaggttaacttttttggcattttattccctccgtcattataattttaatccgctctccttggtatttcaaacatataatccgtttgaagcattccaaaaagagtaaaataaaaaatatcatctaactacaaacgccaatcacgttcataatcggatgatagcgatctaaaatctaagagatcctaattcaatttaaattccgggtagtagcgctcaatcaggtcaatggcatggttggagatttcgatgccatcataggcctggcgatagtaacgaatcagccgtttgagccgccagttgagttcatcttggttgtagtagttcaaggtgaagacatccgctacatcaaataacggctctggcagcattgttccaaaatcatttaactgatcgtctgagcgtttcagatcgtggccaaattcctttaatgcatcaacgccaccaacgttttcaacaattccaaaccctttaccggcaataattcgtggtagattcttggcactcagctcattttgatcgtccagctgctcaattttcagcttaatttcccagccatcgccaaagtcatagcggaataagaattcatccccgacattaaaatagttgagccgaaaatcatttaagccaacgtacttgatcttgggtccgcctggaaaacttggtaccatgctgtattcttcaggattgttcaccatcaccacgagaccgtcatcagattggtaagtgaagtcatactgatgctccgcgtacatttcaaacatgatctccagatagtatgccagctcagtaattggcaggttctttttgattttgaatcgccgccaggttgccggtgatcgaaagtctttcagtgtagccttaattatataggttggaattggctttgccatatcagtttcctccaaatatttgcctttgcagccattgcaacgtttaaagcttttggactgagtataccatagggcacctgcctgctgaaatcatcatctgcagcaatgaaagtacttcgtgcagttgccgatgataactcagcgcgctaaaattaatatataaatacatatctttctagcagattttacacactaaagggctaggtgcttggctgcgcctaaccctttcctctttcatacagcagggaattgtaaaggcaactgctttagtcttaattaagaaagatagtataaactaacagatcatcaccgtgcagatatatcatgtttaacaaaagtactttatgttaataacacgtacatcaagttagctgcttttcgctatataatcatgaatatagtttcatattattttaggagtagttagcgatggaaaacattatttcttttcggtctcaaaactttgcaaataatctagccgcactgatggataagaacaacgaaacgccattggagctttccgaacgcattcatgaagcatacccaacaatcatggcatggctaaacggagatgttccaactaaagaaaagctctataaactaaaaagtcattatcatgtcagtgtgtcatatttaaccgatgagcatcatacatttgatgtaactagagaaatcgctgctcacattgatgacaatacatccgaatcagaaaaaattatgattattgactttatcgagaggttaaaagaatctcgtcaaaacaataatacagaccatcaagaatgattaccaaaatatactgtgcaatctaaacagtaactagtattggcgctgtgggttcgtcatcacagcggttagtgatttataggattacataaaagaatcagtcaagaaatatgtcacttggccaagttgcaagaaactttatctctgtatacatatatatcgtaaaccaccataacttatattttcaaattactatcgacagctaaacgataaataatagcgttttttcattaaacttacatcacagactaaattttcactggaataactttaaattatcgatttattctttttctaaaaatttatcatatcgaaaatctagatattcaaaaaactctacagtatttctagcatcattaattacaccagataagttgtattctttgttaattttataactaaggctcttatctactggatacctaaatctttctccattattgtctaattcattaaatctcttaacgaactttgtcacatcgtcaatactacttcttaaatcactaaatttttcaatagtttcatcttttattaataaccacaatttttctaaattatgtgtatgagattctcgattattcgtactatcttgaccacagaatctatatataaagtattttaattgtagttcaagcgtattccttaatagaaacatcaatggatactcttttttatcaaagttattacacttataaataaagtcagaaacttcttgatatcctgttatacttttttcatattcaccttcaattaagaacttactagtcttagttggatatgacaggtagcatagagcctcttgccaatcccctttcataaaaaagctatctgaaattgcaggtttctcttctaaagcaactccagattttaaaatttcatataccttaatcattccttctgcaaaatggaaattatctaaatatagagtattctctttcctatttttccataattctccttcatataagtatctaaaaattgttgaattagcatcaactgaatttatcgattttaaataattaaacagccaggtggatttttcctcaatgcctacttgagctagataatatttccataatgtaactaaatcatgcttattcaacttctgcgacagtttctttttacttcctcctttttcttctctttttttacaaattttcgctttcaattctaattcaattgcttgtctcattaaaaatattgtaggtataggccataggtcacttattcgtggatcaccgttttggtctattatgtattgccataatatatatccacacttaaaataacaatcggccaaatcttcaaaaagtaaatataatttatcatctttagtaaggcttactaaaattccagaattttgttccatattttccctataaattaatccttttatcattatatatttcttcttgcggcatcttataatatcgccgtcctaaaatgtatgcgctttctttagtgactaataagcacccttctatacgcgagtcatctcatgtatagaagggtattttcatttattaatgattatcttgaatctggttcatgaattcctgtaaagcagtctgccacgttgggatgataaatccagtggcttccgcttttttcaagctcataatggaatgacgtggtcgatatgccttttgtggatattcttcagaggtaactggagcaacctctacgtccttatctttcaaaatttcacaggcaaattcataccaagagcagctgtcttcattcgacaattgataaacgccatattcacaatgatgatcaaccagatacgtcataaattctgccaacgtccgagtccatgtcgggcggccaacttgatcatcaaccactgtcaagcgatcatgatccttagccaggcgcagcatcgtgtagacaaagttcttgccatattcgccaaagacccatgaagtccgaatgatgtaataatcagtcatggcagcttgaatagccttttctccagccagcttggctttgccgtactcatttttaggattggtaggatcgtcaactttatactcgcccgtcttagtaccatcaaatacataatccgtgctaaggtaaaccagcttggcaccaactttggctgctacttcagccaggttgcgagtgccatcttcatttacccgccagttgatttctttaccttcgtcttcagccttgtcgactgccgtataggccgcacaatgatagattactgcaggcttaagggccactacctgctcttcaactgtttgacggtccgtaatgtccatatccttggcatcacgtgcatcataagcaattccgcgttcatccagtaaatggcgtaattcagtccctagttgaccattcgcgccagtaattaagatttttgacattagtatttcctcacaagtctttcttaatcttaaaaaatcgccgaatcgcttgcaattcgacgattttagctatttattgaccattcttagcgtacttggcttccacagcggctttttccgcttcccaccaatcacggtgttcggtataccacttgatcgtgtcctttaaaccttcacgaaagtccgtgtacttaggctcccaccccagctcggtccgcagcttagtagcgtcaatcgcatagcgcaggtcatggccaggacggtctttaacgtgatcataggcgtctttaggctgacccatcagttccagaatcaattccagaacctctttattgtttttttcgccattagcaccaatcaagtaagtctcgccaatcttgcccttggtcaaaatcgtccaaaccgctcgtgaatgatcattggtatgaatccagtcacgcacgttcttacctgagccataaagctttggccgaatgccactcaaaatattggtaatctgacgtgggataaacttctcaatgtgttggtaaggaccgtaattattagagcagtttgagatcgttgccttcaagccgaatgaacgaacccatgcccgcactaacagatcggaactggcttttgatgatgagtaaggactagatggtcggtatggagaatccggtgtaaacttttcaccaggaccctcaccatggccaggcaagtcttcgcgcagtggtaaatcaccataaacctcatccgtagaaatatggtggaaccgcacgtcatacttgtggcaagcttgaatcagcgtgtaagtcccaacgatattggtttgaataaagggatcggggttctgcaatgagttgtcattgtggctttctgccgcgtagtgaaccaccgcatcggctttagaaaccagttggtcaaccaattccttatcacagatgtcgccaacgaccagctcaacacgatctgcaggtaaacctgccaaattggctttattaccggcataggtcagcttatccaaaaccgtaatatgttcgacttcaggatgattgttaactacataatgtacgaagttggagccaatgaagccgcaaccacccgttacgataatgtttttgtattccgtcatgattttgtctcctagatctcaccatagacaaatgggttgtctttttcaaattccgtcaacgttggctgtttagcgtccttttcagaggtaattgccttgtcaaattcgattggccagtcaatgttgagctctggcgtcttaaatgagatgccgccatcagcttcggcattgtagtagttgtcgcatttatagacaaagttgacgttgtcagtcagcgtcagaaagccatgggcaaaaccacgtggtaccaacaattgacgatggttgctagcagaaagaatgtagccttcccactgcttgtacgtcggtgaacccttccgcaagtcaacaatgacatccaagacagccccagtaactacacgaatcagcttagtttgcgcagcttgaccacgttggaaatgcaagccacgcaaaacgccagcctgcgtagacagtgattgattatcctgaacgaagtcaaagtcgatcccggcttctttaaagtcacgatcagagtaggtttcctcaaagaagccacggtgatcaccaaaaacagctggcgtaatgatcttaacgtcttgcagcttagtcgtttgaacgtttaatttacccatagtctatttctcctctgccaagcgtaataagtattgaccataatcattcttctttaatggttgggccagtttgatcaattgttctttgtttatgtatcccatccggtaggcaatttcttcaattgccgccactttcaggttctgccgcttttcaatcgtggcaataaaattcgaagcctcaagcatggagtcgtgcgtaccagtatccaaccaggcatagccacgacccattaattgaacgtctaactggccacgtctcaagtattccttgttaacgtcagtaatttccaattcgccacgtgcggaaggcttgatgtttttggcaattccaacgacgtcattgtcatagaagtagaggcctgtaactgcatagttactctttggctgcttaggtttttcttccagtgaaagagcgtgcatgttttcatcaaactcaacaacgccaaatcgttctgggtcattgacatggtagccaaatacggttgcgcctttttctttttgggctgcgtcttgaaccagcttggaaagtccagagccatagtagatattgtccccaagtactaaagctactgaatcatcaccaataaagtcctcacctaaaataaatgcttcggccagtccgtttggtttttcttgtaccttataagaaaagctcatgccgatctcagagccgtcccccaatagttctttaaatagtggcagatattctggtgttgagattaccaagatttcacgaattcctgccaacattaaagtcgacagtggatagtaaatcattggcttatcataaaccggaatcaattgctttgaaattcctcgtgtaattgggtacagtcgcgtaccactacccccagccaggataatacctttcatcaataatcacctctcaaaaaaatttttaaatatcctcataatattttttaactcggcattattcttaaaaacaataaaaataacaattaattgtaaaatttccacaataatgacgaaaagaatatttttaattatagaattccctaataggtttttctgtaatataaaatatgaaaaaaatacaattaaaattataaaaattgcaaaaggtatgatctgatatatgtattttttatattccttatcacatacttttttcaacaccaagtatggttcataccaattaacaacaaagatatttgaacaaagcgtccccaataaaacaccggttaatcctagtctaaagaaatacaataatattagtgaaatcattatgttcaccgttgcttcaactatggatttccatttctgaatccactgtaatccaaatgcatctatatatgttaatgctggataccttactaactgtaaagcacagtttatagaaataagttcaactacaggaatcggcaatacactctccttgccaacccataatttaataaaaagggaaaacaggaataacaaagggataaaggctaataccgttaaggtattcattataaatgacatgttaagaaataattctaaattctttttcttattattctctgctcccaaattacctatacttgcagtaacagaagaaatgaccttagataataaagcggtaattccctgagtgatcattaaatagtttgaatacatcccgactattcttaacgtttcgaaattagccaatagaatattatcactgccatacacaactattccgcctaatttgtttgaaatacctccgatagtatttttaataagaacattaacagtatttgatctcttaaattttagttttcctttttttcttatatttcccaatgggtacatatgtttagctactcgactaataattaagtttatcaatactgtacctactaataggaggattgagtaaaatagaaaattatcaaagaaaactagaaaacaaatctgtaaaaaatctatcacaattgtaataacaaatgttactttagcgataacataatacttttgatctgcatttaaaattactctatacgatgcaaaaaagtagcttaagccggtatttaataaaaacacaagataaatagcaataacattagggattttcatggattgctttccaattaaattgcctaaaaatggtactgctactaatccaatagataaaaaaactattcctatccaagaatagatcctcttgaataagaccattaaattatctatttcattaaaatcacgatttgctaagggttggtacaacagaaaaacaaatactgagtctacacctaaatcggcaatagaaaaagaggttattacacttgttaagactccgttaagcccaacatactcttgacctaacgtcctactcaaaaatgaccgtactagcattgccattagcattgtaaagatatatacaaaaccagttgttgtcatattggtaatggaattacgtaaccgactattttttttatccatttgaacctctattactcagattttcttttatcttttttacatactttttcattgttaaatctaatatattatttttgtcatgctttttaaaatcttccaaatttcttggctttctatcagggacacttgcatcaccacgatttgatttttcaaaaaattcagataatgatttagaataataatgatttattctaaaaagattacgtggtgcaggacgagctcccttcatatctgcacgccgatacgaccatattcttttcttctgttcatcaatagtttttccagcgactttgtattgatgaggaaatgtcatacctattacacgttctggcctaactattggtttatattctgtaataaagtcatctttagcgtgcttaatataattttctatcaccaaccctcgaggcttatcaatatgtccgccggatccataaaccatccaaccaagttcaacctgagaaatatctgggcttaacgaactcaaccattcttttaaagaaatattcgttaatggttcaagaaattcatcaatatctagtgttactaaccaagaaacttctttctttgctatttttacacaatccaaatatgctttctcttgcattcccttacccggaaaatatttatatgtaacctctcctgattttatataacttgatagtgtatgttttaagtcgtccgaagattcattatcgtatatataaaaatgactaattcctataagtttatgatactctatccattctcttatataggcttcttcatttttcacgatagcaacaagtcctatcttattcgaatcacttcctttgctgaagcgtattgagcaatatttccttagccctattgaaaaaattaatttaattttactaagtatcccaataaacatcagatacatttcataattaactctattaataaatacatctatttgcgatttgtttctaagcatttgtaatccttaaattctaacaaaatgcaacatatatttaacataatatcccatgtaaagtggatcattcatattaaacaatcctgctccatacatacagagcaagcacacagtactataccccaaaaagtaaatatatctatcggtaacttttatatccttaacgtgaatactattcatcaataatataaaagcaataagtgaattacgtaagattctttcaaatccactagacatcaatgtaaacggcatcccgatcaaaccaatcagcataacaacataaaataatccttggtatttttcattttctagctgttttccgtacatatttctaagccattgtatcaaaagaaaagcgatgaggtatgacaacacataagccaatgtatatctggagaaactaccattagaatagacgctggttgcttgatctatatttgctctatttgatatactacttatttttattaaaattgtagataagacactgaatttactagaagctacaacaattagagtgcctataaaaatactagtaaaatatatattattaagccgttttttagttttcatactgtctttaagaataaagaatagtattccaaatatatatagaatacctgttgtttgaaaactagttgcaattaacagcaagcttattccaattacaaatcttgttatggtcattgtattcataatcgcataggctaacaataccattacaagcattaaaaaatttctaacctgagtagcatcatttagaaagattactattccatatagtaaaaaaaatgctgaaggtttgcctgtaactcttaatatgactagataaaaaatcaaataggcaataaaaaaaacaattagcctaaaccctaaataatccattccatgggtataaaagaaataagataaatgcatatacccttgttcaaatatatgagtatcaggtggaaatggataatacatttgatacgttgctgtatcgaatgaatagttagtaggtagtgttcctgcaatccaagccatatagcatgctgccaaaagcgatgatattctttgcattcttccgctaagtgcagaaaacacaagaatcaccattaatataataattaaaacatatcccattccatctgttcctttgatttaaaattaagtaaatttagcattaatatcgcaaaaatatagtgtttcttccaaatatatggttttattttactaataatttcacttttcttagaatgtttttctctagccaagattacatattgtttaaaaaaggatacacgttctatatattcattctgacttaacagctgcggaccatgaatatttaaaaacttatagatcattaaatcatcatgaatcaactgatatatcgtatcaacagcttgcgttattttcttatttatactcttccgttttccacctgccccgactaaattatttccatgttgtctatagaggactaatggttcatctatcagatagtttctcccataaaccgcattgattagacctataaaagagtcatgcatattcagagaatcaatccaagaattaggtaccacatttgctaaaagaactgatgctttattaatagcataagtagcccctactatttgatagttaaacgaaaggaatttataatctgctttctcttcattccaatcatacctagaagacattttttccccaatcgaatgtgctttttcatcagcaatccatgcatccgaatatattccaataggtaactcagaatctataacatttttctttatggcttcattcagaaaggtattaattttatctttctcccatacatcatcttgatcagaaaagaaaactaaatcatagtttacagcatgctttaataattcaaaaaacgatgccttaacacctaaattaaccgaggaattgccaataatctccacacgagaatccttctctaaatattttgagataatctctaaagtcctatctgttgagcaatcatcacgcactaaaatttttaacgaaatattatatgacacattttggttaagaatactatcaagctgttctgctataaatttttcaccattatatgtagacataactacagcaattttatatatcctgttattgtccattctcaaatattcctccaattagtcccttaagaaatgccttattcttactaaaagcatccgtttcaaattgaatatacacaatagtggagataatagttcggaatgtttctttattcattccctttatattcttacgatactttttccatagccatatggtatttctagctattgtatatcttctcataggtgaatggttggttggccaaatagaaaacttaccgaactttacttcttttctatttccgatcttatgtcttaatataattgagtttgcctggacaatattcattccatttaacaaaatccttaaatcataatcagtatcaactaaatcaataaatagcctttcatccataaatccaacttttttaaaggttttttgagagattagagcacctgaagcaattggctttgctgctaaacgaattaatttattattaaggactttcttctctttttcatttggaatgttaatagataatctatttttattgaaattgtaaattcttggctctaaaaatccatccatattgatgtcatatattctaggtgccactaagccaatatttcctatctcttcttgagccacatagaaagcatctttcatttttgaaagataatctttaggtacttttgaatcttgatcaaaaattgctacaaactcagctccttggcataatgaatatttaatacctatattctgtgcttcagctattccaaggtttttcttgttataaattactttatcagcatttattgaattatatttgttattatcattaacgactaaaactacatttgagtcttgtgcttttagggaattagtcaatgtagttaatgcactaatatcagcgttataaattataataactgaataaattttatctacatccatttccaaccccacttatgaaagtattgccccatgcttttaatcgtatataacatatatcgaatttttttatggctatctctttgccattcatgtattacgctaacttttggataaaaaactgctttacttattcgattaacttctcttgtgatatcggcatcttccatatacataaagtatctttcgtcaaagcctccaatctctttaaacacttttgttctaaagaacataaatgccccgcttgcatgctcaatttgcccaatttctgaatagttactttcatcatgaacaaaccaagcctgtcttttttttaaaagatttggagaaataaaacgtatagccatatccaaaacacttggattatgcttataaagtttttgaatggtgccatctacatttaagattttaggcgatagtaaccctatttcagggtgtctgtccatatacaatatcatttcattaataacttcagcattagggataatgacatcagtgttaattactacatgaaaatctgattttaaataaggtaaaacatagttgtttccagtaccgaatcccttattaacgttagggactatcaggtggatattattaaaccttttactgcattcatttactaaatttactgtttgatcggtggatgaattatcaacaacataaagggtagtttcaaataattctgattttaatgattcaatattttctataaatttcgttatcttgccttcattattaaaggtaacagtacaaaagcttatttgtttttttgacaaagttttcaatcctcttataaacgcctagctcacttctttttcccctcatgaattcctcgatgtcctaatacatcgaaaaacgtcttaaaacaaatcttcaaatcctcaactattgtaaggttcgccgcatactccccatcataggcggctttctgttcatcggtgaccaagtctctccctcgtacttgagctaggcctgtgatacccggtaaaatcgtttctgcaccattttcatgtcgcagcgataatacctttttctctttaagaattaatggccgtggaccaataatactcatttcacctttgaaaacattgattaattgtggtaattcgtcaagactggattttcgtaataatttaccagcctttgttatgtatttttcgggattttcaaagctcgccgtcgccaattgtggtgcatttatgtacatagtccgaaatttataaattttgaacggttgaccatttttccccattcgttcctgtctgaaaaagattggaccacttgaatccgccttgatccaaattgctaatattaagaacaacggccacaaaaccaacaataaaaataagctgataatgaagtcgatactccttttaatatataacgcatagaaattgggctttttctttctaatggtgtcgttattagcaactttcatcattcagcattcctcctccctaattctgattctaaaagaggggcgaggtcacccccccccgcctaattttcttaactaaaagaaccaaaaatgtttctttttaggcagtggctgccaatctaaattaacttgatccccattgataatatcgcgcgcgttttgttcatatgtatcagccagctcagcgccaaattcactgcgcagtttctgcagcgcctcgctgagctcgtattcgcgatgactcaaggcatgcgcgtcagaggcaaagattgctccctgcccggccttgatcatgctggtcgtaaccttttcaatctttttgccgaaccggcccagatagctgttggacgtcaattgggtcaagcatccctgctccaagaacggctgcagtctttctggatgttccagcagctcggcatttcgttcgggatggacgataatcggcacgattccttgctgtcgcagcttaaagaccatttccttagcgtactgtggcacttcctggctgggaaactccagcagcatgtagcggccgccctcatccgcgaacaaaatatcatctctttgcaaggcttccagcagctcgccattaattcgaacttcctgacctggaaaaaccgttaatggaatctcgttttcattcagagcttgttgaaagtccgccgtcagctgcaatacgtcggctttatgattgatatagtgtccattcatatgatgcggcgtcaataaagcgtgcgttacgccatcattaaccgcatcctgggccagttttaaagaagtcgcgaggtcaggtgaaccatcatccacgcctggcaacaagtgacaatgcagatcgattaaaaccatcttgattcacccttcctgctgtatgcgacaagcctagttttccgattctttttcgtagccgtagccataaccgtagccgtagccataaccgtagcccgcgtcgtcttctggtacaacgtcattcatgacatagcctagcagatgcgcgtgactcatcttcaacagttcaatggcccgccgtacgcctgctttttgcgtcacgccttgccggacgaccagcactacgccatccacgctgcccgcaatcgtttgcgtatcagtaacttccagcattggcggaacgtctagtacgaccagatcatattgggcctgcacggcttccaaaaggaccttcatgcgctgtgagctcagcagctcggctgggttaggcggtaccgccccgcttggcagcaggtctaatccttcaatgccgctttcctggatcacatcgtttaggttgacttctgattgattactgctcaaaaccgttgaaattccttcttgaccagccagatcaaaagtcgagtacagcgttgggcggcgcatgtcggcgtcaatcagcagcacgctcttgccttcttgcgcccagacgatggctaagttagccgcgacggtacttttcccttcactgatgttggcagaggtaaaagcaatcgtctttaagcgtcggtccacggccatgaagtgaatgttggtacgcacggtccgaaactgttccgcggctacgctctttggtttagccaccgtgatcagcttggcgccgtttttcatcgtattgttgtcaactcgcgatttgcgtttaaagattcccatcataaccctcctttaaactcggcgcgtctgcgtgttttgtgaacgccgcttgattgagaaaccgtcatccaggttgatgtgagtaatctgaccgagattcgtcaagcccagttcatcaaccatgaagtcgttgtcccgcacactggtatccatcagatcgcgcatcagtacgatcataaagctgattaacagccctaagacggcccccgccagcgtaaacagcttaacgttaggcgatgatggcttggtgggcgttgtcgcgtgggccacgaccgtcacattattgacattcatgatcttcttgacccgctttttgaagacgctggcgatcgtgttggcggctgccgcggatttctttggattatcggtttccacgctgaccgagaagacttgcgagttggtctgcgtcttgatcgtgatcgcgtctgacagctggctggtcgtcatgctgtagccttgaccggtatgttcaaccttagctggcttggccgcgctgaccagccgcttggtcccatcggccagcgtcttgtacttggctggctgggccttgcgaatgaccttgactgggttggccagctcttttttggtttcttttagaattactggactggtaatgatgtccttataggtattgataacctgaatgtcggcctgctggttagtgtaggcctgaccattggcattattttcgcttttttggttaaccaataattgcgtggttgccgtatattttggcgtcataatgaatttagaaacgataaagccggccaatgccagggcaattgtacaggtaatcaaaaacttcagatgtttacggcacagattaaacaggcgacgcaaatcgatcgtgttgttactgctgttttccaatgttttcctcctttaatcagtcacgctgacgtgtttaagctgtagagcatcgtgaatctcatcagacacgcgctgcatctcgctggttggcacgacttcaaacgactcgccgccttcactgtcgccatggccctgcacgtgatcagaaaccactttgccattagccttgcgatacttcatggctagcgtcgtcatgtcgctgaacgtcagattggtcttggactgatcagcaatcgaattcaagaatttttggttaagtactgacttatatgaagcagcttccttcattaaagccgtgatgaccaggcgctgccgttcttgtcggccatagtcgccctgtggatcatcgtagcgcatccgactgaaggccagggcttgggcaccatccatgtgatacgtcttgccctttttaaagctgtagccttcataatcaaacgtcaatggcgaagtcacactgacgccgcccacttgattaatggctttttccaacccgcccatgttgaccattacatagtagtcaattggtacgttaaagtatttttgcacggtattgatggtttctttaaccccaccatatgtataggccgcgttgatcttagccggtgaatattcagcgtagccgggcagattaactttcatgtcccgcggcaggctgacaatcgtggtcgtctttttttgcggattgagcgtcatcatcatgatcgtatccgtccgccctttgtaatcacggcccagcgcccccgtatcagtccccaaaagcaggatattgattggcttgccttgcttgaggaccttgtcagcattccgatacgtcttggcgcctgattcgctgtacatattattggtagcaacatggacgtttcgccaggcaacccccgcgaaaatcaagacgagaatcactaaaagtccaatgaatgaccacaaaatcttcaaacctaatcgtttccgacgatggtgatgatggtggtgatggtgcgaatggtgcaccggttgattttgattcgattcttcattcatatttacatagtcccatttttaaaaaaatttttacatctacataccttaaattatctatgcataagccccaaaaatcaaggcgtcaagccccgcacgtctcgtcgcactagggtttaacgcctcgattgttaaaagattaatttattgatttatatacacagttacggaatgttacgtttgttaacgctttatatttatattttataaataatttaattaaataaaattcgtcaataaaaagttttattatttattgcccgatgccgcgcacggtcaaatctttataaatggtctggtcgccattatgagcggtaacgtggtatttgcccggctttttaaagttataggtttgatcggctccctgcgcgttgccgttcaaagtcgtcacgacgttgttattgctgtctttgatctcaaactgcgtgttggctggcgccttaaagctgacagtcgcatccccggtcttgtttaaggaaacgtcagtcgaaaaatcgacctgcagctgactgctggatgaagaacttgccgatgaggatgaagaactcgctgatgatgagctggctgcctgcgagctgctggatgcggccgcggctgactctgagctggactgggccttgctgaccttagtggcatgttcattggcaggatgatgttcagccggctcactagttttatctctcggcgcggcaaatgctcccaccagaccgaccacaaataaaatgatcaagccccagttcatgactacctgtcctttgccgatttttgcctgggcattctttttgagccgctgtgtctgatagatccagacgctgacaaaacaaatggctgctaaaatcaacaacaaaatgaacagtttcttcattataatactcatccttttcgaagtttggctaactgttatcttaacacatttagccaaccagccaatcaaacaatcatcaaatgacgtttcagaacgtaaaaaagcgttgctcaattttaagcagcacttttgaattaaggcttagccattatttgtagttaggagcagccttggtaatttgaacgtcgtgtgggtgtgattcacgcagaccagcgttcgtaatctgaacgaattgagcgttgtcgatcaaggttggaatgtccttggcgccaacgtagcccatcccggagcgcagaccgccgaccatttggaagatcacgtcagcaacgtcgcccttgtattcaacccgcgcttcgataccttctggaaccagcttgttggcttcgttgaccccaccttggaagtaacggtcagaagaaccatgcgattgagccatggctgccacggaacccatgccacggtagcccttgtacttcttgccgttttcttcaaagacttcgccaggggcttccgtcgtgccggcaaacatgctgcccagcattacggcgttcccaccagcagccagggctttaacgatgtcgccagagtacttgatcccaccatcggcaatgatggccttgccgtattcgtgagccacggaagcagcatcgtaaattgccgtaatctgtgggacaccaacaccggcaactacccgcgtcgtacaaattgagccagggccgatgccgactttaaccacgtcaaccccagcgtcaaacagcgccttggtaccttcaccagtggctacgttaccagcaatcagcgtaacttctgggaaatgttcgcgaatttcggcaatcttgcgcagcaccccagccgagtgaccgtgagccgtgtcgattacgatcgcgtcaacgccggccttcagcagggcttcagcgcgttggaacgtgtcggacgtaaccccaacggcagccgcaaccagcagatgaccgtttccgtcaacggcagcgcggttgaagtttgagttggcaggcagttcaacgcctttaaccgtggctacttcgccggcttgagcatcgatggacatgttcttgtgaacgacccccatcccgccttgcaaggccatcgcaattgccattgagctttcagtaacggtatccatcccggcactgataaatggcacgttcagtttaatattctttgccagctgcgtactcaaatcgacttcatttggcaagacatgactttccgctggaatcagcagcacatcatcaaacgttaagcctttcttggcaaacttagtatcccaattcgacatcaatctgcacttccttctttaaatattagctactaccttactaggtttttggcgattggtcaacgaataatcgtgattctaacataattctaataatatttttcagattgttcggttttaactccttttaatcatcattttaggaccaaataccaaatctgtcggcgatagattctgacaatttataaaaaagcaccgcgtttcacgtggaaccgcgatgctgatttttattgccgctgttgacggcgtggcgaaaaggcgctggtaatgtggtagcgtccccgcagccagatgtcgagcgcaaaagctgccacccctaaaatcaggtagaaccattgattcagacgtgggttgacgctgtttggcatcatggccgtcagaatgtagatcaaaatccacattaccagaccactgaccaccgtaacgatccgggcccacaatggtcgtttgacatatttgcccgtttcttcgttcttaactggcagcatgtacttggcgatccagccaaacagaatcccaccagtaatagctacgatgatgattgaggtgatccccatattgccgttgtgcgcaactttcattgattgtggggagatccagtccatcagcccaaacataaaggtaaagatggcaaagaacatgatcccgttatccagtgccatcaattttaatgagctctgcgtcttggattgttcagttggctcaggatgcagcagagcgtgggcccgctgcgttggcgtaccaaacaggccgcgcgccgtttgaccagtcttttggccttcctgcagcgctttgagcgtttcttcaagcatggctggctttttggctgggtcagcgccctgtgcgtccagctgcttgtttaattggaacatgaattcttcgtttttgcgcgtcagtccctgcttgccaaaagcccgcgccgtttcttgacgctggtctttggcgtattctttttgtcgctggccagcagcggcattgcgtggttgttgttcttttgattcagccaagatgttcttcctctctttaattgattcaatgattagacgttgaagcggaactcaacgatgtcgccgtcctgcattacgtattccttaccttccagccgtagcttgccggcttctttaactgcctgggcactgcccagttcgtcaagatccgcgaagctcatgacctcagctcgaataaagccgcgttcaaagtcagagtggatgatgccggctgcctgtggtgccttcgtgcctttcttaaaggtccaggcccgcgtttctggtccgcccgccgtgaagaaggtttccagtcccagcagtttgtaggctgcccgaatcagccggttcaagccgggttcttcaacgccttccatttccaggaagtcagccttttcttcttcatccatttcggcaatctgttcttcagccgctgccgctacgccaatgacctcgccatcgcccttaacgtgttccttgatggcatccatgtacttgttggcatctggatcggccatgtcttcttcagcgatgttggcaacgtacaggaccggcttgctcgtcagcaggaatagacccttgacgattttttgttcttggtcgttgaattcaatggaacgcacgctttgaccattttccaaaaccggcttgatcttgtttaagacttccagttcagccagggcttccttgtcgcgacccttagctgcccgttgaaccttagccaggcgcttattaacggcatccagatcggccattaccaattccaggttgatcgtgtcaatgtcttcgatcgggtcaaccttgccagaaacgctggtgatgtccgtgtcgtcaaatgcccgtacgacatgcacgatggcgtcagtctggcgaatgttttccaggaattggtttcccagaccttcaccttttgaggcccccttgacgatcccggcaatgtcggtgaactcaaacgtggtgggcacgatctttttggcgggaatcagttcttgaatccgttccaggcgcttgtcgggtacttccaccatccccacgttgggttcaatcgtggcaaatggatagttggccatttcggcacctgccttggtaatagcgttaaacagcgtggacttgccgacgtttggcagtcccacgatacctgcagttaaagacatgaaataattgctcctttttaattagtctgcttcgttttcggcatgttccagcacctttttgagatgcttttcaaagttttgccgcgacatcatcacgatatgaccgcagcccgtacactgcagcttgacgtcaatccccgttcggatgatctgccagcggttggtgccgcatgggtgctgctttttcatctgcacaatgtcgtttagttcataggttttcatcgcaactgctcctctctaatcgaacttgactcccaaaagatccaaaatccgcgtcaggtcatcatccgaggtatacggaatctcgactttgccgccccgtttgcccgccgtcatcacgaccttggtgccaaaccggctctgcagctgttcttcggcttcacgaacgtaggctggctttttggcagtcgcctttttcttagcgggcttggcagacttgacgacttgattttgttcagccaccagctgttcaagctgccgcacggtcagattttccttaaccgcgcgctgagccagcttaacgagcgctcgttcatcctttagccccaatagcgtacgggcctgtcccattgacaagcggtgatcctccagcatgtccttgaccggctgtggcaggcccagcaaccgcagatagttggcaatgtaaggccgactcttgcccagcttttcagcgacctgcgcttgagtcagctgcaggcggtccatcagtgattgataggcctgtgcttcttccagcggtgtcagatcctcgcgctgcaggttttctaagacggcaacctccatcatctgcgagtcgctcatcgtccgtacgatcgcgggaatcgttgttttgccagccagcttggaagcccggaagcgtcgttcgccagcaatgacctcataacgattcagatctggatccggctgccgcagaatgatcggctgaaagacgcctgattccttgatcgaagctgctaattcctgcagggccgcttcgtcaaaagtacgccgcggctgatatgggttaggccggatcgccgttagttcaatttcttctacgctttgctcgtggtcttgcttggcatcattatcgccaaacagcgccgcgagactaaagccacgtttttttgccatgtttcgccagtccttcctttagtgcttcggaatgcgaatggtaatctcatatgaatcggccgtgtctttttcactgaccttggctgccacgccgctgtccttgaccattttaatggagtgcttgatcgtgttgacggcaatccgtgggtcactgaccttgattgatttgggctgctttttcttagcccgtttctgcttagcggtctttttggcagctggttcagtaacggcatcattttcggttgccgaatttgacggagccgccgcattgctttgactggcagcagcttgttcctgggcagcctgttgcgcggccttttccgcactggttggcttgcccagcatttgtgccacggcatcttcagtctggcgaacgttccaatgctggttgacgatctccattaaaagcgtgcgctgctgatccgcatccagactcagcagggcccggccatgacgctcggtaatccggccatccaaaatcgcgttttgaacgggcttgatcagtttcaagagccgcagcttattggcaacgaacgactggctcttgcccattcccttagccagcgttgcctgggtcagatggttgaactccatcaattgcttgtaggcctgcgcttcttcaaccggactcagctgggcgcgctgcagattttcgatcagcgctaatgaagctgattccgcgtcagtcatcttttcgacgattgccggaatcttttcccattgcagcagcttaacggctctaaaccgtcgctcaccagcaatgatctcgtattcgcctggtcgaaattcccgcacgacgattggctgcagcagaccatgctcgctgatcgtctgggccagctcttgaatctcggtttggtcaaaaaccttccggggctggtattggttgggtacgatggcggcaaccggaatctcaacgacttgatttttggtttcgctggcggttccctggtgcttgccaaggccaaacagtgaaaatgccatgtctcaatcctcttttctactcaattggctgcttgttgggcaatcctggccgccgggggtattttttcggcgtcgcggcaactttttcaattacgatcagattacgctcctcatccgtaccaggtaaggtcagcttggtggtgtgctcaacctggccgcccagtaccttgaccgccttaccgcctttttgcagctcgtctttagcggcactggccttataagcgatgaattcgccgccgaccttgaccgctggcaagcacagctcgcttaaaaccgacagtctggctacggcccgtgccgtcaccacgtcaaaactttcacgatatgggctctttttggcactgaaggtctcagcccgatcatgaatcaagttgacgtcgtttagccccagcttattgaccaagtcgtccaaaaatttaatccgcttgttcaatgagtccacgatcgtaatctttaactgcggaaaagtaattttaagtggcaacgatggaaagccggcccccgcgccaatatcgcaaagcgtcaaggcttcagtctgcagacgaggttcggccagcgctcccgtcaacgagtcataaaaatgcttgagataaacttctttttgatccgtaatggccgtcagattaacgtgttcgttggtggccaccagatcttcataataaatcgcaaattgggtcatctgagaatcagtcagttcaatgccgtgatcctgcagtgcccgtcgaaattcttccggtgtcatagatcctcctttgtgaaacaggaagatgtttcacatactccattactttaccccaaaaaggccgttgtttcaagcgatccaacgatttacagcggatttttagatgccgtcgcgccagctcgataaacccgccggcagcccgtgtccaacaacgctatcgaatcatttccagatacgcaaaaagccggttgaaacgcgcttggcgaatcaatcggctttttatctgaaacctgggcagccagtttccagatgattatttggttttagcgcatcttactgacttcttcaacaaaccacttgttaaaggcagccgcgtcgatgtcaacacataccttggcgttggtcttgccatcgtggtaggcaccgcgaatgtcgccgaccatggcaccaattgctggaccatcagtttgaatgtcgatccagacatccttggtcgtaaatgcttcagggtgcagcaggtagaagatcgtgttgacgtcgtgcattgggtgaccgccagtttcagcactgacgtcgttgtagtggctgatcagaccataaagcatcttaccagtctcattcatgtccttgatggcgttcaggctgtcctgcgtcagcaaggccttcagcgtaacgtccagaccaaccgttacgattggcacaccagacttgtacatgatttcagccgcgtgaggatcagtgaagacgttgaattcagcaacactggtcatgttaccgccagtcagggaaccacccatggcaacgatctgcttgatgtggctcttaacttctgggaattccttgaacagcagcgcaatgttggtgtaggaaccagttggcaccaacgtgatttcgtcttcagccatgatggcatcacgcagagcttgaacggcactcttttcaattggcgcaccgtagtcattgccaaagtcgtagccttccatcccagaggcaccgtggatccgagctgcgtcttcaaatggcttgatcaaaggttccttggccccttctgcaactggaatctcgtcacgcttgccaaagaagttaacgatcttcagtgcgttggccgtcgtcttgtcaactgaaacgttaccagcaaccgccgtgatcagcttcaagtcgatttcagggttgttgattgccatcgtcaaagcagctgcgtcatcaataccaggatcagtgtccataataatcttagtcgtcatcatgaattcctccttaaaattacaattaagcgtcagtaagcgcttttacttttctgggaaacaaaagggccaaccggaatggccagccccttttgactggcaaaacgcgttaagcgcatgcagtcgtagatcttaccaaacgaacagaccaacaaaggctgcagacagcagtgataccaagataccagacagcaacaggtagccaatgttttgagcaatgtagtcgttggtttccttgtcggcgatacccttgaaacaaccaatgatcataccaagcgtaccgaagttggcaaaggaagtaacgaacgtggtcagaacggcttgcaggtggtgtgggtaagaagcaatcttgcccgtaacttcacccataacaacgaattcgttcgtaaccagcttcatacccatgtcttgtgacagcatccatgcttggtgaacaggcagacccagcagccaagcaaatgggaacatgatcacacccaggatgctttccagcgacagttgcttccagaacagagccaggatggcatcgatcagagcagccagggcaacgaaggcaacaacgttagcaacgatgatcaggatcagcttaccggcacccaggatggagtcgcccaggaagctgaagaatggttccttcttaccgttctcagaactaccaactttttcaatcgtgtcttctgcttcagtaaccgtaactgggttcagcaggctggtagcaatcagtgagttaacgatgttgattggaacggcagtcaggataaattgaccaggcatcatttggatgtaggcacccaggattgaagccgtaacacagctcatggacatcatggcgatggtcaggttacgagccttggtcagcttacggatttgcatcccggaaacggccagaacttccgtgttacccaggaacatcatttcaacggcaaagaatgattcgaactttggttgacccgtaatgaatgacagacctttaccgatccacttgatgatccatggcaagaagccaatgtaagtcagaatgtcgaacagtggaacgatcatcaggattggcatcaatgcagaacagatgaagttcaggttcttaacattgtaccaagcacccagggcaaagaccgtacccttagcagaaatgttgacgatccaagcaaacccgtcggcagcggccttaacgccggcacgaccagcagctgaaccagtcaggaaccaggccaggaccaggttcaatacaatcatgatagcaattgctttccagttgatcgcttttttgtccttagagaacagaaaaccgatacccaagaagacaagcaacccaagaatgttaattgcaagatacatggatataacacctttcttaaaaactgaatctaactttttctcaatcgcaatttctcagtatctcagaatagcggaataattgcagtcgaactgagaaaatcttgcgtgccataataatatacccatcttttgtaaaactgtaaaccgcatacatttgccaactttgtgaaatcatgaaaccgttaccagtattattcggaagtaaatcgttttaaatcaaggcaaaacttaaaaatttgttaaagaaatgtgatttaaatttcacaaacttttttctaatttcttcggtaaaacgtttaaagcttcatatgttttttatagaccatttgataatgcaaaataaaagcaagactgtaaccacttacaattaagtggtcatcagtctcgttgcccctgccaaggatctttagtataccacattgaaatcgctttgtttttcaaaacagcgctaattagtgaaaaatgcaatcgtttgaaattgaacaaagtcgttaatcagtcgtattgatgcaaagctatcgagagtcgtttcaatccttcttttaacgtagcttgcggcgcacagtatcccaatctgacgtggcctggcgtatcaaatgcatcccctggcaccaacaagacgccctggtcagccagcagctgctcgcagaattgatgaatgtcaaccggcacatccagtttggggaacgaggtcgaaacggcttgcggcatgaccacgctggctcgttcctcattggcaatccactcttgatagatttgcagattgctcatgaccagctttcgattgcgtgccaggacctgttgtttatgacgcaggacataggtggccattagatcattaaagaccccgccgcagatcatcgtatagtcgcgatacttgcggaagcgctcggtcagttcggcattggcagccgtccagccaatccgaatgccgggaaccgaataagtcttggaaagcgagttggtggcaatcgccttgtcatacagatccacgattgaaacaaacttttctggctgatctaatggcagatagacctcatcaaccaagatataggcgccaacctgagctgccaggtcaaccacctgctgtagaaattcctggtctaagacggtgccggtcgggttgttggcgttattgagacagatcagcttggtatcagggcgcatcagctgctttagttcttcaatgtcgggataccagttggcggcttcatgaatctgccaatagttgaccgtggcccccaatgatttaggaatgtcatagagctgctgataggaaggatattcagcaatcacgtggtcgccgggttccaccagactataaagcgccaagagatttgctcccgtcgcgccattggtctgcaggatgttgtgcggatccacgtggcgatagagcttggcaacttcggtcttaaagctgggggagccttcaatccagccatagttcatcttttgggcattgagcatctcgtaaaactccgcgccatgatgaccatccagattcatcagctcatccatcgtcaatgaagcgatcgtgctttgcgaaatatcgtagtgggcgcttttttcccatttgttcaaccaggcttccacgccaaatggagcaatctcagccataaattttccccctattcgatcggaatcgtaccgttcaaaatcaaaaccaacgaaacaacagccaaaatactgatcaagcccatcgccagccattcgtttttggcaagtcgcagctttcgcgtgcgccgagcctgccaataaatcagaaagcccggcagcagactcagcgataaaatcattacctgccgccagccagccaaagtcatcgacaacagctcaaaaatcgtcagcaggatgccaattactaattgaccataagcacgctgctgccagccatctttaatctgcgccagtccaacaaagaaatagacgatcagtcccgcagccgtccccagcgtataggcaaaccgataagcataggtcgtaaacaacagcgagcacagaaacaggcactgaacgatcgccgttacccaaagcgcggtcgtcggggcatgatgcgaattgagcctgccaaacaaacgcgtcagcactcggtctttagtcatcatcaaaaacgcctccgccggcagcatcgtccacgaaagccaggccaccagcaccgaaacgatcaatcccaaactgatcaaagccgcgccccagggtccaaccaactgacttagaatcgtacccatcgccggttgcgcggctccagccaattgcgcgcgcgtcattacgccataaggaagcagcgagatcagcaggtagacgactagcagaatcagccagccgccaaatgaagccacaacggcatcccgctgacgcttagctcggtgcgccatgaccgaggcactttccacgcccataaacagccacatcatcaccatgatcgagtttttgacctgatcggaaactgccagggtgggacgggaagactgcgcagccgcgccccaaaagttattgacaaacgtcgaccaatgaaacgccaatgccgttatgatagtgaagatcagcaatggtatgagtttggcaagcgtaccgattaaattgagcagcgcggtagcctcaacaccatagctgacgatcacggtaaaaccaatcgtcaaaagtattgccagtaaaatcgacggcaggttctgaccaccttgaaaaactggccaaaacgttcccagcgcgctcatcgcaatcgtggcagaggttgcccagccatgaagccagccagtatgcccagccggaaataaactcacccagcggcccaaacgaaagccccgcgtacgcaaaaattccggcgtcctgcttggggtagcggagcaagagatgattcagcgcggcaatcaggcaccacacgcccaggccgacgatcagccagcccaggattaccggtcccggtgccgccgcgttggccagatcactgttgacgccaaagattcccgagccaattgtcgcgcccacgatcaaagccgtcagttcatacttgccgattttgtttgaatcagccatcacactcctcctttcgcgcagcctttctggatcagccaccactgctctatcttcacgcagctgctctggatcagtaatcgcagctctatctttgtactactgttccatggcttttgagccgcttttggcatcacacctcatgaaaatgacctgttgctgttgctgttgctgttgctgttgctgttgctgttgctgttgctgttgctgttgctgttgctgttgctgttgctgttgctgttgctgtcagtttaccggctttggcagcggatttcaaacgctttctccagcgcaattgatcgactttgctgttgcttctgatgctgttatggctttaatgaaacagcgagattggtactactcgattggctggacacccgccatgcctcagctctagcgatatcccacgatcaatccggcactggtcttgaaccccatactaaaacgtgcaaaataaaagacccggtgaatattcaccaggccttgggggaagaagcgcttgccgttgccatacttaatatcaaaactcgattatttaccttgcttacttaatctggtctctttatgccaagagatctatgcaacttcaattgtcgacgttctcaaataaggttgtacattagatacggccactaatttagttaattaacaagctttcttcaggaaattcaatttattgtgtgatgtggggtgtgttatgctgccatcgcccagattaaaggcgattgccggatacttttacatttgcaacggatgaggtttcttccatgcttttattataaattccctacatttaaaagtcaactcaaaccgcgtcatcaagccaatggaagcgctatcgcaattatacgattatccaatttttttcgtctaaattaaatgatctaaacaggctttttgatttggtataaaatctttttaatcttgggcctgcttgcgcttgtcaacaatggtatagccgacaaacagtgcaataaaccagacaaagctgatcaacagcggcaaacgcgttgacttaacaaagaacaggattaccaaaacgccgataaagaagatgatcgtcagccagctggtaaatgggaagccgggcatgttgaaagcagccacgcctttgggatgctttttgcggtaaacgatgtggcaccacaagatgatcagccagacaaagacaaagttgatcgttgagaccccggaaacaatattaaagattccggctggcatgatgtagttcaagatgacgacgataaacagaatcaatgacgagaagcgcagggcattgttcggcacggcctggttgctcagcttggcaaacttttgcggtgcgttgtgacccgttgccaacgcgtacagtgatcgactggtactgaaaatcgagctgttggttgctgacatggcggccgtcaagaccacgaagttcaaaattgcagcggcccccggaatccccacggcttggaacagctgaacaaatgggctggaagtcgtcttgatcatgttccatgggtaaaccgacatcatggcaatcatcgaaccgatgtaaaagagtccgatccgaactggcagcgaattgatggccttaggaatgtcgttgttgggatccttggtttcaccagccgtcagaccaaccatttcaattccgacaaaggcaaagacaaccatttggaaactcatcaaaaagcccagcatgcctttcgggaagaagccaccgtgcgaccacagattgctaaatgaggccgggtcagaacccttgactgggaagtgaacgaagaccattaccaaaccaattacgatcagggccagaattgcaatcaccttgatcatcgcaaaccagctctccatttcaccgaacagccccacgttgatcatgttgaccagcatcaataagacgatgatgaccaacggaccgatccattgcggcagattagggaaccagtagcgcaggtagatcccagttgcggtcagatcggccattgccagactcagccagcaagaccagtaagtccagccggccacgaattccatgcggtcgcccaggtattccttgaccgaatcaatgaacgagtgcttggtagtatcagctaaaatcagttcacccaaggcccgcatcataaagaagcagaagatccccacgatcaggtaagataaaatgatcgaaggacccgcagcgtgaatggccgtccccgaacctaagaacagcccggtcccgattgccccaccaatggcaatcatcgtgatatgacggcttttcagcgcccgcgatagtttttgttcttgttgttcatccatactttttctcctgtaaaactctcaatgacaaacattcctgtacaggagggcggcaacactgacgcaaataaaaacgtccctgacactaacttgtgtcagggacgtttttcaacgcggttccacccatcttgcagacatcttatatgcccgccgctctagcagtcgatagaggaaccacccttcatttcaacgttgatgccataagatcgatcccgtgcttacagctgggcagcgggtctctgtaaatcgaccaataattaaaagttactaatcattataacgattttataacgtttgtcaaacattaaatccagaaatatcgaacgaacccctaaacgtttaaaactttgttaaggaaattctgggtatctggatgctgtggatgctcaaagatctgttctggcgtaccatcttctcggatcttaccgtcatggaagaataccacgcgatcagccacccgcttggcaaagcccatttcgtgggtaacgacgatcatggtcatcccttctttggccaggtcctgcataacgcccagcacgtcaccaaccatttccgggtcaagggcactggttggttcatcaaacagcatcacgtccggcttcatggccagagcacgggcaattgccacccgctgtttttgtccaccagaaagcgtccgtggattgacgttagccttttcctttaagcctacgatatccagatagtgcagcgcggcttcttgcgcttcttccttgctcatcttcttcagttccacgggtgccagcgtgatgttgtcaattaccgacatgttggggaacaggttgaagtgttggaacaccatcccaatgttttgacgcaccaggttgatgtcagtcttcgagtcggcaatgtcgtagccgtcaatgtagatatgaccgctgtttggcacttccaagcggttcaggcagcgcagaaacgtactcttacccgaaccagaaggcccaatcatgcagacaacctcacttggcttcacggcaagatcgatcccttttaagacctcattttcgccatagctcttgtgaaggtccttgacttgtaccttgtattgcttgtccatgctatgcctccattctcttttgaacgtaattcgacagccaagtcagcagcgtaatgatgatcatgtacattacggcgatgatcagccacatcttgaacccttccatattccgggcaatgatgacggtcccggtctgcgtcagttccatgaccccaattgccgaaagaatcgaggtatccttcagcgtaatgatcaattggttaaccaaagatggcaccatgatcttcaacccttgtggcgcgataaccttaaccaatgccttggagtatggcagacccagactgcgggcagcttcccactgaccaacgtcaacggcttcaaaaccaccacggacaatagcaccaacataggcaccttcatcaagcatcaaggtcaaaaccccagccgtaaacagcggaatcttttgaccagtcaggtttggcagcccaatgtagatgaagaatgccaaaaccatcattggaatcccacggaagatgtagatgatcgtgctggaaagacccttccagaacttgccttccgcgatgcccatgatccctaataccaaaccgaatgccaatgcgcacagtgaaccaataatcgtcagttcaatcgtttcccaaagaccagtcaaaagggccttacggttgttcttgatcagcccaaagatcgtccggtccttgctgctttcagtcttcgtaccgctgcctttcgtgtacttatcaattagcttttgcatccggcccgtcttttgcatccatttgatcccatcgttgatcttggcctgcagttctttgttttggcctttcttaaagccgattgcgattggcgtggcattgatctgtttagtaacgatcttcaaaggcataccattgcggatcccgtattgcagaaccggaccgtcatcaaacgtagctgccccgttgccgctcttaacgtcattccacattgcattagaagttgtaaagtacttgatcttaaagccgtacttgtccttgatggattcagcatacaaggccccagcagccccagacttaacatcaaccgtcttgcccttgagctggctcatcttggtgatcttgctgtttttgccgaccgccatcacgatcccgtctttatagtaggaagttgaaaagtcgattttggcctttcgttcgtcggtaacactcatcccacccatgccggcatcgatctgaccggaatccagagcctgcagaatggcgttaaagctcatgattttgtatcgatacttgaaatgctcgtgtttagcaatcatccgaatcatttcaggctcaatgccgggattcttaccagtataggtcccttgtttgttttgaatttcaaagggagcaaaggtgtcgacaaccccgatcgtgtaggtctgttcggcatgcgccacctgcttattgacaaataatccagcgaacgtggtcatcagcattaccgcgcagctgatgattgtgcgttgccaccatgacttcttcaaattcctcactcctttttacttattttttaaccgtttattaatattcgcgtactgaatactttatcacctttttaatgtaaaaagaaatataatcgtctcaaaaccatgaacaattaatattattaggccactaaaattaattaaataaggtaaatcctccagaaaacttaattaatcaaatctaaaattcgcctaaccaaatttttggcaactattaacttttaattttgaaaccgttgccgatttaacattcttaagcgacttgactttttgcacaaatttatgtttaaatacccctaattaagacgcgcaggaactcagtaggcagcgactccctgttcaaagaaaaccggcacagctgaaaaccggcacacagtcgtttggcgaattacaatcctgcagcaacgtcgctgaactgaagtcaatgaggtgcgtcatgcacgaagatgggtggtaccacgagcaattcgtcccagagccgttaagcggttctgggacgtttttcgttcctcatgacattttttggaggtatttaaatgaatattattgacgaactgacctggcgcggtgccgttaatcaggtaactgacgaagaaggtctgcgcgaactgacggaaaacgaaaaaatcggcctctactgcgggaccgacccaaccggcgacagcctgcacattggccatctaattccgtttatgatgctgaagcgattccagctggccggccaccatcccgttatcatcatcgggggcgggaccggtgcaattggggatccatccgggcgcaaaaccgaacggaccctgcagacggaatcacagttggagcacaacgttaaggctctgaccaaccagatgatcaagctgttcgggacggaaaactttaccatcgtcaacaactatgactggctgtccaaactgagcatgatcgacttcctgcgcgactacggcaagctgttcagcgtgaacacgatgctgaacaaagaagtcgtagccagccgtttggaaaccgggatctcctacaccgagtttacctaccagatcctgcagtccatcgacttcctgcatctctaccggcataatgacgttcacctgcagatcggcggggctgatcaatggggcaacattacttccgggattgatctgattcataagattgaaggccccgacgccaaagcctatggactgacgattccgctgatgcttaaggcagacggtaccaagttcggcaagacggcgggcggcgcagtctggctggatccggaaaagacgacgccatacgagttctaccaattctggatcaatcaagatgaccgcgacgtcgttaaatacctgaagtacttcactttcctgagcaaggacgaaatcgacgcgctggctgaaaaagtcaagaccgagccatggaagcgcgcggcccaaaagacgctggcacgcgaggttaccaagttcgtgcacggtgaaaaggccgttgaagaagccgaacgcatcacggcagcactgttctccggcgacgttgcccaactgtccgccagtgagatcgaacaaggctttaagaacatgccatccgttgaggttgccaaccaaaagcagaacattatcctgtggctggttgacgacaccaagatcgagccttcccgtcgtcaagcccgcgaagacgtcaagaacggcgccatccgcatcaacggcgaacaaatcacggacgagaatgccgaaatcgatccaagcacgcattttgacggtaagttcgtgatcgtgcgcaagggtaagaagcgctactggctggcacgggtgaaaaagtaattggagaatctggggcagtagtttctggattaagataagacacgttgctgctaatatgggcgaagaagtagttgacccaggcagctagtttcgcgttataatatagctatcatgcacggtgcaatagtagtcaggccaatgacagagagattccaaatgctgagagggatcgcggctaagcgaaatggagcggtgccgacaactgaatcaaaagcatttaagtgaggggctttcccctaaattaggtggcaccgcggcaaagatcgtcctattctcgtttggagagggcggtcttttttaggtgctgaaaggagtttttcttatgaagtttgatcctagcaaaaaagtcgttttaagcggcgaccggccaactggtaagctgcacattggccattacgttggttcattaaaagaacgggtgaagatgcaaaacagcggcaactataatatgtttatcatgattgccgaccaacaggctttgaccgataatgctcgtgatctcgaaaagatccacaacagtctgattcaagttgcattagactatctggcagtcggtttggacccagccaagtcaacgatatacatccagtcccagattcctgctttatccgagcttaatatgtattacttgaatctggttacgttatcgcgactggaacgcaatccaaccgttaaggccgagattcagcaaaagaactttgaccgttcgattcctgccggctttttaacctaccctgtcagtcaagcagctgatatcacggcatttaagtgtgagctggtaccagttggcgatgatcaagagccaatgatggaacaggcacgggaaatcgtccgttcattcaataatatctatggcgacattctggttgagccaaagggaattttcccgcccaaaggacaaggacggattcctggtctggacggcaacgccaagatgagcaagtctttgggcaatgccatctatttaagcgatgacgaaaagacgctgcaaaagaaggtcatgtccatgtacaccgacccaactcacattcacgttgaagatcctggtcatattgaaggcaacgtagtctttacctatctggacatcttcgaccctgataaagagcacgtgcaggaattaaaggaccaataccaagctggcggtctgggcgacgttaagatcaagcgctacctgtttgaagtcttgaacaacgagcttaagccaattcgagaacgccgcgaagaatttgccaaggacattccagccgtttacgatatgctcaagcaaggctgtgccgatgccaatgaggttgccaaccaaacgctggcggaagtgcggcatgccatggggctggattactttgcctagctgaatcaaaaaagctttgcacaactcgcgcaaagcttttttagtatctaatggcccagggaaagcagcgtcataaatggctgtttgatcagacccatcaaaacgtcgattcccaaaacagcaatgacgataatcacggctgccaggatcttttcagcatgactgaagactgtttggccatgctgacgacgcgcgtacagatacattggcatccccaccaggtagacgatgaattcagccaccgtgtactttaagcccgccgaaacgcccatcagcagcgtgtaaacaaatgccaaccccgcaataatcatcccccgctttggatgatgccggccactgtattcatggtgcatggcgatcttaaacaggtaggcctcagcaaccagataaggcggaatcgttgtcgccgcgctgattaaaagcagcttttcataggcctggccgtcaaaatgcgccatcagaataatggcctgaatcgttaccgtggcaatcaaaatggcaaacaccggctgatcgttggcgttggtcttggcaaatgcccgtggaaaagtaccatcctgttcggcggcatgctgcggcagctcacagatcatttccagccacgagatccagctggccagcaccgtcaagatcaaggtcagactgatgatgttacggccccagacgttatgccagatactggtcaggatcgcggccgtagaaggcgaggccagccgcatcaactgaccataagaaaagactcccagcgaaagcagactgatcaaaatatcgatcgtaatgcagatcaagaacccgaccagcgtagccattctgacctggctacgcttcttggcacggcccaccatgactgctgctccctcaatcccgctgaacatccacagcgtaaccatcatcgtggccagcgtctgctgagatacactgcccagattcagattgtgcacggatggcatcaccacgttggcttgcatgtcagtcgtgaatttctcccagctgaagttgcccattaaggagatgatcaagacggtaatcacaatcatcagcagcgtcatcgcgattttctgcatgcggttggaagacttggtgccttttaaggtcagccccgtcattccccaagtcaaaagcgaggccccgatcattgacggccagttgttgccacctgcaaacgtaccagggaaaaagtagttgagcgtgttcatgaccagcaccgcaaacgccgcattggtcgcacagttggagacaaaatatccccaagcggtcaaaaagccaacaaatggtccaaaacctttcacgccataatcatacatcccagccgtcaaatctggcttcacggcacttaggatcataaaaacctcggcaatcagccacatgccgatccccgtcgtaatccaggccagaatctgcgccgttgcccccgcaaccgtcgccatgtttttaggcagatcaaaaattgccgaaccaatcatggcgctgacacagatcgcgaccagcccggcaaagcttaattgattatcccgtacctttggattcgtcattgcaatcgccttcccctctaaatatccactccttttccgaaaacgatttcatttctacttatattatagtcgtcgacagctgctaccgggatcgtcaattttcgatagctgttattatctatgccaaaataaggcaaacaccaaaaaatgccttgccgcgcctaagcacgacaagacatttttacttgattaccttaactgagcgtcgggaaaccatgatcgcgtacagccaggtcaccagcatcatgacaaagaccgagacaaacaagaagttatagccggcctggtcaaccatccagccgccatacactggtcccagcgcccggccaatcgacatggcaacgttgggcattccttgatacttaccggtttcctcagcgacggtcaagacatcgatataggctggcacggaaggaatcccgaccatttccccaatcgtcaggatcacaaagtcaacgacaaacatcgcaaaactgtgtacccagatcagcagcggaaatgaaatggcaaaaatcgcaatcccgataataatctgccgcttaaccgaaagatagtcggccagtctggtaaccaggggctggcccaaaacgatgaccgccccattgatcgtccacagcagactgtaggcaaagaatggaatatgcatatcggtaatgtgcaccgacatgacgctttcccataaggcatagctgaggtagaccgttaccaggcacagacagtaggcatagacgatgtggacgttgtgacgcggactcttaactgccgcggcctgctggcttttaaccgttgacttgggccgcacgtcaacgttaaagtgcagcaccgtaatcaaaaggtaggcaccatagcagacgctggctacgataaagacgatctcgattcccaggtccaacagcgtcccgaccaatagcgtcccgactacgacccccacgttaagcgccatgtacagcatgttatagacatagcgggcagtgtgtcccgtaacggccgagccataggaattgatcacggtcagtcccgaaccgtccgcaaagcagatcacggccagcagaatcggaaacatcggccagccatgaaagaaaatcatcaagatatttcccaaagtggcgaccgttacagtgatcaccgcggccgcgtaaggcttccagttgtcaaacagccagccgcccaggtagttgccaaacatcatccccatggaactgaaaaagattaccaagcccgcgaccgtcatcgacttgttcaagtactcatgcacatagatcgtcgttaatggccaaagcatcgcggcgccggcattattgagcagactcgccatgaacagccacttgagcttgattgattggcgtggcataaatatgcaccctttctaaagcactaataaagccccttttccgtgcagcaagccgacacggcaaggggctttattttttccgtgtctggcttggttgaaactttctttgtctctagtttaccagacattctcagcagactccaaacacgaccgctgattggatcttacttgtgcaggtagttgaatggcaccgcgtttgctggcgtgatcttggtgatgccatgcatgtaaggtaccagtgcttctggaatcgttaccgtaccgtcttcgttttggtagttttccaaaattgcggctaccgtccggccaactgccaaaccagaaccgttcagcgtgtggaccagctgcagcttgccgttttcgtcacggtaggtaatgtgcatccggcgagcttggaaatcagtacagttcgagcagctggagatttcacgatacttgtcttgagctggcatccaaacttcaatatcatgcgtttctgctgaagtaaagctcatatccccagtcgacagcgtaatgacatggtatggcaggccaagcttttgcagaatgttttcggcattcttagtcatcttttccagttcgtcaaatgaggtctccggcttaacgtacttaaccatttcaaccttattgaactggtgcatccggatcagaccacgcgtatcccggccagccgaaccagcctcagaacggaacgatggcgacagcgccgtgacgtatactggcagcttatcggttggaatctcttcaccagagaagtagttggtcaaaggcacttccgccgttggaatcagcgtcatgtcctcgccattgacctggtagacgccttccttaaacttagggaactgaccagtaccgtacatggattgagccttgacgatatatggcggcagaacttccgtgtagccttccttcatgtgttcatccagcatgaagttgtagacggcccgttccagttgagcacccaagccgacatagtagacgaaccgcgcgccagaaaccttagctgcccggtcgaagtccaggataccgagcttttcgcccaggtcccagtggtgcttaggctcaaaggcaaacttagtcggctcgcccaccttgtattcttcacggttgctgtcttcatcaggaccaaccggcacgccatcacgcggtacgtttggcaggtgcgccagcttgtcgtttaagatcgcgtcgttttcttcgacctcaacgtccagcttcttgatgtcttcaccaacctgacgcatttcggcaatcgcgtcatcggctgattcatggttgcgcttggcctcaccgatcttcttggaggccgcgttacgcttagccttcagcgtttcggtttgctgcagcagttcacgccgcttttcatccagggccaatacttcgtcaatgtcttttggatcaacgttgcgcgttgccagcttctgcttaaagaattcagggtctttacgaatcttcttgatatcgagcatctaaaattcctcctaggtatataaaaagagccacttcatccatattttgggacgaaatggctctggttccgcggtaccacccaagttcgacaaagatttgtcacgctctgcatggataacggccatgaacccgtgcggcattacccgcccacatttaatgacaccggagtttcgatcgctgccttgcaccacccgacagctctcttgagatctactttaaaatgtcttcgtgttttatatcatcgctatcttattacatcctgcctgatttggcaatcttttcggctaatttattgcaaagtcgtgctgatagctgacgtgactgtggcccttgtcggaactgatcttgagctgatcgggaatccgttcttccaattcggtcacgtgactgatgatcccgaccatacgcgaattgccttccaaagtctgcagcgcctgcaatgcattatccagcgcggcttgatccagcgagccgaagccttcgtcaacaaacagagcatcaatttgaattcccccggcctgctgctgaatgatttcgccaagcgacagcgccagggccagcgaagcagcaaaagtctctcctccagacagggtatgcacgctacgatccttgccggcatcacgatctctaacgctgacttccaatccgctccatttgttgtttgagccggtgctttcttccaaaaagaactcatagcgatcagcggttaattgtctgagccgtggattggcattgttcaggacctctttgaagtagtgtctgagcacatatctttccaaagtcagccgcattgaattcttgccattcatggtattgaccagatcactgagccgatcaagttcggcctgctgtttaccttgttcctgctggatctcatcaacctgctgaaccgttttttgctgctgttggagctgttcttttaagcgccctaattcccgctgcttttcatcgcacattgtcgtggctgcctgcaaggctttttgcgtctccgccagctgcggtcggggccgttcgttaatggctgccagcaggtgctggcgccggtcaagattgatcttgaccgcctgttgatattcattgacggtctgctgcagcgattccagctgatccagttgggcaaagtcttctgcatagcgtgaccactgggcattgggatcatgatcttttaagtcctgctgcagctgctcgaccaactgttggcgatgattctgctgctgcgtcaggtttccttgatcatgactgatcgttgcggctactgcggcggcgcgctgctgttgatgctgcagttctgtttggttctgatcctttttttgctgataatcctgcagctgaatctgccaatcatgcagttgttttttagctgtgtttaaatcagcgtatgctggcggcagctgctttactttggccgtcagctcaccattgagtcctgccagttgagccgtcagcagctgttgatcatgatccagtttctgttgctgggccgtcaattcatccaatgtctgctgctgtttttgctgttcttgttgcgcctgctttaattcttcaatagctgcttgagtctttttaagccgttgtgtggtctcattcatacgctcctgcagtttggcggccagctgggcaagatcggtcgccggcagctgactgtcatgtcttaatttcgtcagctcagtcgtgtattcggtttttaaaagcgctaactgctgggtcagattgaccgttttttcctgagccttgactttttgggcctgcgcatcgtctaaagcttggcgcgcctgttttaaagccacaccggcagcttgaatctcatcaagcgagatcttagcggctaggttgcctggctggggatgatcaattgagccgcagaccggacaaggctgacccggaaccagatgagtcgccagttcagcaatctgaagggcggcgtgcttttgatcagcttcttgaaaagcagtctgcgcggtctgataatgctgcccagccagtttctcctcgtgctgggcctgctgcagactggcttgctgatcagttatcgtctggtgcttgctctgcagatcctgcagccgcttgagtaatgcctgtccggtgctgcgttcctcaagcattttttcaatcaactgccgatcggtttgctgctgcaggttttgaatctgctgtgccgttttctccagtaaaaccgtctgctgctgactgacggtttgaacctgctgctgacttttttggagtttagccagtttttgctgctcagtttgaatgcgttctttaagttcggccgcttcttgatatcggggcagcaggcttgccaaagcgattttttgctggttgatcgaatcgatggctggctgctgctggttcagctcttgagcacgctgctgcaattgctgcagtttttgatcaagttccgtagccgccgtctgctgttgctgcagatcgttttgcaagtcttggatagccgcctgggcatgctgccaggcaacgtaatcagtttgctgatggcgaacccactgcagctcgtcaatcagctgctgcttagcttggattgctgattgctgctgatccaactgttgttgaacggtttggttctgggccagctcatcataggcggtctgcagattttgttccacgtgaaactgttcatcgagttttttagcctttgcctgggcagccacagcagcctcgacttgctgagtcagctgctgttcatgctgttttaacagcgtcgcggcggctttcagccattgaacgggatcggtttggtcagccagctcttcaatactggtcatcagttgttccatttgcttttgactgtcatggctggcatcctgtgctgccgtcaactgatccttgagttgctgggtccagtccgcgtatagctgcgtaccaaacagctccgccagcaattcatttttattgttgctgtccgactccagaaactcacgaaacttaccctgtggcagcaaaacgatctggcgaaactgatcagcgttgatgccgattagatcttcaataaattgattggcgtcggtaactttggtgatttcttctttttgaccgtttttttcataaaacaggtctactttttgactcttgtgccgatcctgtttcggctcccgaatgatctgataggtcttgccttgatgctcaaaccaaaatgagacccgtgtcagatccttttccttggcaaaatcagagcgcagtttttcagcagtccgtccattgcgattattatcagtcgttgtaccaaacagactaaagcacatcgcgtcaaaaatcgtggtcttgccgctgcccgtcttgccactgatcaaaaacagcggcacttcgtcaaattgagcaaaatcaacggtctcattgacatatgagccaaaatactccattttcagttttaaaggcttcaattttcttcctcctcaaccttggtcaaagctgccgatgcccactgccgctgctgatcatccagctgctgatcaggatgcactttttcataaaactcatccaacagtgtcagcggatcatgactggccatcgtcatggtcgcgatgctggcatcgtcctgctggttggggcgcttgatctcaacaatcttaggataacgagccctcagtcgattcatcaggtcgctgatcagcttggtgtcggtcaggcggatggcaacatagtcttgggtttgatcgtattgagctgcgattttcccttgcgtcagttcatcaaatgagccttctaaaatgatcagatcatgcttaggctgcaagggggcccaagtgagcttgaatggattcgtatcgacaatccagacccctttttgcagattggcctctgaaaccgaaaacttaagtggcgagccgctgtagcgcatgcgttcttcatttaacgcccgcggattatgcaggtgccccagtgccacgtagtcgaagtcttttaacagcgtggtcggcacggcatccaatcccccaacctcaacttgaatctcagaatcggtatgcgtactgcccgccgcgaaaaagtgcgccaccaagacgtgctttttatcaggatcgaaaagctgcttcatttgattaacaattaaagtcatcgcctggccgatcgtcttaacatcttgttcgaaataattgcggactgcctgcaggttaaagaatggcagcaggaaaaactgcgtatccataatcgtgactggttcaaacgcactggccagcgtggtatgcagataaaaatcggtcgtctcaaaccattcactgcccgtcgccaggcgcgcggccgaatcatggttgccgctgatcgccaatagcggcagatggtcatttagattcagctgcttgagcattccattcagctgctcaaccgcctgctcgctggctaagccccgatcatacagatcacctgcaataacaacggcatcgacttgatagtctttagccagctgttcaatctgatcaaacgccgcggtctgatcttcagcaagcgaaaaatcatgcagtttcttaccgatatgccaatcggccgtatgtaaaaatctcatgagaccttcctttctatcgaacaaacattcgcattgataacattatagcacagataaatcagaaatttcagcatggtaaaattcaaactttcttcgcattttatttagattcagcccctagttaaagttcacgcaaacgttaatacatcagtgtttgatcggaaaaagcgccgtcatttcaagactttaaatatgttttccttaagcaagacttaagtttctttttcttaaacttggtatatagtaatgagggtacctttttaaattcaatttaggtaaaggagtgattagtgaatgttggcagctctcaaacgccaccctgtcgctgaattcctgattaaaacattcttctacttcatcgtcttaatgctgttgatctacctgtacggatactatggcgctggccaggcaccgtttatctataacgaattctagcggaggaaaaaatgatttctaatattgttcgcgagtttgaccgcgtggcaaaagaaaacgccacgcgcgtcgtctatgacgaaatgggtcagactcacacataccaagatttattggttgactcaaatgcttttgcggcttggctcgatcaagaaaaaatcgttcctgaagatggtccgatcatgttttatggcgatcatcaatttgaaatggtggccggttttgtcggcggcctaaaagcaggtcacgcctacattcccgttgaagtcggctcagccctgccccgcatgcagtcaatcattgatgcggccaatccgcggctggtcgtcgccatcgatgactttcccgttgaaaagctgaactacgacggggccgtgattaataaatatgaattggaacagatctttgcccaaaagacttcatacgaggttacgcatgaagtcaccggcgaccatcctttctacgtgctgtttacttctggtacgaccggctcgccaaaaggagttgagatcagccacgacaatatctgttcatttgccaactggatgctgggcgacagttttgacatcccagcccaccagatctacctgggtcaggtgccattctcgtttgacgtctcgcatatgtactggctgacgggtcttttgtccggcagcacggtgcagaccctgccactagctgttgttcaaaacctgggtcagctgtttaccacgctgcctaagcttgacattacggtctttgtcggtacaccttcatttggcgacatggcgctgctcagtcctcagttcaatcacgaacagatgccgaacctaaagtactttgtcttctgtggcgaagagctgacaacctcaaccgtcaagcggctgttcaagcggttccccgatgcgcgcgtctttaacacctatggcccaaccgaagctgccgtggccgttaccagcatggaaatcacgccggcaatggccaacagtcacgaacggctgccaatcggctacgacaagcctggcgtaactaccacgatctggaaggacgggcagcccgttgatgagtcaaacgtccatggcgagatcatcatcagtggggacagcgtagcgaagggctacatgaacaaccctgaaaaaacggtcaaaaacttctttaaatacaacggcgtccagtcatatcgcactggtgacgaaggctttatcgatcaagacggcatccgccacatcatcggccggatggattttcagatcaagctgcacggtttccgggttgagctggatgaggtccgcaacagtctggaactgagcgaatacatcaagcaggccattgccgtgccgaagtacaacaagaagcatcaggtcagtcatttgatcggctacgtgattgcacagcccaacgactttaaagatgagaaggaactgactcaagccattcgtcaaagtctggctggcaagatcatggattatatgatgccaacccagttcgtctacgttgacagtttcccgaagtccgcaaatggcaagattgcggttaagcagatgatcgcggaggccaatcaataatgagctggcttgaaagtcttcccaactacacggcttatggcacgccatcgtactttatctacctgctgattgccgtcttgccaatgggaatcagcctgtactttggcaagcggctggcttggtatgaggccatcgtcagcttcctgtttatcttctttatgttcgatggctccagtgccccgcagatgctttctctgatcggctacgtagtctatcaaacgatcctggtaatgggatatttccattatcggcaaaaaaagaatgcagcaggcgtcttttacctgatgacgctgctatcgcttttaccgatcatcatcgtcaagttcacaccggcaatggtcggtcataactcgctgctgggctttttgggcatcagctacctaacgtttcgggcggtcggaacgattatcgaaacgcgtgatggcgccgttaaagacctcaactggtggaagttcatccgctttttgctgtttatgccaaccattacttccggaccgattgatcgctaccggcgtttttcaaaagattatcgcaaagtccccagtcgtgaaaaataccttgaaatggtcggtaaggccgttaaatatcttttcatcggctttttatacaagttcgtgctggcctacctgtttggtcaggtttggctgccattcgttgagcatcaggcattaatgtacgcaccgcatttaagctggtgggtcgttgccgtggcctacgtctatgctggcgatctttacttcgactttgccggctactcgctgtttgccgtggccatcagttatttgatgggtgtcgagacgccaatgaacttcaacaagccgttcgtttccaaaaacatcaaggaattctggaatcgctggcacatgacgctctcgttctggttccgtgactacatcttcatgcggttcgtctttttggccagcaagaagcattggtttaaaaaccgcaacgtcctgtcatcggttgcctacatgatcaatatgctggtcatgggcttttggcacggggttacctggtactacattctctatggtttcctgcatgggagcgcattggtcatcaatgactggtggctgcgttacaagcgcaagcacctgcatatcaagaccaatgcttttaccaagggcgtggccatgtttattacgtttaactttgtcgtcttttcattcttgatcttctgcggctttttgaacacgctgtggtttgtcaaacattaatctgagtacttatttttggaggttatatcatgcaagaacaaattcaacaacttttagctgaagcaaccggccgtgacgccagcgattttgctgacacgactgaagatctgtttgccgatggtctgctggactcaatggcaaccgttcaattgctgctggcactgcaagatgagttcgacattcaagttcccgtttcggaatttgaccgcagtcaatggaatactgtcgacaaaatcgttgatcgggtaaaggaactggaaaatgaataaccgtcgcaaactgtggtcgatctttggcccggtgatcgtagcctgcctattggtactgggcttttttgccttgccatggagcagctcgcattcccaggcaaccctgcagaaagccgctgattcgcttagtccgcgcgtttttaaaaacagctcgattaaagtggcggccatgcaggataaaaagaaaaactacattccattcttcggctccagtgagttgaatcgaatggaccgctatcatcccgcggtgatggctgctcgctaccacaactacacgccattcttgttcggttcccgtggtacgcagtctttgccgcagctgtttaacatgacgatgatggcccctgaaatgaagaatggcaaagccgtctatatcatttcgccacaatggttcgtcaaagaaggcgtcatgccatcagcttttaaatactacaacggtacttacgctaatctaacctggctgaagcaggccaacccagattcgccatacgatcgctacacggctaagcgactggtcaagcttttaggtacggaaggctcagttgccaactatgccaaaaaaatcgctgacggcaagcacctcagctcatgggatcgtacccgtatcgatatggaatcaacgctgctcaagcatgaggatgagctgttctccggctggttcttaaaagacaactacaacaatcgcatccagccacgcgtcaagaaactgcccaagacttacagctacagtgccctgaccaaagaagccatcagcgacgccaagcattccagcaacaacaaccgctttggcatcttaaatcagttctatgatcggcgcgtcaaaggccatctcaaggacattcctggcagtcaaaaacactacagctaccttaaatcgcccgagtatgccgatctggaagtcgtcttgaatcagcttaaaaagaccaataccaacgtcgtctttatgatcacgccggttaatgccaagtgggaaaagatgactggtctttccatgccgatgtactatcagactgccaataagatcaaatatcagctgcgttcgcaaggtttcaacaatatcgttgattattcacatgatggcggtaagcccggctttatggaagacaccattcacattggctgggccggctgggtcaactttgatcatcgcattgcaccgttcttggagcaaaaacagccgcagcctcactaccatatgaataaagcctttctatcctcagaatggcaaaatcttgatcctacgacggccaacttaaatcaattcaccaaggatcaccttgataaataaccaaaaaaagagttcgcagctagctgcgagctctttttttgcatcttatcagaattttagttttcagaagcacccgtcatcgcatcagcatccgtttcttctggatcatcagctgcttcagatgcacccgtgctggcatccgtttcggcctgttcagcacgttgagcagccgccgacattaccggagcagctggttcgctgggagcagccggttcctcatcggtatcttcagaagcccccgtcgtcgcatccatggctggagcaggttcttcaactggcgccggggcagcgtggccatgcgaggcgctggaggttgcatcagcattccaggcaccattttcagccaggttcaagatgtcatcaactgaacccgtaaattcaatcgtccccaggtagtgaccatcaacatcccgcagcgcatagtagcgaatcaagacacggtgaccgttcatcatcaatgggcgggcaaccacgtctttggtgccgttcttaaagctgtcgataatggccttaaccgcaggaacagcctttggtgggtggcattcactgtaggtttcgccaagctggttgacgttacgaacgtgttcacggttaggcttgtctgagtagtaggcaaagcgatccgtggcatcgatcaagtcaatttcaaatggaatcgtattgaagatggcttggacttctcgcagcgacaggcggccggtcgggaagctgacataggcatcttcaatcataggacgttttacagacatgagttgttcacctcgagaagcatttttgaaaagttccgcatattcaacaaaattggtaaagcatttttccagattatcaacgcaggcctggtcagtcagacggccatccttgctaaagaccttggcagcattgccgatcagcacctcgttgccagacagcaggttggcattgcagtcaggactcaaaagcatcttgcgcatctgctgctgagctcgtgcggaagcctggcgaccataggatacccccacaatcattgctggcttgccatgcaggaccttggattgatatgatagccattcaacagcactcttcattgcggctggaacggcatggtcatattcgggagtagaaaagattaccccatcagcagcgttgatctgctgcttaagtttccagaccggcgtcgtttcctcaaaaggcacgtccttgctaaaagccggcagatccttgatttcggcaatctcaatctctgccatgcgccagaagtgcttcttcataaactgcaaaagaacgcggttgtaggaaaagtcggcgttcgtaccgacgattgcaacaaatttcattacttggcagcctccttttccgctttggccaatgctgcttcttccaacttaacttcttgatcattggcgatcgcaaagcattcaaagtcgcgcagacacttgtctaagaacttgatcgtaccaggatcggtaatatcgccgttttcatcaaacagattctgggcaaaactcataaagaagtcttctttttgaaagacgcgcgcgttgacccccggcgagatcataacgtcacgcaggtcaacctgagcccgtgaagagccttgcgcgtcagtagaagccccaaccagcagcaccggcttgttggtaaatggatgcagctgataggaaagccattcaatgatgctctttaaagaagaaggtactgagtgatcagtttcaggacaggcaatcactacggcatcggcagcatcgatcgcgtctgacatggcctggatggcagccggcgtttctttggcgctttcgttgaacagtggaatcttgcgcacgtcaacgaccgtcatatcatgttcataggctttgctgatgtattcaagcagcatgcgattgtacgaatggttggcattagagccaggaatcccaacaatcttcaaattcattcactccttattaatgataatactctccatacttggcattattgcgctagcctattttaatataaattttggcgaaattgtatagcttcgcacaaattttgtgaaaagaatttcaaattgtgaaatgaataaaattgtaatcaaattaaaagctgttatctaaacgttgagataacagcttagtttgttcaataatgatttaattactttttaccaactgtccggtaaacctaattacgaaacatgttgaccttttgatcagttttcttcaccagctgctgccagactgtgctctcgataccagtgcaccatcaagcccagtgccaatccaaccagtgccggaaccagccatgacaggccataggcagccagtggcaaggaagcccgccagctagccaccagcttgccaaacgcgctggcactgactacgcttgggaaggaaactaccatatcccctaatgccggcacgacggtaagcaagacaacaaagaagtaaaccgcaccatcccgcttaaacaacggcgaggcaaccgacagcaggatcaggaccatggccaatggatacagaaacatcagcattggcgttgaccaggcaatgatctgttccaagccaaaattggcaaccaaaaatgaggccaaagtcgtcaagaacagccaggcatgatagctcaactgtgggaaatgcttgtgaaagtcctgcgcaaaggctgccaccagaccaaccgccgtcgttaagcaggtgaccgtgattaaaacagctaagacggcttgtcccagtcggccagcataggcattaaccagctgcgtaaaggccaccccgccatcagctgaaaccttgaaccggcctagagtcatcgcaccaaccacgatcagcagcacatagatcaaagcaacggcactcattgccaggacgcctgatttggcaaccactttggcaacgtcgctatcccgcttttggcccagctgacgaaccgctgtcacgaccgtaaccccaaaagccagaccagccaaggcatccatcgtattgtagccctgcaaaaagccattgacgaacgcgccatgcacataagctgtcgttgcctgcgtttggaatggattggcaaacggattaacgaacgcaacggcaaaaacgacaaacaacaggactaaaaagactggattcaaaaccttaccgacgttggtcaagatgtcattttcacgataggcaaatgcaaaggccaaagcaaagaagaccaatgagaacaagaacagggccagcgtctgatcagccttgggaacaaacggtgcgaccccaaccgtgtaggaaaccgtagccgtccgtggcgtcccaaacagcggtccgatcgtaaagtgaatcaagaccataaagaccaaagcaaaaccaactcctaatggccgaccgatgtcaaaaaccccttcagcccgcgttaccgcaacggccaggaccgacagcagcggcaaggcgaccccggttactaaaaagccgactgccgcaccgacccagtgactgccggccagctgacccagatgcaagggaaagatcaggttgccggccccaaagaagagaccaaacagcaatgatgccacgaccagatactgcttggccgttagttttttcgatgtgagttgttccatttttttgcctccgaaatgaattaaaattagaaatcactcatgtcgaatactggctgcgccgaaaataaaaagtcccttgaccgaaaattcggccaagggacgcaatcgcgtggtaccaccctagttcaccatgccatcgctgacacagtcttttacgtacggcccccatttaagctggagcgatacgcgtgcacggtaatgggtgcgaccatccatccttacttggtttaaggatgaaaactagaaagtgattttcgcctaagactttaaccgatcccctcacacctagcaggactcgctgacggtggccaaagactactcttctttcttcattgcattcgatatgattaacttttaacaatatactaatgcaaggttaatttttagtcaatgcatttttaataaaaatcacaaataatttttggccattctaccaatgtgctaaaataagaccactggaacgcaacagaacggagaaaaacaatggaaaaaaatcacacccgcttcaatcatcgtcggccacaaaaaagcccacgcccacagccccaagtcgaagtcaaccttggcgatcgcttcccgctgaccattcgcaaactggggatcgaaggccagggaatcggctactttaaacacaaggtctgctttgtccctggtgccctgccagatgaagtcgtagtagctgaggttactgccatccatccccgttacctggaagccaagattcataagctgcgcaaacccagccgcttccgagttgagccgcgcgacagctatgccgatcaagcaggcggttttgaatttgaatgcctggcctacccagagcagttaaagttcaaacggcaggtcgtcttagacagtctggccaaatttaagccgcggggatggcaaaactatgacgtacgcccaacaattgccgtcccagaacaatacggctaccgcaacaaggcccaattccagatccgcgaacaagatggccatttggttgccggcttgtaccgtgccaacagtcatgacgtggttgacatgccaacatgtgccgttcagatgccagggacgatgaaagccatgcgcgcaatcgtcaagatgttggatgaactaaagattcccgcctacgatgagaccagcaacagcgggatcattaaaacgatcgcgattcgggagtcattggcaaccggcgagttgcaggtgaccctgattaccaatactgccaagctgattcataagggaccgcttttggccatgatcgctgaacagctgcctgaggttaaatcggtcgagcaaaacgtcaaccctggcgatacgccgctggtttggggtgagcaaacgattcatctggccggtcaggaatacattaccgaatcattgatgggacttgattttcatctcagtgcccgttcgtttctgcagctgaacccggctcagaccgaaacgctctacgaacaggcagccaaagccatggagcttgggcccgatgacgtcttggtggatgcctacgcggggattgggacaattggactttccctggctagccgcgtcaaaagcgtacgcgggatggaggtcattccagaagccgtggccgatgccaacagcaatgccaagcttaacgacatccaaaacgccagctatgaagtcggcaccgcagaagaagtcatgccgcgttggcaggctgaaggattccgattcaatgctctagtcgtcgatccgccgcgtactggtctggatgaagccttgatcgaacagattcttaaagctaagcccgccaagttcgcctacgtttcctgcaacatgtcgaccatggcaaaaaacctggcacgactttccagcgtctatcgcgtcgactggattcagcctgtcgatatgatgccgcagacgccgcgctgtgaagccgtcgtcaagctcagtcgccgctaaaatctgattctaaataaaaactgcagccgcctgccgactgcagtttttttgatgagtcagcttcagccttgatagcactgaacggctgggattgtgaagccaattaggccgcaaccagcttggcagccgcgttcgcacttgagccgttatgctgccgaccagcttaaccgttgacgagccaatactggtcagcgactgattactaatgacgcagtccacggtagcagccattgaacgaaaatcgtttaaagtcagctcctaactcactacttacttgactgcctgccactgtttccaggttaccgcggcactgatattgtccagatcgtcataggcgtgatcgctcagttgctggagcttagccggactgcttaaaagctcaacgacggccttagccatgctggcagaatgattcagcgcgatcagtcggccattttcataattgacgatcatctcgtctggaccatacgaaaagtcgtagctgacgactggaacgccatgccccagcgcctcccccattgccaaaggctgcgcatcgatgcgactggtattgagcagcagctgggcttgatcaaaagcagcatccaacggatattgataatcggcaaactcaactgcatcatcaatcttaaggtctttggccagttgcttgaagttagccgtatcattaggtgcaccatagccataaagcgttaatttcgcgtcaggtacggcagctttgattttggcaaatacctgcagcaattgatcagtctgcttgtcatagcccaggcggccgacactgatcagctggttaggtagccggtcagtcattttgacgcgcttggccgcctttttaaccggcgtgccgttaatcgtcaaaacacgtgccgatttgcccaagcgctgacgcaaaacacgtgcctgcgcctgcgtcatcacgataataccatcccagcgttgcagattttccgtcagggcgttttgcaaaaggctgttcaaaggcgccttcagtggatcctgaccatcattgacgtgactcattggcagccacagatagcgatggaccttggaatgcatgtgcagaatcggatcaatggcaacagccggccgatccgcgataaagacgttgttctcgccatgagcacgattcaattcatccaaaaagaaggcaaacatttcattttcactggcaaaccaatgatcctgaccatgccagttttttaaaatattaagcgaattgattggcgtgttctggaccgatttgacaaagtagcgttccagatacatctgaccatcggggcgatagtagcgggcattgaactcatgaccatcctgaccaaagaattcatcaacagccttaaagccccgaatgtcataagtattgcgcaaagtcaggctgccggtctgatcgtaccagtcgatgtgatgaatctgaccgatcgtcccaccggcaaaatagatcgttgctgccaagcgtcccccgtctctaacctcgcgaaagttgttgcctgtgccgatctgatagtcgacggccagtttcaggtcctcggtatgcagcggctggccctgatagtcagtcgtctgggcaaaaaaatcatatagattggtcagttggtcattggtgacgccaaaacgctgcatcgtccggtgaagcactggatcaaaatcgcgcgtaaccagctgggccggcgcctgatgatccttaaacagctgcagacgctttaattcggcatgttcgacactggagtttttccccagcagatactgattaacaaagaaatccatcagtcagcgacctcctttggcatatcatcaagcagctcgttccatagtttcatgacattggctgccgagtagcgggcactgtcttgataggcatgcgcgctaaactcagccagtcgcttctggtcggtcagcaggctgatgattgcctgtgccagcccgtcaatgtcgccgtttttagtcagcagcccatcctgttgatcaatcacgacatcggccggaccgtacttgatgtcattggccacaattggcagcccgtgcgactgcgcctccaccaaagacagcggcagaccttccgcacggctgggtaaaatcaatagctgcgcccgttcatagactgcattgacatcggtcgtatagccgcaaaaggtgactgagttctcaatctgctcggcactgacctgagctttgagcttctggtcgaaattatcattggcatatccccaaagctccagctgggcatcaggaacctgctgcagaatcttaggccacgcctgcaatagatgatcctgctgtttttctggtgagagccgcgctaccatcacgaccagatcgcgctgtcgcttagcaaaatcaacatgcggcgctgccaagacctcatcagccacgattggccctggaatccgatagatcttgacgccctgcttgccaaaacgatcctggacgtcagcctgctgctgcggcgttagagcaataatgccatcccagtccttcagatgatccaatccccattgatagttgtagtttagcgttgaatgcagcatgtcgctgggattgttgacatgatcattatgcagctgcatgacgcggaaaacgcgatgatgcatgtttaagactgcccagcccaattcatagacgcgatccacaaccaaccccagcggaccgtcactattcaaggcaggatccacggccaactgatcatagaaaaagcgcgtcaattcgtcaaaattggcaaactgccagtcctgaccatgccagttaaacaaatgatagctggttgctttttgctggcgccgatccttaaagttcaccttctgcagcgccaactggccatcggggcgcagatagttttccacggcaatctgaccattccagtcatacaactgttcaaccgaagcaaatccccgattgtcataccagactactttcaacagcttgccgaaatggtcaaaatactgcagattgatgatgctgcgatcacgatcattgcgacggcgaacgtacatgacccgcgtcttgccgtcatagtagttgtagctgatgccatctgccttgcgtttccactttggattcagatgcagatcctgaagcttgacgatccgatgcggcaccaggcaggcattttgaaaatagtcgaatagattgataaaatcctgatccttaatcccagctgcttccacaaccagatgcagctcgttggaatactgccgcgtcacgatcttggctggctgattgaattttttaaacagattgagtcgcttgatttgggcgtgctcaattcctgattgattgcgctgaaggttatcatttaaaaataacagcattttttcacccttttctttgctcgcacttactgcttaagtttaacatttgaatatgaagaaagcatgattgaactgttgacattattaggtccgcattctcagttatgttatgattaatggataaacgtacaaagggaggcctggacggatgcagaatccatttggcaataataatcaaaataatcaggatttttttaataatctgccaataccgccaaactacgccaagatcaaaaacgatgagggtgaaatgcgcattgccaaggtaggtttttcttggactgtctttttgttcggcccgtttccagctttattccgcaatgactggtacaacttctttttaatgatcgtcttggatctggactatgttttggtcggtctgtttttcaaatggaactggatgcttgatttcccatggccaacactgttcttctgcttcttttacaacatgatgtactttagacatctgttcaccaaaggatactatccagccgatgagcgttcaaaagagcttttgacccaatccggctattggaaagaaaaatatcggcaaaaataaaaaacgatagcgaatctggctatcgttttttatttttaatgacgagctgaccaagcagcgggatccttgcgccattcatgcagatccttcatttgattgcggtcgattaaatcagtcttttcagcagtctcaatcaaagtcgtgtagttggttaccgagtagtatggaatgccaaactgctggaagttgtcatcggcggccggcagttcataggtgaagacggaaaccacgcctaccacatcggcgccttctttttcaacggctttaacggcctttaagacgctgccgccagtcgagatcagatcatcaatcacaaccacgcgctgaccctcataaagaacgccttccgtctgcttgccctgaccatgatccttaggcttggaacgcacgtagatcatcggcaggcccatttcttcggcaacccaggccgcgtggggaatcccagccgtagcggtcccggcaattacatcgacgtcttgaaaatgttcgttgatcagctggaccatgccttcatagatattgcggcgaacagctggataagagatcgtcagccgattgtcagtatagattggcgagtgcagtccgctggcccaggtaaatggcttgtcggggcttaaggtgattgcttgaatgtctaaaagatctttagcaacgatttcggcttgtgttgacatatttagttttccccttccataaatgcttgacgaatcgtctggtaggcactgactggatcttccgccagcgtaatcggccggccaaccacgatcccattgctgcccagatcgcgagcctgctgtggcgtaacgacccgtttttgatcatcatgaacctgcagattaggccgaatccctggggtaacgcacagaaaatcgggaccggtaacttcgcgaatcgccttgacttcttgagctgagcagacgaccccgtccagaccgtttttttccgaaagctgcgcgtagttctgtacggcttcgatcaagctgaagtcaacgtgctgttcctcatgcagaatccgatcatcaatcgaagtcagttccgtaatggccagcaatttaggcattggacagccggccgctttggcaccttctgccagccccgccttggctgcctgcagcatctcactgccgccagccgcgtgcgttgtcacaaaggatacgcccatcttgccaattgccgtcatcgcccgcttaacggtgttgggaatgtcgtagagctttaaatccaagaagatcttaaagccgcgctgcttggcttctctaacaatgcccggaccaaacgcgtagtacagctccatcccaattttgacgatcggcgtgtgatccgtgtcgttagcgagttcatcaaaaagcttcaatgcggcctgcttcgtgtcaacgtcaatggccaccattggttcaaatcgttccattaaaatcgtacctcattcagatctgtcaatttctcaataccataataatccatcaccgtcggcaactggtcaataatcttaggacaggccaatggatcatggaagctggccgcgccaacctcaaccgcattggcaccagccatcataaattccaaaacgtcttctggagtctcgaccccgccaacgccaataatcggaatgttggagaattggcgaacctggtgaatcatgcgcagtgcaattggctttaaggctgccccggaaagcccgcccgtgacgttggccagttttggcttgcgcgtcttcagatcaattgccatgccggttaaagtgttgatcatcgtcaagccggccgcgccaccattgattgcggctttagccagcggaacgatgtcggtaatgtttggcgtcagcttaacgtagaccggtacgttggaaaccgctacgcagcgccgcgtcaagcgttccaacaattccggatcggttcccattgccagaccgccatgcttgacgttggggcaggagacattgagttccatggcactgacgtaaggcgaggtccccagcttggccgctactgcttcatattcttcctcgctaaaaccggctgcactggcgatcactggcagttcaggatagttttgcgccaaccatggcagcttttcttggaccacgttgtcaaccccggcattgttcagaccataggcattcaaccagccggcagacgtttcacaggcccgtggcgcaggattgcctttgcgtggctgactggtggttgacttgatgaccaaggagcctaatttgtttaaatcatagttgcgggcaatctcttgaccataccagcaggttccgctggcaggaattaccggattcttcaaatgcaggcctggaagtgaaactgataaacgactcataattttcccctttcgaaaaaagcatcagttgctcacttcaggagagcactgatgctttttaaggtcggttaaaaacctcaccgcaccgtttgaccctctctggagttcattaaatggcaacgctaagttagactattcaattgagatatcttcatgaccatcgtattcttcgaccgccacgtgtaccgtttcattagttgacgttggaatgttcttgccgacaaaatcaggtcgaatcggcagctcgcggtgaccacgatcaaccaagaccgccagcgagatgcgcttaggccggcccatatccatcaaggcgtctaaagcagctcgtaccgtccgccccgtgaataaaacgtcgtcgactaagataacgtgcttatcgttgatgtcgacgccgaggtcagtagtcttgacttcaggctcaaccttatgatctggacgatgacggtcatcacgatacagcgtaatatcaagcgttcctactggtaccttgaccccttccaactgttccatgcgcttggcaagacgttgggccaggtagacaccgcgcgttttgattccaacaaagaccaggttttcgacacccttgttttgttcgataatttcgtaggtaattcgggtcagtgcccgttgcatgcttgaaccgtcaacgatttcatgagccatgaagttcactcctttattttatttgctgaaagaaaaaacgtctcttcgcaccaaaacgaggagacgcaacatttatccgttccttttcagcctcacgggaccaagttaaaggtgctcatactttatctgttagtgtaactgcctcgattagcagtgtcaaccgccagaaccaattctaatcaaaccataataaaagatccaaccatcagcgacggctggacctgattgatagatttgccaaggtctagcccagccaagggtcatgcagaataatcgtctgttcacggtcagggccgactgaaatcgtagccaatggcgtttgtgacagttcacagatccgcttcaagtagttcttggcgttttctggcaactcatcatagctcttgatctgcgtgatgtcgccttcccagcccggcagctcttcataaaccggttcgcagcgatccagttcagccaagctggcagggtagtagtcgatttcttgaccatctaaacggtaggccttgcagatcttgaccgtctttaagccagacaagacgtcaagcaggttcagactcaggtaggtcatgccatcaacacgacgggcatgacgcatggcaaccgagtcaaaccagccaacccgccgtggacgaccggttacgaccccgtattcatgaccaacttcgcgaatgtgggcgccaatctcatcgtgcaactcggttgggaaaggaccagccccaacccgcgtgcagtaggctttgcagatgccaacgaccgtatcgatctggttaggtccaacgcccgccccagttggtgcaccggcagctccagaattagaagaggtaacgtatgggtaggtaccatcgtcgatatccagcatcgtaccttgcgcaccttcaaacagtacttttttgccggcatccaattcatcgttaaccaacagcgaagtgtcggtaacgtatttcttcagttcttgaccgtactcgtaatattcattaaagatgtcatcgaattcgagcggttcaacatgatagatcttcgtaaacagctcgtttttagcagccaggttagcccgcagcttttcagcaaagacatcgcgttccagcagatcgcacatccgaatcccggtccgcgcaaccttgtccatgtaggttgggccaatccccttttgcgtcgtgccaaccttcttgtcacccttggcttcttcttggcacttgtcaagcagcaggtggtaaggcagggtaacgtgggcgcggttagagattctaagaccatccgtgctgatgccattatcgtttaagtaatggatttcttcgagcagcgccttaggatttaccacaaccccattaccgatcacggaaagcttcttagcgccgaaaatccctgatggaatcaagcgcagagcaaatttcttgccgtcaaagctaatggaatggccggcattgttgcccccctgcgaacgaacgacgacatcggcttcctgactgagatagtcggtcattttgcccttgccttcgtcgccccattgactgccgacgattactactgatgccattaattagtcacctcatccaaaatttctttatgagcacgtacttacttaatgatattatacgatttaccaaaaatttgcaagatattaaccgaacattttcaaaaagaccgattaaaaatgtgcgttttatacttgacgccatgaatttgtttgtgcataatagctaaggtttaacgtattacatttttaccaaaaaggagccttgactcatggaaacttttgattacgatgacattcaactggtgcctaacaagtgcatcatcaagagtcgcagcgaagccgataccagcgttaagtttggtcccaagactttcaagattcccgttgttcctgccaacatggaaagcgtaattgacgaggatctggcaatctggctggcccaaaacgactactactatgtaatgcatcgtttccagcccgaagaccgtgccgactttgttaagcgcatgcacgatcgcggcttgtttgcctccatttcagttggaatcaaagatagtgaatacgattttatcgatcaattaaaatccgaacatttagtcccggaatacattacgattgatgttgctcacggacactcagattatgtaattaaaatgattcgctatattaagcaacaattacctgaatcattcttaactgccggcaacgttgccactccggaagccgttcgtgaactggaaaatgccggtgccgatgctaccaaagtcggcgtcggccctggtaaagcctgcatcactaagctcaagaccggctttggcactggtggctggcagctggccgcactgcgtctgtgcagcaaggccgccagcaagccgctgattgccgatggtgggattcggcataacggcgacattgccaaatcagtccgcttcggtgcctcaatggttatgatcggctcgctcttggccggtcatcaagaatcacctggtcatctgatcaccatcgacggcaagcgctacaagcagtactggggatccgcttccgaagtgcaaaaaggcgcctaccgcaatgttgaaggcaagcagatgctggtaccattccgtggttcgattaaagacacgctgctggaaatgcaagaagatctgcagtcatccatctcatacgctgggggccgcgacctcaagtcaattaccaaagttgactatgtggtcgttaaaaactccatcttaaacggcgactattaatcaataaggatcagtccagacaaggctgatccttttttgctgcaacaatttaaaaaaagcgatgcctagtaggtaaaaatcaatgtatatcgagttagggatccctaacactacctacgatttaacaaagacccccaaaaaaagtcgccccgcgttttgcgagacgactctttttgctattggtattaatgcttgggagacttacgtcagtggatttaaggagttattttgaactagccatcaacgataaccgtgcccagcttgccagccaaggcatccttcaaaccgctcagtgaagtgatgatagcttcacggtctgggtgatccttaacgaatgacatgcaggcttcgatcttaggcagcatactgccggcagcgaattccttttcgtcgatgtacttctcggcttcggaaatcgttaatttcttcagcgtcttttgatctggttggttgtagtgaacatagacatagtcaaccgccgtcagaatgatcagcttgtcggcatcgatgttgtcggccagcagtgcactcgtccggtccttgtcgataacggctggcacgccttgcagaccatcatcagtaaagataacgggaaccccgcccccgccacctgcgattaccaggtcgccggcttcaatcagcttgttgatactgtcgatttccaagatccgctttggcagtggtgatggaacgacttgacgatagccacggccagcatcttcaacaaacgtgtagcctttttccttttcgattgcttcggcttgttccttagtgtagaaatcaccaactggcttcgttggattttcaaaagcctggtcctttgggtcaacggcaacttgcgtaaccatcgtaaccacgttcttgttcatccagcgacggtgcagttcgttttgcagactctgctgcaggtggtagccgatgtagccttggctcatcgcaccacattctgggaatgggaaggcaggtgccttgccattttcagcggcatagttcatccccaggttgatcgccccaacctgtggaccattcccatgactgataactacttgattgcctgaagataccaggctgatcaaagaccaagccgtgtttttaaccaattcaagctgttcttcaggtgtcttgcctaaagcattgccccctaatgcaactactactttagccatatgcagttcccccttggtaatagaatcaattaatgatgtggatgtttaattattcaccaagagtggcaaccataacggctttgatggtgtgcatccggttttcagcttcgcggaagacaacggagtgcttgctttcaaagacttcgtcagtaacttccatttccttaaggccaaacttcttttcgatttcacgaccaacttcagtgtccaggttgtggaatgcaggcagacagtgttcgaagataacgttagggttttcagtagccttcataacgtccatcgttacttggtaaggcttcagcagcttgatccgcttttcccacatgtcgtcggattcacccatggatacccaaacgtcagcgtagataacgtccatgcccttgacaccttctttgatgtcgttggttacgacgatcttggcaccagtttccttggcaatttcgttagccttgtccagcgtttccttagttggttcaagttccttaggcgttacaacgtggtattccatacccataacagcggcacccagcatcagagcgttggatacgttgtcttgaccgtcaccaacaaaggcaaacttgatgtcttggtagttcttcttcagaacttccttagcagtcaggaagtcagccagaacttgggttgggtggtcttcatcagtcagaccgttccaaactggcacaccagagtacttagccagaatttcaacgttgcgttgggagaagccacggtattcaataccatcgaacatcccacccaatacgcgagccgtgtccttaacggattccttgtggccaatgtgagaaccagatgggccaaggtaagttacgtgagcaccttcgtctttggcaccaacttcaaatgaacaacgagtacgagtagaactcttttcaaaaatcagagcaatgttcttgccttccagacgcttgccttcattgcccgtgtacttagccttcttcaaatcttcggccaggttcagcatgtattccatttcacgggtgttaaagtcagccagggttaagaaactgcggttacgtaagttaaatgacatttttaagttcctccttcttaattacagtttctatcatagaaaccgttttcagtaatcttcacattgattcaaaatacttcaaaagaaaaatttattttttaggttatcttaatcttgatatatcaaggaatgtaaacgctatcttagaaatatgcattaaatcggtgcataaaacatcaccgctcaaaaagggatgttgctggttaaataaaaatgttaaaattcaagaagcatcaacaagtttccaaaaacttcaatttgagaacgtttatgctttaggaggtatttttatgaatttttacattgctgacgatgatccggataccgttgatctgcttagcgatttgattgaaaacgactttaacaattcaatcgttggggtcgccgataatcctcagcaggcctatgatgaccttttaaggctgcgcgtcgacatcatgctggtcgactatggcatgccagtaatgtcaggaattcagctgattgaaaagcttaaagccgccaacagtcagccgcattttatcatgatgtcttcggtaagcgatgctaagacgcggacggctgcctaccaggctggcattgacttcttcttagaaaagccaatcaacctggccgaaaccaagcatattattcgactcattgccggctatacgctgatgaccgataagctcaaccgcatctttgagctggttggcagcagtgccccctatcatctgccacagtctcagcagcggcaacaggttgaccgcatcaaatcgattctgcgctttttgggcatcacggcagaaaccggttgccaagacatcattcgcattatttcattaatggtggatcaaaaactgggcttcagcgacattgattttgccagcgtgctgcattttgacgcacacaccaaaaaaatcgtctttcaaagaattcgccgggctttaaaagtcggcctcaacaatcttgccaatatgtttttggactatccggaaaacgagatcttaatggaatatgccaacaaccttttcggctacaaaaacgtgcataatgaagtactcaagcttaaaggcgttcaaaacaatggcggtcagatctcgctgcagcacttttttgacggtctgctgcaggaaagcatcattgaaaaatagccaaaatgggactcgacagctgccgagccccattttttagatctcttttaattcacgcgtagccaccaaatacagccaccggtgctcaaccttttgccgttcgacattctgcagtgcgccggcgtacaagttcagctgcccgctgtaacgatcaacgatacgctgctcagaacgttccttaagcgctgtcgttgattgatcaacatgatcggtcttatagtcaaatagttccaagccatcatcaccgacaaaatagccatcaataatcccgtgaatcaatacgggagcatcctctttttcatctgccagattcttaaagagctgggcggcattaatcagcatggaaaaaggagcctcacgccgcagactagccgcgtgcgccaaaatccgccgaccaagctcagtttgataaaaggccacgatgccgtcaatatcaatagcatcagccagttcatccgtgcttagcagctgatccattcttagttgagcgatcgtttggctgaccagtttggcatctacctgaccactgctcagatcaagtttttgaaagaccaggtgcgttgccgttccgatttcagttgctgagagctgatgtttttgagtcgtcataaacttaggctgggcaaaatcatcgctacgataccagccgcttgtcttgacctgctgctgatcaaacgtcagtcggcccatttcacgatcatcagggtcctggacggcaaacagctgcttgatgtcgctgaccgcttgataggccgtcgtcaacactgcttcaggatgcgggtattccatttccacgacctgcttaaaggcctgctgctggttaggcgtcagctgggttgccggcgcggtcgtctccttagcctgttcgccacgctgcgccgccagatcatcaagctgtttttgaacctgcgtctggttatagcgctgggcaaaaaaatcacctgcgctggtctgccaggcggcttcatcatcgttggcttccatccccagatcagtcaggtcaaaatcagctgcccgcaccattcccatgccgatccaatccaaaaacgaatgggcattgagccgagcctgggaaccaatgatggcagtactgctctgcagggctttttgccaagtcttggcggtctgcttcaatcctgagcggccagtgccttctttgttttcattgactgaaccggtaatgatcaaacgctgctgagctcgcgtcaaggcaacgtacaagacccgcagatcctctgctcggctgctggctctttgggcttcaataatcaggttgcgctgcggcaggtcatagagaatctgcggcaatgcatcaggcgcctgatccgcggcccggccaagatacttgattcccaaacccgcgttggcatcaataatcgccttgccgttttcatccttaaagccatgcgccgtgtcgatcaaaaagaccacgggaaattccagccccttggcaccatggatcgtcatgacgttcacggtatcgctggcaagctgcgtgggagcctcgccaagatcctgattgcgtttttgcatgcgttcgacaaaccgaatgaattgataaagtcctttaaagctgctttcttcatagccatgcgctcgttcatacaaggcatgcagattggcctgccgctgctgtccccctggcatgccggccacatagtccagatagccagtttcttgatagatcgtccaaatcaattcaaccaatgaacgtcgctgggcaatgttatgaaactcatgcagctgatctaaaaagcgggccgtcttttgatgcagcgcggccagatcaatgccatatgggtgatcatcaagcagctttaagtcatggtaggtcgtcacgaaacgctccaatgcctggaaatactgatcatgccggtcattgatgcgcagataggccatttccggttctgtcagcccaacgattggcgaacgcagaacggcaaccagtggaatgtcttggtatggattgtcgataatcttcaacaatgaaacgatcgtccgtacctcggtcgacttaaagtagttttccacgccatgaacggtcaatggaatattcaatgaggcaaactcgttgaccagcgtgttgttgattgacttggcccgttccaaaagcacgatatcgcctggcttgatgtcacgatgaccatcgggagcgtcgggatcaaaaatctgttcatgattgtccagcatttggcgaatccgcatgccgaccatccgcagctcgcctgattgacgatcagcctcatgactggcattggcgtcgttgtcctcagcattggcatcatagagcatcacctcaactggcttgacctgctctttaggataccattttgcggcaaatttcaaatgagcagcctcatcatagtccatctcaccaacttgatgatccatcagctgactgaacagcaggttggtaaaatcggttacgttaggcatggagcggaagttttcggccagattgatcagctcgcctggcgaatccggctgcagctgatcctcgctgacaaacgtttcatatttatgcagaaacatcgtcgggtcagcctgccggaaccgatagatcgactgcttgacgtcgccaaccataaacagccggttgacgcttggatcatggagctgctggaggatcttttcctgcagcggattggtgtcttgatactcatcaatcataatttcgcgatagtgccgctgcagattctttaaggtctgcttaccggcattcgtatcaaccgtcagaatctggtaggcatagtgctccaagtcggaaaaatcaagcaggtgccgctgcagcttgatctgctgatagttttggcgatactgccaggctacctgaaccaactcatcaacgactttcttggcccctgccgacagcttgatcagcagcttggcatccataaagtagtgatcatgcaggctttgaatctgttcgcgcagctcgttgcgtgagtccttgattgcatcatatgccgccaatgcagccgtttcatcttttttgggccggcctttgatcgttggaaacatttttttggtcagttgagcgctgattgcgtcccaagtaccggtttcggtcagcttcagcagctgctctacccgttcggcatcgtcagccagcatctgcgaagtcgtcgtcaagtctgctgcctgagcctgatgagtcagcgtgacaaaatcagcatggatctgctttagttcacgctgcaggaccggcagcagctgtttttggtaaaagtttgatttggtcagctcttcatcattcagctcatataatttaggcagctgccaaagccaggcatgcgggtcggcctgcgcattggcaactcgatccagttccatcacgatatcgctcaatgcgtcatcactgcggtcattgacgaaattcatcaccagccgctcaaatggtcgctggctgggatcttcaatcagcgcgtctctggcatacagttcttctctaagatcatcccagacttgatcttgcagcagcgtcgtctcggtttcatcagtcagcaggcgaaactgtgggtccagatcaatcaagtagtagtagcgcttgatcaactgttggcaaaaggcatgaatcgtactgatgtgggcaatcgccagccggttgatctgatcgcgcagatgacggttgttggcctctttttccagacggcgccgaatccgctcgcgcatgttgtcggcggcttcgttggtaaaagtaaccatcagcagctgatcgatattgagattcggatcttctttcagcattttgataacgcggtcaaccaataccgttgtcttccccgcgccagccgatgccgacaccaaaatatcatgggttctggcatcaatagctcgctgctgctgtggcgtaaacctggtatcactcatgtttttccccctgtgattcttgtttcagcttttcctgcacgtcacgctcggttagcaaaacgtcgcgatagttcttttgatccagcattgggtcgaagcggtagatgtcttgatagtcgctgtattgcaggccgtcgcgcttatcaagccgatatggccgcaaagacgtgtcccctgcaaaaatctgcgtcgccgcgttgacgatgcgttcttgattacgctgcaaaagagcagccagctgtgactcatcaaccagtgccataccgctgttggccttgatattgccgttcttaaaggcacgcaggctcagaatctgcggtttgaaattgtcaaagccctgatccagatcattcagcaattgccgatcgttcagcaggacccctcgatagcgatgactctttaattcttcagatgccagactgccgctaagatcctcccatttaaagacaggattctgcaggtgcaggtacaaagccccggcaatcttggccgactgctgattcagcttgagctggtggctgaggctgtttagatatgacagcatctgcagtgccaagccgtcataggcctcgaccagattaaactgctgattgccggatttgtagtcaaccaccatcaaataaggctcctgattcagctcaacggaatcaacccggtcgatccggccacgcagatagaccttgtgaccatgatcaagcggatagatcaatggcgcaaagctctgctggcctcgatcgctcaagtccatcacgccgaatttctgttccgttaccacgtttttggcgcgcgtcagcttggactgatcacgcaaaaccttcgtcatcgtttcgaccagacgttccagctgcctcttgcgaaaggccagtcgctgatagttctgcgttaattgaatcaactgtggctgctgatcaaaggcccaggccattgcctgatgtgtgagacgctgcagctgatcatcggtcaattggcggagtgctaagccttgctcactaagcagccgcatgaagcgatccagactgtcatggaaaaacgtcccggatttatcggccgagatttccagctcttctcgtttttgaatgcgcaggccatatttaagaaagtattcatatgggttgcgataatagtcctgcaattgagaaattgaggcatacagcgtgtcatgctgcagcgcgggtgctatttcgcctggccgttcaccattctgcagtgcctgcgttcgtgcatccagtgcttctggatcccattgaccatacagccgttctgccagatccgccggcagcggcgtcgtttcattggtatagtcaagactttgcgccgtccagtcgtaacgcttgaccttttgcgccatcagttcgcttaaaaagtgccaggccgcgcccaatggctgatgatcatccaatgcctgccgcttaacctgcatcagcgtacccaatacggcaaatggcgcactgacaaacggccaggctgcggtcgcggtatcctgtggctgagccataaacggcagatcatccttgagacgtttcttgtcggcatcccagcgatcaaacgccatcgccagatcaatcatataaggcgacatactaagcggtttttcatcattgccgatctgcggtgccgaaatgatcaaacgctggcggccgctcataaagcccaggtagtttaaaaacggctcgttgctcattttttcaacaccgctggctggcagaaactgttcgtcatccagacaggcattcaacagctcacggtccggatcgctaagcagtcccgtagctgacttagcttccggcatgacgtcgctggttgcgcccatcataaagacgaccttgcgcgtagtggtttgcacgatcccggtttccgaaatcacgacttgatccaaggttgatggaatctgcgagtattgcgcggcctcaaaaccagccatcaataaatcggcaaactcatcaattaaaaatggctgctgctgacctaagatctgcacgtactcatccagcagattacaaaagacttgccagacctgctggggttcctgcgcccttgccagatcagaccggctgtcggcaatcgaccattcctccagccgcttgacaacgccggcattgaccaaaaagccgtacagtgccttggctgccgccgcgccgttttctgcctgatcaagctggctgaaaaatttttgcagtccgctgacgtaatccttgacgacgtttaatggtgccgaggcatactgatcgcgtttctgcatatccggatggtgccgcagctcttcagcatctgcgttgggatcaaaatgccaccgctgactgctcagccaatcatcacccgtgcggccatattggagacaccagttttccgtttggtagacggccttttggaaatattttcgggtaacaagccggcccagatcatcatgcattttttgcggaatcagcaatcctgtcttcaaaaggtgcatcacgtcactggttgcaaaatgacgctgatagaccttaaacagcgcctcaatcagatttaccaagggatgattgttcattaaacgctcaaggtcattaaagatcggcacctcatgcgctttaaaaaccgactcaagcatcgtggcataaccgtccagatgacgcgtcaaaatcaagaagtcccgatagcggtatttacccgtgctgaccagctgacgaatcttggctgcgatcagattcagctccgccacgcgtttgggggccgtaaagaactgaatgctttgggaatcttgaagcggcgcgctcggcagctcattcagcatctgagcctgagccgccaagacccgatccagcacctgcagatccgcagtaacacgcggctggtcggccatcacgtctgccagctgcttgacgcccggcgtttgcttagcgaattttgccaagcgatagtactgacgccctgattcataaaacagattatgctcatctggcagctgattttggtatgggcgatccaaaaccagtgcgatcgtggtcgcctgggcatttttgatcagcgcttgtacgatctgcagctcacgagccgtaaactgcgaaaaccggtccagataaaaataggcgtgtgacagatccttttgctgcagatacttcaccaaaagcgcgtcaatctgactgatatcttgatagtcgcccagagccttcacgaattcgccatacaccagaaaaatgactttaagcttagcttgccagacatcatctaagatctgacgattgtctttggcccaggtctgtgcacgtttcataatggccgcatagtcagtcggtgcgatccgagccgtctgcagttcggtcagctgctgtgtcagttccttgataaaacctggccgcttgatttcgccggcaaacatctgcatttcattttgatgctggttgacgatctgagccgtcagcatcgtcagccccgttggcgaaagccgtggtgcctgaaaagccggcgtgtcgcgcagcagataccatgccaaccgactgaacgacagtacctgcaccttcatctgagcatatggctgatccggatcctggtcagcggtatttttcagctgattcagtacttcgatttcggttgcaaacttaatatggttgggaaccaggtagaagaactcgcctttaggatcagcggccagctgctgtttcatttcagccagcagcccagcctgatgatcatacgcggctgtccccaaaataaactttaagctgctcattaaatcgctcctccgttttgattgattgacttaattttatcatgcacccccgccgttaaagaccgcgactgtcaattctgtttttaattataatcaacaaagattgtgattttatgatcaataatacctcgtgttaataatacctttgatatcaacatttcaagccgttttaaaataaaaatcgcaaattttgatttcttggttgtctttgtcagataaaagtggtttaatgtaattgttacttagtgagcaataactaagtcaaggttaggacttccatcccaataaagtcatcttttatctcaaattcaaatctctctactccatacttggtggtttttaatcgcctcaatgataactttttcgatgtgtcagtccagctgacgtcctaacccgttgaaataaaaaacacgatggccaatccctggtcatcgtgttttttattgtaccgcccatccagcattacagaatcggtgaaaacaggcgcgagaacgtttgcttaaagcgcagccatactggttgagccgcgaacatttccggcgtcattaccttacagttacgaatatcattaacaaagatctgttctagttgatccgtgatgtgatggtcatacataaaggcattgatttcaaagttaagcttgaagctgcgaaaatcgaggttggccgatccaactgaagccatcttgccatctacgaccatggttttggcatgcaggaagccattttgataaaaatagatcgttgccccttcgttagccagctgacgagcatagtactgcgttgctcggtagacaaaaggatggtccggcttgcatggaatcatgatgcgaacgtcgacaccagaatgaatggcaatccgcaaagcatccaagacactgtcgtcaggaattagataaggcgtttgaatccagatatgatcctgcgccgcgttgatcagccgcagatagccaagcttgattttttccaatggtgattcaggaccattggaaacgatctgcaaagcggtgttgccctgtttaaccgtaatcggtgggaaatatggccgatagtggatgatcttgtcctggacgtggcgttgggaggcattccagtcacgaataaatcgctgctgcaatgagtagacgccaccgccgatcacacgcagatgcgtatcgcgccaatagccaaacttaggcagtcttcccaagtactggtcacctacgttaaagccgcccacgtagccgattttgccgtcaatggtgacgatttttcggtgatcacgatagttcagccgaaaatcaaacaagttgctgtgcgtcatcaagaaaggttccgccaaaccgccattttgtcgtaaagcatcataaaaactgcgcttaacgcccatcgatccccacgagtcatataaaactcggacctcaacgccttctgctgccttctgttccaacagcgtacgcagctgattgccgatccggtcgttatagatcgtgtaaaactcaatatggatgcttttttgggcattggataaatcatcaaacatcttttgaaacagcctttgcccatccgtatagatatcaacctgattatgccgggtcaaaaatgcgttgtcgatgctttgaaacagcatgatcgtccgtcgatacatacgcatggtctgttttttaggccgcggcatatccaaaaactgctttttctgttcttctaaggccgcgctcagttccagttccgtctgcgattggatccgctccatcttgtcctgcggcagcttgcgtcccaaaaatgcatataggataaagcccagcaccgggattagggttaagaccagcagccatgcccaggtcgcggcaatatcgcgcttttcacgaaacaccgtataaagcgcggcaatttcattgattatgatgattccccaaataatcaacttgataatctgccacgtcgttaaaagcattgttctaccttcctttcgcttgctttttttattctaacgcaccttttgattcgaaccaacaacttaattgcgctataatttttcgaaatatagttaaatctggcagttattgctgaaaggtttaaaaaggaatgaacaaccatgtttgactcaatgccattgggaatcggccagtatcatctgtttcatgaactgttcaaggctaatccgcgactggcgattatcgtcttggcgctgatcgtcgttttggccatctacttgaatcaacgccgataaaaaagagctggctttttggccagctctttttgatttgcttattctgcttttggtgcctgatagtctttattttcactgataaccagcttgccatcctgcatgtcggcgcgcaggtgcttaacgtccagatgatccagatagtagtcggtaacctggtcgcgaatctgctgttcaacgacccgccgtaatggacgagcccccattgcctcatcatagccttggtcgatcaagaagttcttggcttcctcgctgactgcaacgtccatgcccttcttagccagggtcttgttgacgtctttaagcatcaggtcaacgatttgcttaagatcttctttagtcagatggtggaattcgacaatggcgttgaaccggttgagaaattcaggacggaagtatggctccagccgcttggtcaggctttcttccttattgtcggctgccttgatcatagcatcactggagtagccggcgttggaggtggcaataatgatcgtgttcttaaagtcgaccgtattgccttgtccatccgtcagccgaccatcatccagcacctgcaaaagcagcgtaatgacttgtggatcagccttttcaatttcgtcaagcagcacgattgagtaaggatgacgacgaaccttttccgtcagcgtgttgctgttgtcatcgtagccaacgtagccagccgtagtcccaatcagcttggagacggctgtccggtcagcatattcagacatgtccagccgaataatatcgtctttattgccaaacatatccaaagccagctgcttagccagttcagtcttaccgacccccgttggcccaacgaacaggaagctgccgatcggacgattgccttcatcaaagccggcccggttccgccgaattgcgcgggcaacggcatcaacggcttcatcttggccgatgaccttgctcttgaggcgcccaaccaggcctttaagtcgttcaatatcactggcgcccatcttagaaaccggaatgccagtcagccgttctaccgagtcagcgacatcgctaggcgttgccgtaactttctcggaagccgagtgatcagccagttcttttttcagttcggcaatcttgtctttgcattcttgagctttttgatagtcttctttttcagcggctgcggtctgttctttttcaatccgcttgatctcagcttcaatctccttggcatccttgactgggtgcttggctgccaggtgcgcggccgtcatgtcgaccaggtcaatagccttgtctggcagactgcgctgtggaatatattgaaccgagtagtcgatagcagcttttaagatgttgtcaggcaaggttacgttatggtgcttttcatacaggccccgaattccctgtaggatcttaaacgtgtcttccttgcttggcgcgttgacaaccactggattgaaccgccgcgacaaggctgcatccttcatgatcgtgttgcggtattcatcctgcgtcgtagccccgataatcgtaatctcgcctctggacagggcgggcttcaaaatgtcggacatcccttttgagccattgccatcgccagagctgccggcaccaatgatctgatgaatctcatcaaagaacaggatcacgttgccggcttttttgacttcatcgaccagcttttgcatgttttcctcaaagctgcctcggtattgcgtcccggcttccagactggaaatgtcgatactgatgatctgcttgtttttaattgcggctggcacgtcgccgttgacgatagcctgagccaatccttcaacgaccgccgtcttaccaaccccggcatcaccgaccaagactggattgttcttgatccgacggctgaggatttccgcagtttcttgaatttctttgttacggccaatcactggatccaatttgccagccttggcttcttcggttagattgcgccccagcttggccagcatgccgccttttttaggtgccttcgcagttggctgcttgacatctgcttgcggcagcttgccggttcttcgatactgagcgtactcttctggggtcacttcacgtccattgatcagatagcggcgattttcggtattaaaaccgttcaagccgcccatcatctggttaaaaatgtcattcatgtcatcgaatggatctactggaatttgtgccataagctattccccctattattaatattcaattgtaattcgctaaatcagtggtcaataaaaggcctaatgctgttacactcgacctcctactgctacactatgcgattatcgctctaggtaatgctcttccagctcttttagcacttcccacatcttgcggtgctgtgctcgagccaaagcatccaagtcgcgcagattcagcggcgtggcactggtctgctccttgttgaacgatttgtgcaaggtcgtgtagccgtagccggatcgtttggacacttgatagatcgtcaagtgattcacgtccaaataatgcttgatgtcgattcgcaccatgctcacttcctttacgttttttattatatcacgtctgtgttataacacaagtgtaaaataccacatttgtgaaatatttttttatcaagtcaaaaaggttctcttccttttatatgcttcgttttgagatcgttttcaacgaatattgaatcaatagccaagcaagctgactgatgacggcctgcttggtgcatagaaaaatggataaaaatttttaaccattttctcactttagttcccaaggacgtgaaataccatgctgcaaacgtttgacgcaattatgcagcctttatttactcgtgtttatcttttgcataaaactaaaaaatataaagtattgttgactttttattcgtttttctgtatatttaatgacaatttataaatcaattataaattaagagcaatcagaaacagaaatatcggaggaagaacttatgaaacaagaaaaggaaaaaatcgttttagcttattctggcggcctggatacctcagtcgctattgcctggcttaagaacaaaggctacgacgtaattgcatgctgtattgacgttggtgaaggcaaggacctggaagccatcaaggccaaaggaagtcaagtcggcgcctatgcatccgtcgttatcgatgccaaagaagactttgcggaaaactttgtcctgcccgctctgcaaagcaatgccatgtacgaacaagaatatcccctggtttctgctctttcccgacctctgattgttcaaaagctcgttgccgttgccaaggaatacggtgctaccgccatcgcccatggctgcactgggaaaggcaatgatcaggttcgttttgaagccggcatccatgcactggctcctgacatgaagattgaggacccgattcgtgactggcactggtcacgggaagaagaaatcgactacgccaagaagaatggcattcccgttccaatcaccatggaaagcccctactcgattgacgaaaacctgtggggccgtgccaatgaatgtgggattcttgaagatccatgggctagcgctcctgaagacgcctatgaccggaccaacccaattgaaaaaacgccggacacgccagaaatcatggagattcaattcgcacacggcaagccggttgcccttaacggtgaagccatgccactggccgaactgatcatgaagctcgacaagattgccggcaagcacggaattggccggatcgatcacgttgaaaatcggctggtcggtatcaagtcgcgtgaaatctacgaatgtcctgcagctacggttcttttgaaggcgcacaaagatctggaagacctgactctggaacgtgaagcagctcacttcaagccggtcgttgaactgaagatggccaacctgatctacaatggtctgtggtactcgccattaatgaaagccattcaagcattcattaaagaaacgcaaaaagacgtcaacggtacggttcgggtcaagctgtttaaaggcaacgttgtctgtgaaggtcggaagtcgcctaattccttatacgacaagaatctggctacctatacctctgccgatgaatttgatcaggaagctgctggtggcttcatcaagctttgggaactgcctgacaaggtctatgctcaagtgcaggccaatgctgccaacaaccaatctgaacctagcgtaaagggggaaaccatcagtgccgattaagcggatgtggggtggacggtttgaagagtctggctccgatttggtaaataaattcggggcttcaatcacctttgaccaagagatggcccaagaagacattcaaggatcattggcccatgtcaagatgcttaaggcaaccaagatccttgacactgccgacgccgatgccatcatcaaaggactggagacgcttgctgaaaagctgaagcaaggcaaactgtctttcaatattgaaaatgaagacattcatatgaacattgaggcactcttgacggcagaaatcggtccggtagccggcaagctgcacactgggcggagtcgaaacgaccaggttgccaccgatctgcatctgtacgtcaaagagcggctgcctcaagtaattgtggccatcaagcagctgcagcaagtcttggtcgacaaggccagcgacaacgttgagaccatcatgccgggctatactcacatgcagcatgcccaaccgatctcatatggtcattatctgatggcatatttccagatgctgcagcgtgacgctgaacgattcaaattcaacatgcagcataccgacgtctctccgttgggcgcggcggctttggcgggaacgacctttccaatcgaccgtcaattgagtgcgaagtaccttggtttctcagatatttatcacaactcgctggacgcggtatctgatcgtgactttgtcttggaatttctcagcagcgccagcattttgatgatgcacctgtcgcggatgtgcgaggaattaatctactggtgcagctatgaattcggctatattgagctttcagatgcctattccacgggcagctcgatcatgccgcaaaagaaaaatcctgatacggccgaactgattcggggcaagactggccgggtctatggcgacttaatgggacttttgactaccatgaagggcctgccgctcgcatacaataaagacatgcaagaggataaggaaggcgtttttgatgccgtcaaaaccatcatccccagtctcaagatcatggctggcatggttgaaacgttgaaggtcaatcaagataagatggaacatgccgtccacaatgatttttcaaatgctactgagctggcggactatctggccagcaaaggcattccatttagacaggcgcacgaaatcgttggcgagctggtcttaaagggattgaagaccggtaagaaccttagcgatatcagcctggcggaatatcaaaagatcagtcctttgatcactgaagacgtttatcacgtgctgcagccaaaagtagccgttgaacgacggaattcagcaggcggaaccggctttgctcaagtcgaagcccagattaaagctgccaaagaactattaaaagattaagcaaagtcctgcaagactcatgaagttttgcaggactttttatgttttggcgatcattggcaaaaaaacaaggcatcgtaggtaattttagtccccgtccccgtagccattcatgatctgatttccttcaaaaagccatccccagcaggctccttaatccgtattcactaatacctaaccgtcatttcatttgctctattgggacattaaacgttttaaatactttaacgcgacactcatccgatctttgtcgattgatttttgctgcctaatccgtttcgatattatatgaagatatttgaaaacgttagggagatttaaattgaagttaaagaaattaactatcaactggttcagcatgctttggctgacggtccttttgctcataacaaccgcagtcagcactaccgcctgcctaatgctctctcatgctgctggccagtcttttttgtttttatggctgattaaaaacgcggccgctttgagcgttttgattctgccaatgatgctgggagcttttgacatcaagattccgcatcggcaaaccgccgtgattctatcagcgggaaccggcctgatcttatttggcttggccaatcatcttacgcagccggccgttttggaaagtgtcccttctgctgagcgctatgtcgtccaaaacatctttgtgacctggttagcctatttggtgctgctgcttttcgctccccgactgaaaaaatggctgcatcaattcacgatcaaacagcgccggcgcactttaattatcttgacgctggcgatttggctgctcaatctcaaccatgccgtgggggtcttaggtctggcaggcggcagcagctttttatggtttagctacctttttgccatgggtgattggctgggcagcgatcaggcactgctgcagtcattaaagaccagctggctgataattggcgatctgctggtctttttggcaatgtgtctggctgcctggttcaatatcaatcagctgagctataatccgcatgatggtctgcttttgaccactcactatcaggtcgccatcaacgcctttcaaaacacctacctggcaatggcaatcctggtcatcatcacgctggtcaagctgctgtcatcacgatcattaagcagcttttatgccattttgggcggtttgatgcttaatttgctggccatccccaaactattcgtaccgttcttaaagtatcagccacgctggcacctatcgattgctattgcagcaggctgggccgtcagctggagccttgccgttttgctcagtcagtggacgacccgctttgactggcagcttaagtttgatttaggtgctggctgggactttttaaagaaaacctttgccaaatgctggccgtttctattgaccgccgccgttatctggggaatgacgatctggtcgtttggctacctttggaactggcagctcaacatgctgcagtggatcatcacggatcataatgccatcgtctgggccaatgtaatgatcatgatggccctggccggaattttaatggccttgaccaatcgctggtggctcagcagtgctttaacgatcattatctatggcggctggctgactgcctcgctgcttaagattcaagcacgggctgagccgattctgccaactgacctggctacgctaaccgcacctaaagaaatgctgggcatggtcgagctaacgattctgctggccgcagggggtgtcgtcatcgttctgcttggctttgccgtagcaatcgagattcgccatggtcgaaaataccgccttaagattcagtggcgctatctgatcggtgcggctgccatcctttatctaagcggttttgcctttatcaatcacaccaactcaccaacctatcgctgggctgagaaagtcgacgacacgccttatttttacgcgcagctgcgtggtgccaaggttaacggtacgctcctgcagtttgccaataacgttgacgttcgcgtaatggacaaacccaagggatattcaaaagctcgcatggaaaaaatcggtcaaaaatatcgtcagcaggctaaaatcatcaaccggcagcgaactcacgccagcgttggcaatcagcgcctcgtctttatcttaagcgagagttttgctgatccgcgtcgcgtgccggatctaaaagtcagcggcaacccactgccttatctggaccagctcaagcatcgcacgaccagcggcttgatgatcagcactggttatggcggcgggacggccaatatggaatatcaagccttgaccggactttctatcgtcaacttttcgccaaccatgccaacgccatattcccagctggttccctaccaaaaacgcgccgtatccattaatcagctgttttcttacagtgatggaattcatccgtttaccgccaatctatacagccgtgtaaaagtctatcgcaaatttggtttcaaccgtttctatcatcttgatggcggcagccgactttcctatacgcataagatcgacaacagtccccgcattgatgactggtctgcctataagcaggtattgttaaatcttaggaatcatcatggcaaccagttcatccaattggccaccatgcaaaaccatatgccatacgacaatttttatcatcacaacaactacaaggtcagcggaacggcctaccgaactcctcaggctcagcagcagatcgagacctacacacagggcatccactatactgacgaggcactgaaaaaattcatcagccggttagaccaaagcagccagccgaccaccgttgtctggtatggtgaccatctgcccggtatctacaatggcgtttcgatggctgagcatgggctggtgatgcacgaaaccgactactttatctatagcaatccagctgctcaaaaaatcaatcacagccgcgttgacaaagcaaagatcgtcagtccaaacgagtttatcccaatggcaatggcgcagatggatctcaaggtttcaccatactacgcgctcttgacacaggttcatgaaaagctgccggccattacgctggatcccaacgttcacagtcacagcaaccgtccgcacagcacggccgctgaatacgtcgatcaagacggcctgcagacgacgctttctctaaagcagatgcggctgtttgacgactatcgcatggttcagtatgatctgacggccgggcatcattatctgctgcatgactggttcatgcttaaggtgccgcattaatcagactgcttaatcatcaccaaatcatatcaagacagatcatcgcctagaaaacgcgtttccgctcttgataaaaaagacgctcaacaattgagcgtcttttttatttgattcgatcagccacctcgtcaacgacgtcctgcagcgtaatctgcttcatcatggcttctgcagctgcctggatctgatcataggccttgcctagtaccggctgaatgtttttaccgactggacactgctgattagtctgttcatcgatatgcagcagatggtgattttcttcaactgcgtaatacacatccagcagcgtgatctcaacggccgggcgactcagctgtggtgccggcgcgtctgactttggcttgagaatgccggccttgaccattttggcaattagactgcgaatcaggctgggattggcatccacgctggcggccagatcctgactgctgattttttgcccgtgatagatctccagataggtcagaatatgcacggcatcacttaaacgatgagaatatttcataattcagcgcacctttatttatgatagggaagaccattgataatcgtaaaggcccggtagatctgttcagtcaaaaccagccgcatcaattggtgaggcagcgtaaagcgtccaaacgagatctgctcattggcccgttttaagacagccggactcagccccaaagatccgccaatcacaaacgtaatgtcgctgtgaccgtaagttgccaactgattaagcgtctgggcaaattcttccgagctgcgttccttgccgttgattgccagggcaaaaacgtactcgcgatccttaatcttgcttaggatacgttcgccttccttagccataacctcatccatctcggcttggcttagtgattcgggtgctttttcatccgggacctccacgatctcaaacttgcagtatcgccccaagcgcttggcatattcagcaattccggccttaaagtatttttcctttaatttgccaaccccaattatcttaatgttcatttaaaactccttctaatcaattgttcggtaattataccaattcttctcccaactgaccacgactagttatccacagttcaaaaccaaaacagccgtttgtattcaacggtcaaacccattgatataactgtgtttatcaatcatcaataaatatgataaagggttttccacaattctgcaatctttacttgtggataactaaaagtactgatattaaggaatttgattcttattttttaaatcgcagtcttttacacgaaacgtggcggcaaagccagctaatttaaagttatccaccgtttttggaacatttatccacagaaattgtggataattcgtcaaataaaaaacgtgatcttaacaatcaattaatcattaagaacacgtttttaagctactggttgtttgatgagctgctgctgtcggcgctggcagactgagtcagcttaaccgataccgtctgctgtttgccttgccgatacagcgtcagcttaatcgtgtcgccaaccttgtacttgtagagctgagtcttcagatcaccgccatcattaacttttttattgttgatcttggtaattacgtcatacttttgaattcccgcctgatcagctgccgagccgctctgagccttcataactacgacccctttggtaatgctctttggcagcttcaggatgtcttgctggtcttgaccatccacattgctcagatcgatcatctcaatgccaagcgatggccgcgtaatcttgccattggctaccaattgattgatgacccgcacgacctcattgcttggaatcgagaagcccatcccttcaacgctggttccttgactgtcgctggccagcttcattgagttgataccgatgacctgcccagccatgttgaccagcggaccacctgaattaccggcattgatcgccgcgtcggtttgaatgaccgtggtattggtgcctgagttgcttgagctggcactgatcgtccgttttggcgccgaaatgatccctttcgtaaccgtgttggcatattcgctgcccattggcgaaccaattgccaagacgtcttgaccagccttgatcgagttggaattgccgaacttggcaaccgtcgttacgttagcggcactgatctttaaaacggccagatcagtcgttgagtccgtaccaaccagttcagcctggaccttcttgccgttgctcatgatcacctgcagcgcgctggccccagaaaccacgtgattgttggtaacgatataggcggcgttgcctgacttcttatagattacccctgaaccttcactggccgtctgcagcgaactggaattggagctggatgaatcagagtctgcaccaaatatcgacagaatatcattgtcgtcagaagagctggcctgcttgttgatgacgctgaccacggcccccttgaccgcattataggcctcagttgactggttgctcttggtatcttcatttttattgatcttagtgcccccagacttgtttgatccagatggcactttggtagctgcgttttgctgatgagtgacgatcgcattacccacgccatacgaaacaccgccaccaatcaagcccgctaaaagtcctacccctgcaactttgacgattaactgcttgcctgccataatctaatacttcctttgttttttttcagtataacaaaaaagtatgaatattagttgaaatatttacaaagccagcagcttgcttggctgatcgggttcggcatcctttaagtcaaaatcctgatccacgcccagatcatgctgctctaaaatcgtggcaaccgttagatgagccagcgagcgaatattgttgtgctgactgcgatgccccaaaaagacctgtttcgtgttggtgccgattacgtccaaaagtgcctgggcactctcctcattggaaagatgcccctcatcgcttaggatccgctgcttgagcggccaggagtatggtcccattctaagcatttcagtgtcatggttgcactccatcaaataggcatccgcattttcaatcgttttagccacgcgctgcgagacatagcccgtatccgttaaaatacagaaggtctgattatcgtggtgcatctggtaaaactgaggacaggcagcatcatgcgaaacggcaaagctttcgacttccaaatcaccaaagtccttcaccttgccgggctcaataatgtttttttgagccagcgggatctggcccacttttttagccattgcctgccaggttttagcattggcataaacgtccatgccatagcgccgagccaaaacgccgacgccttgaacgtgatcgctgtgctcatgggttacaaacagcgcttcaacgtccttaagcgagcggccaatcgcctccatgcgctcttctaaacgtttgccgctaagccccgcgtcaatcagaattcgatgatgagcggtctctagataggtggcattgcctgagctgccactggctaaaatactgtagtaaagcttgtcatccgaatttgtcactgctgttttttccttcttttggttattgattcagctgcgtcgtatcaatttcttctggcgtattgcgcatcagcgtgctgttgaatgcattgaccctgaggcgttggacgtcatcagagttcttggtcttgatctcaacgtaccaggttggcacatagactgtttgatccttagtcagcaaggttttcgtatagccaagttttgcccagcgaatctttgagttgttgggaatatagttatgcttatacagccaggtcacggcttcctgctgactgatcgtgactgagcgcggtcttaagacttgaatgttgttcagataagtctgcgtataggcgtagactttatgattcctgctgaccttaaagcgcaactgcccttcaccgccaaacaccgaccggccttccatcatctgggtatagacgatcgtgctggaactggacaaggccttgttgtagacatagtgcgacccgtataaaacgtgacgcgaatttttgatgtagtcgttcagctgccgttctggattcagcatgctgactttaatcggcgtgtttagttcactgattaaggttccattgctcaagcgcaccgtctgatcgtcaagcttggcagcagcattggtcagctgactgttggcccggttggcggaaatataatatcccattggctgcttggtggaaagttcagcaaaactgatctcgtcattatgcatttcctttaagatcagctgctgttgaccctgctgcttgaccatcgccgtaaagtgagtgccgattaaaaaatagctggctaagacgatatcaaagatcgcaaaggcaatcacgaagatccattgaattcgtttaaaattcatgccgcgtcctcctatttatcgtcgatcagcgtctggtaggcaacccacttgccatgatagtaggcatagtaggttggctccagtttaacgactttactgtccgcattctgatcatcccagcgatagccgattctcaagccagtaacatccttatccttgccagcctgccgcagctcattatagacgactgaagaaggcggcagtttgactcgcgactccttgatcggcaacggtatgccaagtccaaacaatgacaactgaccgcgttcgacgccatccgcattggcctgcagcttaaccgcgccatagccatgctcattaaagatcgggaagccttcgacatagctgcggaaaacgatggtctgctttttttcattaaccgagtcaaaacgcatccaatcaagattcgtccccgtagccgtcaagcgtttatacagatgacgatacaggcttgctccctgataggtgctgtccttgcccagataattgttgaaactgaccgtatgcgtatcgcgatgatagtcaagccgtttgctggccccatccatataggtcgtatcattgccctttttcttgacggtgaacgctgaggaattggtcgaccgcagcagattctgcgtcagattgtcaatattctgcgttgacagccggtaggcaaagaccggtagcttaatggcatgtgggtaggtcacggttggctgattatcaacgattttatgatcaacgtcgatccgctgacccgaattttggatcagctttttgagcttagaccgattggcgttttgagtaatattcaatctatagaccgtaaaatcatcatcatcaagcagatagaccacatcgcgacccttaagcggaatcacgatatggttgatgtgcgacattttttgagtatcgattgattttgaaaacgtctgattaaagatccccgttgccatggcatctggataagacagcatgattgaatcatcattgcgcagatagttcagataagctgaagaatcattgcgagcaacgcggcggaaaccagccagctgccatttttgcatctccttgcgcagtgtcagcaccagattctttttttgtccatacaaaagcttttgcgactcatcagaattggttaggatcacctgcgttggcagatagatatcgccgactgactgcagggccgtctgctgtgaggcgcctttttccgagtcattattggcaatccattcatagccaagcgagttcgtccacagcaaagccgaaaagatcatactgagaatgacgaccacggctaatagaatgctcagccagttttctttgattttggccattaatcccagtcatctccttcatcatcataaggtacgtaaggcagtgagatataaaacgttgagcccttgccttccacactgtcgacccagatctgaccacccagcatgttgacgacttcctttgagattgccaggccaagtccgctcccgccttgcttgcggctgcgggccttgtcaacccgaaagaagcgatcgaaaatatggttcagatcctttcttggaatccccaggccttgatcactgatgcttaaaatcacatgattatgcgtttccaacaggcgcgccgtaatcacgccaccatccggcgaatatttaacggcattgttcataatattgtccacgacctgcgtaaacttatccggatcgatctcaacccagagatccttgcgtgtaaagtgccgctcaatggtataacgcttctttttgggatcctcttcttttttgataatcatatcaaagcgatccagaatatagctgaacagctcgttgatgtttacatattccaaattcagcttggccgttcccgaatccatgcgcgacaggcttaataggtcattgatcatccgaatcatgcgctcagtctcatcctgcacgaccttcaaaaactggggcgtaatctcaggatctttccaggcgccatcgcttaacgcctcaacgtagctcttaacgctggtcagtggcgtccgcagctcgtgtgagacgttggaaacaaactccttgcgctcacgttcttctttttgctggctggtaacgtcatgcaagacgcataccaaaccagagacaaagcctgattcgcgttgaattggcgaaaaataggcactcaagatcatgtcattgccatcaacgtttaaatcaaacaacgtctgctgctgcgaattgtcgatcagctgacgcaccgtatagtcgcgccgcacgtctaagacatccagaatcgacttgcccaagacatcatcttctgaatcaatgtccagcatctgcagggccatgttgttgatgatcgttacgttgccgcgccgattggttgccagcaccccatcactcatatgcgacaagacgctgtccaagcgccgccgctcagaatcggttgactcttgagcctcttctacgcggacggacagattgttgaccgctcccgccaactgaccaagctcatcgtttcccatgaccttgacctgaccagaatagtcgcctcgcgcgattcttaatgcctgtttgcgcatctcttcaattggccgcgtaatctcgcgcgaaatcaagaccgccagcccaagcccaagcaccacagtaaccagagcggcagaaagatagatcaatgaaataccattgacgctgtcataaacgctctccagattagcccgcagataaacggcgcccacgacgttattggtcgctgcgccaactaaaggaatgacgttgacatagtagcggttgtgactggagttgtcgtatatgttttcagtatgggaacgattgttgagcagcgtattcttgacggcttcatcggtcgttcgttgtccaacaacgtcttgattactggcattgctggtaccgcgcacgattcccttagcatcaactacgcgaatctcagaaatgttgttgttcttgacttcagagagaatctgcttgatttgccggttagcagccttttcattggtgcggctcagctgtttggtcaatgaactgtcaacataggtcggcagctcgatctgctgcttgaaggtattgaggttttcctgctctaactgacgcacaaaaaccgccccgacgacttccaaggtcagcatcagcattaaagcaaacaccagggcgattttaaaatgaatggtttgataaaatttgattttgctgttcaaaactaacgaacctttttagttttggcttgggttggccaaatagtagccgaccccacgacgagtaatcagccattgcggatgacttggattatcctcgattttttcgcgtagccgccgaaccgtcacgtcaaccgtccgtacgtcgccaaaataatcatagccccaaaccgtctgcaacaaatgctcacgattgataacctgaccgatatgctgtgccaaataatacagcagttcaaactcacggtgcgtcagattgatattttcgccgcgcttggtaaccgtgtaggcatcaggatgaatcgtcaaatcgccaacctgaatatcagcattctgggcttcggctgctggcgctgcggcagcttcttgacggcgcaggttggccttgactcgtgctaccagctcacggttggaaaatggcttggtaacatagtcatcggcccccagctccaatcctaagaccttatccagttcggaatccttagccgttaccatgataatcggcgtcgtatgcttagcccgaacccgcttggcaacttccaagccatcgatcttaggcagcatcaagtctaaaacgatcaaatccggctgctcgctttctactttttccagggcttcttcgccatcataggcaaccacgacttcatagccttctttttccaaattaaatttaatgatatccgaaatcggtttttcgtcatcaactaccaatatctttttagccattaattattcccccatggagttgttaataagattaaaattcatttgaatcgagtcgcagagattattttttaccataaattgcggttctattatagcatagtcgcatcagggcttttaaatctgattattttttttgctaaaaccgttgacaaattacctcaatgcatttaatatatataactgttgttggtgttcaacagcaattaaaaatttgggcagttagctcagctggcagagcaacggactcttaatccgtgggtccagggttcgatcccctgactgcccatcagaggtttacaaagcgattgatcatttggtcaatcgcttttgttttaccgtaaaacagtattttaggcagtttgacgattaattgcaaattttttcaactttttattgggaaaaggattgcattagcctaagatatctgatagtataatatctgttgttaaggacatgggcagttagctcagctggcagagcaacggactcttaatccgtgggtccagggttcgatcccctgactgcccatcatgtcgccatcggctgttagtcggtggcttttttgttacctaaatccacccatcaaaaaaaagatcgcgtcacctaaaacgcgatcttttttgtttaatctgctaaatctgccgtggtcggaacaaccttggcatgtttaagccgactgattttattttcctggccggcgttgacctcaaactcatccacaaagtcgcagttggcgcaggccactatgatctgatagcgctgtgaatgatccggattggttgcttcccagttgcgctcggcaattaccagcggcttttgatgacacttgctgcaggcaatctttaaactacgatcttcgcgaaagggatcaccaaccttgccaaccattccccagcgatcctcaccataaacctgatcaaagttattgtaaaacataatctcaccttgaattatcagaactgttcggtagcatgctggcgagccattaccattgcaatgactacggcctcaactaccaaaatcgaaaccgcacaaataacaaataatggccgatatgaaaatctttcaatgatcaaaccgccaaacaacggtccaattgccttgccagtcgaagcaaaggcgttcagcattccttgatactttcccttatcgtcaaccggcgacaaaaggttgatgattgcgggaatcgtcggaaaggcggttgcctcgcccaaagtcagaacaaccattgccaaaacaaacatcccatagcttttggcaaacaggagcagaacaaacgacagaccgcacgtcagaatgccaaaatagacaaaataatagtcgttggtaatttttttggtcagccagctgatcacggcctggaacaaaacgatcaaaattccattgatcgtccacagcatactgtacagcgtcattgaaatccccatatccgtcatgtaaaccgacatgttgcttgaccattgtccatacatgatccagatgatggcaaatgagatgaaaagcgtccagatgatctgcgcgttggcagctggcagcttgccttggtgcgggccgaaatcgacatcgaccgtatgatgctgccgcggtttgatcggcgtgatctggaaaaacataactacgaccagcaggaaaaaggcatacatgaccaccgtaatggcaaatagaggcgacacgctgttatgtgccaattgataaagcggtccgacaatcgtagttcctaaaaccatgcccaagttgttggcaaaatacagcatgttaaagacgaagcggccgtcatgactgcggacacgggtaccaaatgagttgaccatcgtaatgatccagccattaaaaaagccgatgatcgtcagcattaccggatagatcggccagccattgctaaagatcaagactgccatcgaaatcatcgccaaaatcaggccgccaatcattaaatgacgtggattttttcggtcaaacagcaatcctgcgatatagctgcccacaacattggcgccagaataaaaaagcaatacgacccctgaaacggtcagcgactgatgcagctgatcgtgaatatagatcgttgtcaacggccagacaaaactgttgccgatactccctaaaaacgatcccaaaagcagccactgcagtttaaagccggtttttttcatttatctgctcctttccttctcaataatcctctcttaattttagtgcgaatttactgcaagacaacaaacaagcagctgctgatcactcaactgctgcttgtcttttaagccggttcggtgtgttgatagtcaaccgccgcgaacttgttataggctttgttaaagagcagcttgacggttccccgtgggccgctccggtttttttcaataatgatctcgacttcgctaaggctttgatcgggatcattaaaggttttctcttctttttcgtcatcatcatcggcgccttctcgttcatagtagtcggctcgatacaaaaagctgacgatatcggcatcctgttcgatcgatcctgactcacgaatatcagaaagcaccggccgcttgtcctgacgctgctcaacgccacgcgagagctgcgaaagagcaattaccggcacgctgagctccttggcaagcttctttagctgccgcgagatctcagagacttcctgctgccgattttccgggttgcttccttcaatcagctgcagatagtcgatcacaatcagacccagattgccgttttccttagccagccgccgacacttggcgcgaatttccggaaccttgatgcccggcgtatcgtcaatgtagatgttggcctgcgccaagacacttgaggcaaccataaagttgttccattcatcctgattcagctgaccggttcttaaatgattggcattgatgtttccctgtgcacaaagcatccggttgaccagcgattcagcacccatttccagactgaagatcgctaccgttgcatcggagctggttgctacgttttgtgcgatgttaagcgcaaaagcagtcttacccatggctggacgagcagcaataattaccagctcatcatcatgcagccccgttgtcatttcatccaattgcggataaccagtcggcaggcccgtcacatcgctttcgtttttggaaagctcatagacatgattgatcgaatcgtttaagacagtatcaatacgctgaaagccagcccgattgcttgattcagaaacgcgcagaatcgaggtttcggcttcatccaacagctcattgacgttttcttgaccgtcatagcttttttgaacgatttccgttgccacatcaatcagacgtctggccgttgccttatcgtgaacgattttggcatagtagccgacattggccgcggttggcaccgagccagccagctccgccaaatactcagtgccgccaatgttatccaattgatgttcgctttccagctcagactgcatcgtcaagacatcgatcggcttttcttggtcgttaagcttaaccatcgccgcaaaaacgatctgatgcgcgcgctgataaaagtcattggaggaaacaaactccattgcctcttcaatcgcgccatgtgacaaaaaggccgcacccaaaacggctttttccgcggccagatcgcgcggtgcggtacgcgttgaacttaaactggcattgtccatttattgacggcctttcatttatttagcagccacatgcacgtcaatggttgcttcaacgtcatgatgcagtttgatcggcacgtggacaaagccagttgccttgattggtgccggcaattcgatcttgcgcttgtcgatcttcaagttgaattgatcctccaaagccttggcaatctgcttagaagaaacggagccaaagatgcggccatcagtaccggctttagcactcagctcaactaccgtatcttcgctttccagtacttcctttagccgcttggcttcagcaagttcttcagcctcatgcttttgagcggcccgctgctgcccctttaattcgctcatggcagctttggtagcttccttggccagaccgcgcttgatcaggtagttttgagcgtagccatctgggacttcttttaactcaccgcgcttgccacggccacgtacgtctttaataaagataaccttcatagtttagtactccttttctgtttcatcttctgactgatcaccagtcgtcagcagcctgatcagctcagcttttacctcactgacggttttaccggcaatctgagttgcagcattagccagatgaccgccgccgcccatcttctccataatgatctgaacgttgatgttgcccatcgagcgagccgagattccgaccttatcgttagcacgcttggcaacaacgaatgaggcatcgaccccatccatctgcaataaggtgtcggctgcctgcgcaacaatgactggatcataggtacgatcatcctcaccggcacataacgccattttatcattattcaaaaactcaacggtagcaatcaggtgatttctttccataaagctatggacgttttctttcatgaaatattgaatcatcagcccatctgcccccgctgagcgcagatagctggctgcctcaaacgttcgggtcccagcctgctgcgtaaacgatttggtatcaatctgaatccccgtcagcatggcagtggcttccagcttatttagcgactcgctttcccgcggctgatactcaaacatttccgtaatcagttcacaagtcgagctggcataaggttcaatgtagactaaaagcggattttcagggaattcctcgccgcggcggtggtgatcgataatgatcgtgcggtccgccaagcgctcataaagctgtggcgaaatcgacatgcttggcttggaatgatcgaccattaccaaaagactgctgtcggttgccttattgattgcttcatctggagtaatgatccgatcgcgaatgctttgatagtcattgatctccatcatcaaacgagcaatatcgctatgaaccttctctttgtccaaaacgatccagcactcgtgaccattcatttcagcaattcttctgatccccagacaggcccccaaagaatccatatctgggttggaatgccccattacaaagacttgatcggcctgggtcattaattcctgcagtgcctgactgatcatccgagctctgacgcgagtacgcttttccattggattggtacggccaccatagaaacgggcccggtgatcttcttctctgaccacgacctgatcgccaccacgccccagtgccaggtcaaggttgcgctgcgccatgtcggccagtttgatcaaatcgctttgaccatacgcgatccctacactgagcgttactggcgaattctgcttggaggtattttcgcgaataacgtctaaaatcttaaacttctgcttttccagctcaaccagtgattgataatgaccgattacgaaatagttgtcttcattgatcacgcgcagcagcagatgattatcctttgcccagtgactcaattccgaagtaacgtaattatgcaggttggagacggccgaatcgttcattccttgagtaagttcaatgtagttgtccaaatagatatttcccaggaaaatctgctcatgctgataacgctcgctgatctgctcatatttggtaacatccagcaggtaacagacatgataacggtcctgcactaaaaactcaaatcgatgatcgcgccacgaaacgactgctggtcccttatcatgacgatgctcatcaatcaatttagccaattcatcatcagcctgcgtcaatggcttgccgacaacgtgctcaaactgaaaatagcgcgccatatatggattgatccaactgacgatgccacgatggttcagcatcaccattccaattggcatctctaaaagcgcctcttgctggcctcgttgaacctgatatgtcagattattgatatattcttcagtatcaactaccagacgacgcagctgatgagcactgatccagatccccacaaaggcaattgccaataataccgttcctagaatccagctggttttaaaagccaacatcagacagatgatcgtcatcaaagccagatagcagaaattccagcgaactgcgtgattcttaattaaaaaattccaattgttatgtcgaaagaaattacccatatttttctcctataacgacaatctagatattcctatcttatcacaatcggttcggcaactcaccgttcacgtttttcatcattgtttgaataaaggcaaaaaaaaacatgatgacactggccatcatgttttaaattatcagctgaattagtcttcagcaacgaatggcagcagacccatgatccgtgcacgcttgatagcgaccgtcagacgacgttggttcttggcgctggtacccgttactcgacgtggcaaaatcttgccccgttcagagatgaaacgcttcagcaaatcagtgtctttgtagtcaatgtattcaatgtggttagcggcgataaagtcgaccttgcgacgacgacgaccgccacgacgttgttgagccatgaaattaccctccttaaatcatgtatttggttttaaattaaaatggcaaatcatcttcagccgtgctgtcagcagacttagtgtcatttgactttggtgctgcactggcattggttgaatcagcggcaggctggccattggttggcagaacgctgtcgtttagatcaaacgtagcggcatcattgtttgatggtgcagctggctgagaatcttcattgccgaatggaaaatcattgtggactggtgtttcttgaccaggcattggtgcattttcaaagggattgttgaatccgccttgattgccaaatgatgaatttcccattggttgagaagcacgaccgttgtcaaagccttgctgatagccaccgccattatactgtgactgattgttgttccagttgccttgaccattgccaaagtttgactgagaacgaccgccactgtagggctgaccgccattgcgacgcggttccagcaatgcaaagttatcaacctgtacttccgttacgtagacgcgctggccttgattgttttcgtagctgcgtgtccgtaaagaaccgtcaattcctaccaaggcacctttatgggtgaagttggcaaaattttcggctggctttcgccagataacacagttgataaagtcggcatcacgctcaccttgagcattccgaaactgacgatcaacggccagcgtgaaggaggccactgatgtgccgccttgagtgtagcgcaattcagcatctcttgtcagacgaccggttaatacgacgcgattaagcatggacctcgtactcctctctaaaacttattcaatttggattgcaacgcgacttaggcttcgcgcttaacaatcatgtgacgcagaatgtcgtcgctgaacttagccagacggtcaaattcgttcagagattcgtcactgtcagcagtcaggttgactacatggtaagtaccttcagtgtacttagcgattgggtaggcaaaccgacgcgttgaccaatcctttgaatcgatgatgttggcaccattgtccgccagaatcttgtcgaagcgagctaccagttcgctcttagcagattcttcgatgtctggacgaatgatgtaagtaatttcatatttgcgtgtttccatgaatgttacacctccttatggactctggctcttattttcaagattaataagagcaaggagagcagacgtctttacgtatactcacagacaaagatattagcataaataaaaatcaattacaagcgattcaatcatctaatcaaaaaagctgaattgcggccctctgattaaactatatgccgtaattcagcttttgcattttatttagttgttttctgtttcagatgctgcggaatcttcttcagcaggtaaagcatcatcatcttgatccgtctgatcttccttggccactttagccatcgtagctaccttggaatcatcatccattcgaatcagatgcactcccacggcggcacgaccagtctgtgaaacggtctcgatgccaaaacgaatgatcacgcctttatcggttaccagcatgatgtcctcatcgcccttgaccgtcgtcaaaccagccaatggaccattctttgccgttacgttgacggtcttgattcctttaccgccacgacccttaattgggtattcagcagctggcgtctgcttaccaaagccattctcgctgattacgaaaacattgctgtccgaatcaagcggtgcggcgccgataacacagtcgccttcccgcagcttggctccccgtacaccggcagccgagcgacccatcgaacgaacgtcttcagcattgaaactgactgcatagccaagtcgcgtccctaagatcatgttctgctgaccatcaataatgttgacgtgaatcagctcatcgccatcatgcagctggattgccttcagaccattgctgcgaatattacgaaagtcatcaactggcgtcttcttgaccgtcccctgcttagtaacaaagaacaggaacttgtcggtatcatcggcagcattcgaaacgttgatcaccgcggtaatcttttcgtgattgtcgatgccaagcaagttgatgattggaattccctgagctgaacggccatactctggaacctcgtagcccttcatagagaagaccttgcctgaattggtaaagaacagcagaatatcatgcgtggaactggagatcagatgctcgataaagtcatctttgtgtacgcccattcctttaacgccgcgaccaccacgattttgcgacttgaattcgtcaaccggcagccgcttgatgtagccattatgagtcagcgtgacgacgatatcttcttcttcaatcagatcctcgtcttcaatatcggtaatatcgccgacctgcagctcagtccgacgtggatcgccaaacttgcgctgaatctctaacagttcatcgtaaatgatctgattgatgcgttcttcatgcgccaagatgtcttgatagtcggcaattgcctcggtaagcttttgatgctcgttttcaatcttttcacgttcaagcccggtcagccgcaccagccgcatgtccaaaatcgcttgcgcctgacgatcatccagcgtatagcggtcaatcagctgctccttggcaatctcgctggtctgcgcctcgcgaatgattttaatgatctcgtcaatatgatcaagggcaatcaaaagtccctgcacgatatgatcgcgactctgcgcttttttcaggtcaaattccgtccgccgccgaaccacgttgatctgatgttcaaggtagtgctgcaggatctgcttaaggcttaagactttcggcgctccgttgacgatggccagcatattgaaattgaaagtcgtctgcatcagcgtcatcttgtacagattgtttaagatgacctcagcactggcatcacgccgaacgtcaatcacgatccgcatcccttcacggtcggtttcgtcattgatatcggtaatcccctcgatttctttttcacgagccaattcggcaatccgctcaatcaagcgtgccttgttgaccatgtaaggaatctcatgaacgacgatacgctgacgaccattcttggcttcttcaatgtcaaccttggcgcggacaataatcgttccacgtcccgtttcataggccttacggattccagacttgcccatgactacgccgccggttggaaaatcgggtcctggcagcaccttcatcaactcttcagtcgtagcatccggattctgcatcagcagatgaatggcgtcaattacctcgcctaagttatgcgtgggaatattggttgccatcccgacagcaatcccagaggcaccattgaccaaaagattagggaaccgagccggcaaaacagttggctccttttcactgccatcatagttgtcttgaaagtcaaccgtattcttattgatgtcacgcagcatctcaacggcaatcttgctcattctggcctcggtataacgcatggcggctgccccgtcgccatcaaccgagccaaagttaccatggccgtcaaccagcatatagcgatagctgaagtcctgcgccatccgcactaagccttcatagatcgaggaatcgccatgggggtgaaacttacccataacgtcaccaacgatacgtgcggattttttatatggcttgtctggcgtcacgcccagttcattcatcccataaaggattcgccgctgaactggtttcagcccatctctaacgtctggaagggcccgggcaacgatgacgctcattgcataatccaaaaatgaatttttcatcaatccagtcagattgacatcggtaatgcgccctggcatatcttgatctgccacgttttttcctccttagctgattttacaggtccaagttctcgacaaacttggcattttcttcaataaactcgcgccgcggaccgactttggttcccatcagcattgggaagatcttttccgcttcagcagcgtcatccaggtcaactcgcagcagatggcgtttttctggatccatcgttgtttcccagagctgttcagcatccatttcacccagtcctttgtagcgttgaattactggcttagggcttggctgcagcgtgttcaagacgttttgcagctcttcgtctgattcgacgtacttgacgaatttgccctgccgaacttgatacagtggcggctgtgcaatatagacatagccattggtgatcattggcttcatatagcgatagaaaagcgtcagcagcagcgtccgaatgtgcgcaccgtccacatcggcatcggtcatgatgatcagcttgtggtagttagccttggtaatgtcaaaatcaccgccaaaaccagtccctagagcagtaaacagcgaacgaatctcatcattggccagaatgcggtccatcccagctttttcaacgttgaggatcttaccacgaattggcagaatcgcctgcgtcaagcgggaacggccctgcttggcactaccaccggccgagtcaccctcgacgatgaacaattctgaaatttctggatccttgctggtgttgtcggctaatttcccgggtaatcttgaaatttccaagccgctcttcttacgcgtaacttcacgagcccgtttggcggctacccgcgctttggaagccagcattcccttttcaacgatcttgtgcgctgtgtccggattttccatcaaaaagcgcgcaaacatctcgctgaagatgtggtcggttgccgtccgcgcatccgagttgcccagcttggtcttggtctgtccttcaaactgtggatcagggtgtttgattgaaacgactgccgtcaatccttcacgcacatcatcaccggaaagcgtcgtattccccttcagctgaccgctctttcggccatagtcattgataacgcgcgtcaaagcggttttaaagccggtttcgtgcgttccgccttcataagtgtgaatgttgttggtaaaagtcatcagcgtgctgcggtatcccgtcgtatactgcagggaaacctcaaccgtgatgcccttgtcctcgccttccacatagattggcggatcaaacaggacttcttggccttcatttaagaattcaacgtagtgccgaattccgccttcataatggaactcttgccgggttggcttttcttctcgcttgtcctcaatcgtgatctttaggcccttgttcaaaaaagacaattcgcgaattcgatccgtcagcgtcttgatgttgtagaccgtcgtttcacggaagatttctggatccggcttaaaatgaactcgggtgccgtgttttaattccgaaatgccttctttaacaaccttcattggcgtcttaacgtggccatggtcaaagtccatatagtattccttgccttgccgcgttacgtagacatccagctcggttgacagcgcgttgacgactgaagcaccaaccccgtgcagaccaccagaaaccttgtagccgccgctgccgaacttaccaccggcatgcagaacggtaaagaccgtttccagtgccgacttgccggtttctttttgaatatcgaccgggatcccccgcccgttgtcggttaccgtaatgctgttgtctggttcaacaacgacattgatctcatcacaaaacccggccaaggcttcgtcaataccattgtcgacgatttcccagaccaggtgatgcagcccttgagcactggtggagccaatgtacatcccagggcgctttcggactgcttccagcccttttaggacttgaatctggctggcatcgtactcactggccagttccgctttcttttctgcttcaagttctttatcgctcactttttatcctccttgtcaatcgttccatgggcaatctgaaaaatcgttgggcgattgatcaattgtcgtgctacgccgcttaagctggtcgttgtcaaaaacgtctgaaccttatcctgaatggcagtcagcagatgggtctggcgatcatcatcaagttcggataagacgtcatccaatagcagtaatgggtactcgccggtctgttcattcatcagatcgatttctgccagcttgaccgctaatgccgttgtccgctgctgtccttgcgagccaaagcgatgaacgtcctgctcgttgaccaaaaaacgaatatcgtcgcgctgtggtccataaagcgtcgttcccagcttgatttcttgcggctgatgctcgtgatacagtttctgcagctgctcggcaatttcattttcagccgttttttcatcaatcataacctgggaaatatatttcagctttaagacttccttttgttgggaaatatgctcatgcagctgagccgaccatgtctccagtcgcttgagcagcttaaagcgcatcgccattactgccgcgccgctttctgccagctgatcggacaagacctccaacaatacctgatcgacctggctgccatacttcaactgtttcaaatattcattgcgctgctttaagagacctctaaactgactgatggcatacagatagcggctgctcatctgactgaactcagtatccataaactgacgccgttcctgaggggctcctttaaccagtgccagatcttctggagcaaataagactacgtttagattgccgatataagtcgacagccgcgattggaaaagatgattaaccttgactcgtttgccacgcgtacccaacagcacttccaacggtacccgtcccgtctgcttgataaccgtgcccttaaccatggcttccttagcctgccagttgatcagctcgcgatcattggcggttcggtggctgcgcgtcattgccaagacatagatggcctccagcagattagtcttgccttgggcgttttccccaataaagacattgatgcctggggaaaactcaacttgacggctctcataatttctaaaattccgcagctcgatttccgaaagatacattgattattcagctacgatctcaacgttttcaataccgctgatctcgatttgatcgccaacccgcagcttgcgaccccgacgagcctctgattcgccgttgactttgacttcatgttcacgcaaaaaccacttggcagctcctccagtgggaataatgccttcttctttcagcagctggccaagcgtaatgaattcactgctgattgcgactttttttgaattttgcatacttttcacctactttatgcttgctgttctattatagcttttataagacgtaaaaacaaattaaagggcatttttaggccgtatcagcaaatcttatcccaattaatcatttttatctaaaacaggttatctttgctcagaaggcaaattttagtgatttaagcgctatcttaaactagcgaatgatttatccaccaaatttcgctaatttaatcacttttccacaataaaaaaacatccactgtggataagtggatgctttttcaacagttttatttgaatcagtaagtccgaaccggcgtaatcagctgaacaaaattggctttttcttcagttggtaccaaggtaaatggccgcagcgccgtcgtaaatgaaatcagaatcttggtttgaccaaatgactttaaggcatcacgcatatagtcagggttgaacgagatttccaatgggttgcctacgatctggtcagcattgatttcttcttcaacgttaccaacatcagctgacgtgcccgaaaccgttgcaatcttgttttctgggttgacgctcagcttaacgacattgttgcggctttcatgagacagcagcgaagcccgttcgatcgaagccaacagatcgctggccgtgatctccaaacgcgtatcggatgattctggaatcaagcggctggtttctggatagttgccttccagcaagcgcgagtagaaatgcgtattgccaaaaataaacagggcttgattttcggtaatctgcatcttaacgccatctttttcatcggcaatcattttagccagttccgtcattgaggcccctggcaaaacgatgtcaaaatcacgatcagccgtttctggcaactcaaccttgcgttgtgccaaacggtgactgtcggtagctactgccgttaagatcccattatttaaagttacgtgaatcccagtcaggattggccgactttcttgtttagaaacggcaatccgtgtctggtcaataacttcacgcaacatgtcagaagctagttcaaccgtattttcactttcgacttctggcaggtgtggataattgttggcatcctgaccgttgatcgtaaattcagctgtccctgaggtaatccgcacctgcagaccattaaagacctcaatcgttgcctgcttgtctggcagctttttgatcacttcattaaagaagcgggccggcaaaacgattgcccccggttcttcaattgacagaccatagctgctgtcactggcatccagagttgattcgatcgtaatgtcagcatcactgccagtcaggatgacgctatgatcagttacgaccattttcagaccagtcagaatcggaattgtggttttagatgagattgctcttaagacgttattaagctgattaatgaatgctgggcgattaatggtgaatttcataaatgaatctctccttgttgctttatatatatattatataagtttagtagtagtaataggacctgtggataatgtggaaaactagtctgaatccaatagctataagttttcataactgtggaaaagctgtggatatcttggggataactttttagttttccacaatcaaggctgcagctccattctaaggttgcggatgtcgtcttgtaaattatcatcctcggccagctgtttttcaatcttatcgatggcatggagaaccgtggtatgatccttgccgccaaattctttgccaatcttaggcagtgagctttcggtcagctctcgggcaagatacatggcaatctggcgcggaaagacgatctgcttgacgcgttttttccccacgatatcagactgacggatattataataagccgcaacctttttttgaatcaagtcaatcgagattaccgcctcatcggcagcttccatgcccttgagcgtttcatttgccagttcaatcgtgatgggcgcgtgatgaagctgggcggctacgcgaactctcagcagcgcgctttccaactcgcggacgttggtgtcgaccttgctggcaataaagcttaaaacgtcattgggaacgttgatttgctcttcttcggccttgctgcgcaaaatggcggtccgtgtttctagatctggcgaggtaatctcgactggaactccccagacaaagcgtgagaccagccgatcagtcaaatcagggatctgcttgggattccggtcagcggtcaagacgatctgcttgttgttgtcatgcagcgaattgaaagtattgaaaaattccagctgggtgccttccttattggaaaagaactggacatcatcgaccaacaaagcgtccaggtcacgatactcgcgccggaactgctcttggttgttgtttttgatcgaattgatgtagtcattggtgaaggtttcgctggtaacgtatttgatcttggcgttgggattatgccgtagcatgttgttggcaatggcctgcatcaaatgcgtcttgccaaggccgacgccaccatagatcaagagtggattataaagtccgccaggctgttcagaggcagcataggcagaagcataggccatctgattgctgcggccttcaacgaaagcttcaaatgtatattctggatttaagggtgtctgtttggtcatgattccaccggctggcgaagatggagtcatgagctctctctcaagcgtgtagcgtggctcaatatgaaccagggtttcgttgaacagcaggtccttgagcttagcggtcatctcgttttgccaaaagtcccggtgagatttggttggcagctcaatggtcagctgattgttttcgagagaaattgctttggctggtgcaatcaggttgttataggttacgctgccagtggtcttgcgaaactctttttgaaccgattcccagagtgagtttagctcaatcaagtaaattcctcctcatgctaattaaaaatccaaagaatattttagcattgtctggtagttttccacaaggctgtgtaaaaactattaacaaaatccacagacatgttgataagttttccacaaggctgtggatttgtggaaaaagaaaagacaaaatcaagttaatcactggtgatctgtggataactttagcgaattaaaagcgtactattcatgttttcataattatccacagatatgttgataactttttccacaacctgtggggaactctttttgctttggataactctgtggataaatataaaagtccccagttttgttttggtacttgtggaaaaaactggggataactggccgcttctgtgcagtaaaaaacgctaaaataacgcaagataatcatttattcttggcgtaggatgtgttatacttcaaaagtatgtttgaagagattgtctttttggactgtaaataaaataataaatacaagcgaggaggtgcactcaatgaagcgcacatttcaaccaaagaagcgtcaccgcgcacgcgttcacggcttccgcaagcgtatgagcacgagcaacggccgtaaggtattggctcgtcgtcgtcaaaagggccgcaaagtattatctgcataaaatcggccactatttaattagtggctttttttctaaaaggggccggggcattcatccactgcattatgtgcggttgtgcctcagtcctttttgtatttttaaaggttggagcgaacatgcgaaagtcataccgagtaaaaaaggaaagtgaatttcagcgggtctttgaaactcatgattccgtagccaatcgaaaatttatcatctatcaaatgcaaaaaccaggtcagaagcattttcgggtcggcatctcagtcggcaagaaaatcggtaatgccgtacaccgcaattggctgaagcggcggatccgccaaacgctgctggaggttaagccggcaatcaagcctgacgttgacttcttgattattgcgcggccagctgctgatggcttggaaatggcagaagttaaaaagaatctggttcatgcactgaaattggcccatctgttaaaagaagattaagagaggatcgcactttgagaaaaggacacaagaaaatcctaagcctggcggggattatgagtctggcagtctttttggctgcttgttccaattcaccaattaccagccacagtaccggcttttgggatcattacatcatctataactgctcacgattcataatctggctgtccaacaattttggcggctatggaatggggatcatcatctttacgattatcgtgcggattatcattctgccattgatggtgtaccagaccaagatgtcggtcaagatgcaggaattaacgccgcagcttaaggagattcaaaagaagtatcctggacgcgatcgtgaatcactggaaaagatgcaggcagcgcaacaaaagctttataaggatgctggcgtgcacccgtttgcttcgatgctgcctctgctggttcagctgccagttatgtgggcattgtatcaagccatctggcggacgcacgttttgcgcagtgggagcttcttatggctgcagctgggccacaatgacccatactacgtgctgccgattttggcggccctgtttacgtttatcagttcctggctgtcaatggcttcaatgccggaacaaaatgccatgaccaaatcaatgacctggtttatgccgatcatggtctttttcatggcactgggctttagttcggcaattacgctttactgggtagtatccaatgccttccaggttctgcaggtactgatcttccaaaatccgttcaagattcgtcgcgaacgtgaagaaaaacaggctgctgaacgtcgccaccgcaacaagattgccaaggctaagcgcaaggcctaccgtagcaagcggaaataattgagcaacgagggcggcttgaccgctcttttttgataatgattgagggggagctttatggaaacttttgaggcgcagacaattgatgaagcaatcgcagccgcatcagctgcctttaaagccaatcgtgatcaattagacattcaggttttggagcagccgcggcatggctttcttggatttggccgtcggaacgccaaaattcaggctgaattaaaacggccggtgcagccgcaaaagccaatcgtaaaaaagtcggccgttaagtcccagccagctaaaaaaacggtcgtggtcaaaactgccaagccgacagacaaaaaacaaaacgtcaaaccggcagcaaatgattcaaatgagccagatgccttggaaatggagcatcgtcatcaagccaatgtgcagaagatgaatcaagcggccaaggcactttgcggctatctgaaagacgtgctggtagcgcttggggtaacggctaagcctaaaatcgtcaagctgcggactcatgaattggtcgttgatctgcaggccgacaattcaggacgagtcatcggctttcatgggcgacggatcaatgccttggaacagttgggaacggcctttttaagctatcatggcgtcgatgatccggggctgatcctggatacgtcgaattaccgtcagaaacggcagcagtcattggaaaaactggctgctcgctgcgtcaccgaggtaattgctactggtcaagccgtctttttggacccaatgccggctcgtgaacgcaaatatctgcaccacgtcttggaagacaacccgcgggtcaagacctattcgcatggtcgtgatccatatcgcagcgtcgtggtagcaccaaagaattaattgattgacaaccaaacgctgaaaaactaaaatagcgatgttaattgaatttaccgttagttagagtagtgaaagtgctttgaccatgttgatcccaagggggggagagcgtggactcggcactttttttattgcggcggaaaggagcagaaaatggcaaattcagaatttgatacaattgcagccatctcgaccccagttggcgaagggggcatctcaattattcggatcagcggcgaggaggccgttgccgttgccaaaaagctgtaccatggcagcaaggatttggcaaaggtggcaaccaataccattaactatgggtatatcgttgatcccgacagtggtgcggaagttgatgaggtcatggtttcaatcatgcgggcacctcatacctacactagagaagacgttgttgaaatcaactgtcatggcggactgctggctaccaaccggattctgcagctgacgcttagtcatggagctcgactggcggaaccgggtgagtttaccaaacgagcctttttaaacggtcggctggatctttcacagtctgaagccgtgatggatctgatccgcgccaaaaccgacaaatcaatgaaggtggcgctaaaccagctggatggcgatctgtctcgcttgatcaaggctttacgcaaggatattctggacgtcttggcgcaggttgaggtcaacattgactacccagaatatgacgcggttgaagaaatgacgaccaagatgctgaaagaaaaggcccaagaggttcagcagcgcattcaggcacttttaaaaaccgccaagcagggcaaagtgttaagagatggtctggcaacggcaatcattgggcggccaaacgtcggcaagtccagcctgctcaacacgcttttgcatgaggacaaggcaatcgtaaccaacgtggccggaaccacgcgtgacgtgattgaggaatacgtcaacgtagaaggcgtgcctttaaaactgatcgacacggctgggattcgccatactgaggatacggtcgaaaaaatcggcgttgagcgcagtcgccaggcgatcgatacggctgacctggtgctgctcttgattgacagttccaatgcattgaccgatgaggaccgagaactgatcaagctgacggctggcaagccacgcatcgtcatcttaaacaaaaccgacctgccgaaccgaatcgatctaaacgaactgcatcagctgacagctggtgatcgcgtcatcaagacctcgatcgttgagcatgagggaatggaagaattgggccggacgatcagccatatgttctttgatgaaggaatcgaaagctcgcaaagtaccgttatggttaccaacgctcggcatattggactgcttcatcaagccaatgacgccttgaatgacgttttgagcgggattgcagctggaatgccagtcgacttggttcagatcgatatgacgcggtgctgggaactgttgggcgagattaccggcgacagctatcaagacgaactgttggatcaattgttcagccagttctgtctaggaaagtaaaggagataaaaatgcagatttcacaaggtaagccgtttgatgccggcagctttgacgtaatcatcgttggagctggtcatgcgggatcagaagcggcattggcggcagcacgcatgggcaacaagacgctgcttttgacgatcagtctggaaatggttgcctttatgccatgcaatccatcagtggggggaccggctaagggaatcgtagttcgtgagattgatgccttaggtggtgaaatgggccaaaatatcgacaagacctatgtgcagatgcggatgctcaacacggggaaaggtccagccgtccgtgcgttgcgggctcaggctgacaagcacgcctatcaccgagccatgaagcagacgatggaagaaacgcctaatctgacgctgcggcaggccaccgttgatcagctggtggttgaagatggcgtctgcaaaggagtcattaccaataccggggcccgctattttgccaaggccgtggtattggcaacgggaacggcagcccgcggcaagatcattattggcgaattgatgtatgaatctggtccaaacaatacacagtcagctaccaagctgtccgagaatctggaagagctgggcttcgatctgcagcgattcaagaccgggacgccgccacgcatcaacggcaatacgattgattattcagttaccgaagaacagcctggtgacgaaaaaccgcatcatttcagttttgatacgccagacagtcaatacatcgcagtcactgatcagatttcctgctggctgacctacaccaacccaaccacgcatcagattattcgcgacaaccttgaccgggcgccaatgtttactggggtgattgaaggggttggtccgcgctactgtccttcaattgaagacaagatcgtgcggtttgccgataaggatcgccaccaggtcttcttggaaccggaaggccgcgatactgacgaatggtacgtggacggtatgtcaacctcgatgcctgaagaaattcaagaaaagatgctgcattctgtaaaagggttggaaaaagccaagctgatgcggccaggctatgcaatcgagtatgacgtggtggcgccatatcagctgcatccaaccctggaaaccaagctggtcaagaatctgtttacggctggccagaccaatggcacctcgggttatgaagaggcagctggtcaaggactgatcgcgggcatcaatgccgggctgcgtgctcaaggcaaggggccgttcgtgttgaaacgctcggatgcttacattggcgtaatgatcgatgacttggtaaccaagggaaccaaagaaccatatcggctgttgaccagtcgtgccgaataccggctgatcctgcgtcatgacaatgccgacctgcgcttgatggaaaaaggccacgcaatcggtctggtttctgatgagcgcctggcaagaatggaacataaaaaggccttggttaaagctgagattgctcgactcaagaagattcgcatcaagccaaccaatgaggcagccaacaacctgattgaggctcacggcgacaatcctttgaaagatgccatcgcggccgctgatttcttaaaacgaccatatgttgactatcagacactgatgaacctgattcctgatccagataaaccgctcagtcgagaagtgatcgaacaggtcgagattcaattgaagtacgagggctacattaaaaaagaagaggtcaaggttgaacggctgaagcgcatggaagccaagaagatcccggctgacctggactattcggcaattgatggtctggctactgaaggccgtcagaagctggagaagattcggcctgaaactttggcgcaggcatcgcggatcagtggggtcaatccagctgacctggcgattttaagcgtttatctgcgtcaaggacgtttagctaagcttaaggattagagaatatcttgaaggtgccttgggtttggattatcattaaggtttcagagggcgttttttataatcgccgttgacagtatcactaggaaaatatgaggatgattttaaagtgaatgatcaaattgatttccagccaattctgctgggaacggactttaactgctatggcatggcacgttctttttatgaagcctatggaatcaaaagcattgcctatggagttacgcacatggcgccaactcgctacaccaagctggctgatgtgcatgtaattgaaggctttaacgaagatccaggctttatcaagtcgatgcgtgagattgccaagaacttaaagccggataaaaaatacctgctgctgtcctgtggggatggctacacggaactgatcgccaagcacttagacgagctgaagcaatggtttgtctgcccatatgttgactatgacatgttccaaaaactgggtaccaaagaaactttttacgctgctgcggaaaagtatggcctgccttatccaaagaccaagctgatcgaggcggctgaatttacgaagccaaaagaaattgagctgccatttgattttccgattgccttgaagccttccgacagtatcgcctggctggacattcattttgctgatcgtaaaaaggcctatgtcttggacacgcgggctcagtttgataagctgctgcctgaaattgctcaagccggctataccggaaagctgatcgcccaggacttcattcccggcgatgattccaacatgcgcgtggtaaatgcctatgttggtcaagatcacaaggtacgcatgatctgccttggtcatcccctgctggaagatccatcgccagtggcagtcggcaactatatggtgatcattccagaaaagaacatggaaatctaccaaacgattcaaaagttcttggaagaaatcaattacgtcgggtttgcggactttgacatgaagtacgaccggcgcgatggcaaattcaagatttttgagatcaatctgcgtcagggccgcagcagctactactgcactttaaacggctacaatctggctaagtacgtggttgatgatgccatctaccatcgtccatatgaccataccgattatgcagacggcaacaagctgtggctgagcgttcctaagaaagtcttctacaagtacgctaaggaaggcccagataaggagcgtgccaagcagatgcttgaatcaggcaactggggtacgacggcctttgacaagcatgatacgctcaagcagcggctgctgatgcactacgccttttcgttaatgcctaagaagtacaaggaatacttcgtgcagcgctaatttagtcaagaacataggagagtcattatgtgtggaattgttgcatttgtggataatgaaaagccacaagtcaaagaaagcctgattcaaaaaatgatggaccggatcatccaccgtggtcccgatgatgccggccaattcgtcgatgaacacgcggctttgggacatcggcgtctaagtttcgttgacgttaagagcggtaagcagccgatctttaatgaaaacgaaaacctggccattttatttaatggtgaaatctacaacttccagccgctgcgcgaggaattgattgctgctgggcaccatttctcaaccaagacggacacggaagtcattctgcatggctatgagcaatggggcgatgacgtctgcaagaagctgcgggggatgtttgcctttgtcatctggaaccgacaaacccaagaaatgtttggggcccgcgatcacttcggcattaagccgctgtattacgccaagatgaatgggacgttctttgtcggctcagaaatcaaggccttcttggaacacccgaacttcgacaagcagctgaacaaagaagccctcaagccatatctgacgttccaatatccaattacccgggaaacgttctttaagggcgtctacaaactgccagaaggtcattcgttccactacaccaaggatggtcagttctcaatgactgaatactgggatgaagactttgaaccagccgatgaaacctttgatcaagccgttgatcggatcgaggctgccgttaccgaatcagtcaaggcgcactcttttgctgaccaaggcattaaagtcggttcgtttctttcggctggggttgactccagctacgttacggcgatgatgcggcctgacaacacgttctcaatcggctttgacagcacctacgatgaaaccaaggaagcacgggaactggcagctaagctgaatcttaagaatacggatgccaagctgaccaacgaggaagccttccataccttcccattgattcaatactatctggacgagcccgactccaacccatccgtcgtgccattgtacttcttgaccaagctggctaaggacaatggctacaaggcaatgctttctggtgaaggtgccgatgagctgtttgccggctacattgattatggcttctacaccaagtccaagctgattcgctggattaccgatcagctgaagaaaaagccgcggcaaaagcgctacgagattgccgaaaagcttaaaaacaagcatttccatggccaggcgcacatgtatgccaacctggcgccagctcgcgatacctttatcggtgaggcctacatctttagtccagaacaggctcaaagcattctgcagcctgaatttgactgtggtccaacggttaagcagatcgttgacccatactacgacaaggttgaagacaaagatattgatgaggttgccaaaaagcagtacctggatctgcactgctttatgccaggtgatattctgctgaaggccgataagatgagtatggccaactcgctggaactgcgggtgcctttattggatcgggaaatgatgaaggttgctcagaccacgccaaccaagtacctgttcaacgctaagggtaccaagtgggctttccggatggcggccaaccgtcacctgccagaagaatgggcaacgcggcctaagatgggctttcctacgccaattcgggcctggctgcgtgaagacaagtactatcaagaagttcgcgaattgttcagccaggattttgtcaaagagttctttgatcaagacaagatcttgaagatggccgaagacaacttccaaggcaagacggacgaccggcgcaagatctggaccgtctacacgttcttggtctggtacaagctgtactttatcgacaacttcaagccggatgaatctgcaattgatcaaaccaagcaaaaggcggcgaactaaatgctgacggttaaacagacggtagccgctctcaaggaacgggacctgtttaaggaaatcatcgttgacggtcagtggcagtatgacgtaccggaaaaaattgctgatgttgagttcaagcagctttcgtatgactcgcgtgtaattgagccgcagacgctttttatctgcaagggacagcgctttaatccgcagtatctggtggatgcagtcaaaaaaggcgccacggcttgtctgactcagcaggtgtatgatgaggagctggctggtcagaccgtctggcagcttgtcgttactgatgtccaaaaagccatggcgacagtcgcacgggcattttatggcgatccggaaaaagaactgacgctgattggctttaccggtaccaagggcaagacgacctcagtctactttacgcggcatattttagcgcatgtctttgacaatcaggtggcgcagctgtcatcgattgccgaatgtctggatggtaaaaactttattgaatcgcacctgactacgcccgaatcattggatctgtaccggatgatgcgtcaagccgttgataacggcatgaagtatctggtgatggaggtttccagtcaggcttataagaagtcgcgcgttgatgggctgcattttgacattggcgtcttcttgaatatttcgcgtgatcatatcagtcccgttgagcatccaagttttgacgactatctttggtgcaagagccagctggtaaaaaatgccgataaagtaatcatcaaccgcgagatcccttactttgagctgctggcccaaaagacgcgtgcattcggcaaccagctgattacctatggcagcgatcaatcagatgccgattatcgctttaccttaggcgagcatggtcatttccaggttgcttcgtttaatgaccagctgccgacagttgcaggcgattttcgggtcatgctgccgggatcgtttaactgcagcaatgcaacggcggctttggcagtcgccgcgcagctaagcgataaaaccagtgagtttgcggcgggacttttagaaaccaaggtaccgggccgcatggagatcttaaagaacgaaaaaggctatgtggcttgtgttgactacgctcataactacctgagcatgagtgagagcttcaagttcttaaagcatgagtatccagacggccgcttgatcgtggttaccggttcagtgggcagcaaagctgagtcacggcgccaggatatcggtcgcgcactgtcagagtatgccgacgtggccatcctgactgaagatgacaactactttgaggatcccaaaaagattattcaggcaattcgcgatcatatcgtggatccccacgttgaggttcatgagattcttaaccgtgaagaggccattaaaactgcctttcagatggcgcggccgggcgatgtcatgtttatggctgctaaggggcgggagcagttcctgcgcgaaaatggccatgacaagccttatgtcggcgattaccagctgacagagcagttgatgaaagcgtataattaaatatgactgttagggaagtcgataccttgacagttaattgaagataaggtccagtctgcggtgcgtttgcagactggaccttattgtcgtttttttaagacatcttaaaagcaagttcttgatgctttcgttgggatttcgcattttttttcataatcttgtgtcagaatacgaaacatgatcgaaagacaatgaacgtttaaatgaaaggtgggggagaaatgctgacgcttaatcaagctgccaacattttaaaacaggatcaattgctgcgtgaaatcgtaatcggtgatgattggcgcttcgagattccagccaatctcaaagatcgcaggctccaattcttatcttatgattcgcgccgcattgcacctgatacgctgtttatgtgcaaaggactaaacttcaacgaaaaatatctggaggacgcaattgataagggagccgttgcctgtgtgactgaaaacgtctatgccggcaaagaccagaagcaagtcgtgcagctggtggtcaatgacgttcaaaaggcaatggctctattggcgcgcgagttttacaacaacccgcaacaggaactgaaagtgattgggtttactgggaccaagggaaaaacgacttcggtatactttgcccgccatttgatgaatgaggtttttgatcataaggtagcccaattatcctcaattgctgaatgtcttgatggcgagcattttgaagaagctcatttaacgacgccagagtcactggacctgttccggatgatgcgtcaggctgctgacaatgggatgcagtatctgattatggaggtttccagtcaggcctacaaaaagtcacgggtctatggactgcattttgatatcggcgtctttttaaatattgccgctgatcatatcagtccggtggaacatccaagctttgaagactacctgtactgtaagagtcagctgatgctcaactcatccaaggtgatcatcaatcgtgagtgtccttattacgagctgttggcccaaaaagcgctggctgctggcaatcaggtaatctcatttggcagcagtcagtctaatgccgactatcgttatgtagtcgattcgccgcatgagtttcacgtggcgacgtttagcagtcagcagccgcagttgactggccgctttaagatcaatatcccaggtacgttcaatgacagcaatgccttggccgcgctggtcgtaggacggcagttcagtgatgatacggcggcttttgccaagggactggaaaaaaccaccgttcctggccgcatggaaatgctgagcaatcagcggggactattggcctgcgttgactatgctcataactatctgagcctgaatgaaagcttcaaatacatgaaaaacacttatcccaatggccgtttgatcgtagtgatcggtgcggctggcggtaaggctgagtcgcgccgtaaggatattggcgaggcgctggccaaatatgctgacgtggccattctaaccagtgaagacaatttctttgaggatccgtacaagatcgatgaagaaatcaaatcacacattgataatcctgatgttgaggtacatatcaacgttgatcgcgccaaagccattcaagatgcgtttaacatggcacggcccggtgacgtcatgtttatggctgccaagggacgcgagcagtttatgcatgaaaaaggccatgacattccatatgttggcgattatcagctgacccaaaaattgatgcgtgaatatgatgaataagttgttagttgctggtaaagtgtattaaaattgccgttagaaaactaatctgggagcaattttgatgaaagcttttaaagaattaatgagttggatcgtgccgattgcgattggtctgctgctggcattgctgatcaagcagtttgcttttcagtttgtccgggttgatggtccatccatgcagcctaatctgcaaaacaacgagcgcgtggtctgcttaaagcaagccaagattcatcgcggcagcgtagtggtttttgatgccaatggcgttgatccgcaagtttcagtaaaaaccgagtacgtaaagcgggttattggtctgccaggcgatacggttgaggccaaaaacggcaatctttacgttaacggcaaaaaggttgatcaaagctacatcagcaagagtgagcgctccagtggtaccggaacctggactttgcacagtatttcccaggaaaacagctgggtgctgcataatggggcctacaaagtgccaaaaggcgagtactttgtcttgggcgatcaccgcagcgtctctaacgacagccgctactggggattcgtacctaagagcaagatcgttggcgtcgtcaaggtaggtttctggaatcgtacgcagccggctaaaaacaatatcaatcagcaatggaagcatttctttgccgataactaacaatgagcagcgttctttggcaaaggcgctgcttttgagttgtcgataattttgctttagaatgattcacaaaagactgtaagtgaggaagattcaacatgtcagagtttgaaaagttaacatcgcagcagctgcagggctacgaagccgatttcaaacagcggccagatgctgccgtaatcgcgcgagtcgtgatgaaaaatggcatcaaggcagccagcgaggatcaaaacgtcagtcagcgcaatcaccgcgttttttcgtatgaagtcaagacgggcaaggtatccaatcagcggcatagcggtcgctgctggtcgtttgccacgctgaacacgctgcggcatctttttgccagccagtacaacttcaaggattttgaattatcgcagaattatttgtttttctgggatcgtgttgaacgggccaatatgtttttgcaaaatatcattgctacggccgcactgccatttcatgatcggctggtcgatttttatgtggcatttgcggaaaatgatggcgggcagtgggccaatgctgcctcgatcattgaaaaatatggcgtcgtaccggaatatgtaatgcctgacacctacaataccaagaatactgacgatattgccggggtaatgaaggatctgatgcataaagacgcgttggtgctgaggaagatgatcaatgagcagcatgctgatcgggctgcggttcagcaggtcaaagaaaagatggtcagtgaggtctatcggttggccgtttatgcttttgggatgccgcctaagcagtttgatctggaatatcaggatgacgatcatcagctgcatcggcaggccaatctgtcgccgctggagttctttcatcaatattggcagctgaatctgcgtgactatgtagttttgaccaacgcaccggatcataagctcaatcaggtctactcaatgccgcagcaggaaaatgtcgttggtggaatcccgctgcaattcgtcaatgtgccgtttgaagaactgcagaacagcgcggtcaagcagctgaaagcaggagaaaccgtgtgggtcggcaatgacgtcttacagcagatggatcgcaagcggggcattatggatgctgagctgtacaaaacagaagcgcttttgggcattgactacgtgatgaataaaaaagaacgactggaaaccagacaggcctgcgtttctcatgccatgacgctgactggatttaatgaggctgacggtcagattgatcgttggaagattgagaattcatggggtgaggaaaatggcgaaaaaggctatttcgtcatgacgcaaaaatggtttgaagactatacctatgaagccgtgatcaacaagcgctaccttagttccgaactgctgcagctgactaagcagcggccggttcaactaacggcttgggattcgctacagtaaaaaacagccctgatcagaatttgatcagggctgtttgcgcgtcaagaaatgcctaaagattaggatccatcttgaaggtcagcttggacagttcagctcccttggtcagcaggtcaaacaggtgctgctgtgcacgggtgttaaaatgcttggcgatatcatgattctgcgaggtcagatagctggtcagccgttgcccgtcaagctgactgatctggtcatcgacagctttgatcttgcgtcttgcccaggcctgcagctcatcttgaaagtccagattgtccttggcaaattcagcataatggctttcaacgacgctggccagggcctcatttagccaataggcattgttcagatccattttttctggaaactcgcggtatgaggcatcggtatcatcggcgttggcaaagaagggcacataggcgcaaaaagtcgggacaccgaactcaacccattgaatggcctgagcggcaccatatgaatcattgcgtgcctgcagaatatgcgattgtgccgtacgggaaagcgcgattgaacggtagcgccgccgctgctctaaagtaccgctgcccaagggatcatagggtgtttcattgtagtgtgattttaaaacgtattgaatgtcttcaacgctgattttatgatcaggcttgcgaataaaaggcatatcagctgactcgggcgtttgatccttggtcagactgggactcagatagtgctgggcaaaccagacgcggggcgtattgtagtggtggtcctgtttggtattggtgccgaagatatgccgaaagttccagcgctcatcatcgggattgaggtggttcttttccacaaatggtcgaatgccatctgcccaggcaaaattctggctgtcgccaaagtcaatgtcttcaatggcaatctgattggccgccacggcatagcagtcatcaggaatacgcacggcaacccagtagtggccagtagcaatttccatgtaccagacctcatcttgatcaatgaactgaatgccgttgccttccgctgaaccgtatttggcaatcaatcgtcccaaatagtcaactccttcgcgtgccgaatggatatagggcaaaaccagggttgtcagtgaatcttcggccagaccgtttttgacgtatggatcataggccagcacctttggattggcatagacggattccgtggcactctcaccaacgccagcctcgttaaagccatcctcttcgttgggcccctgcgtctgatcaacgcttggcgtggccgtatagcgcatactgtcagctggcagcggcacggtcaattgattataagctgagacataggctgcctggcgattcttgacggccggccgaaccaggaagcgtttgggctcaattgccttgacgcgatcctcattgcgcgagataaaagtagagccatcagttgaagcatgcttgccgaccatcattgacgtgcaggctgaatttttgaaacgattccatggagacatttgattcgcgacctttctgatttgaaattttccctattataacgcgtttgattctaaaatgatgaaaaagatccatcttatcatctaaacggcgaaaaaaagcgcttaatgaggctgagaagataataaaaagctgtctggcatctgccaaacagctttttgattagtcttcgcgtgagtaggtagcaatatcgtgcagaatttcatccatgaaggcatctacagtcatgccgttttgatccttttcaccatacttacgaacggaaactgagtcgttggccatttcatcttcaccgacaaccagcgtgtatggaactttttgcgtttgagcttcccgaatcttgtagcccatcttttcattgcggtggtcaaccttagcccgaatctgagcggccttgaacttcttagccagttcgtcagcgtaggcaccgtgcttttcatcagaaactgggatgattacgacttgttcaggtgacagccaggttgggaaggcacccttgtagatttccgtcaggtaggctacgaaacgttccatcgtgccgacaaccccacggtgaatcataactggccggtgctgcttgccgtcttcaccaacatagtgcagatcaaacttttcaggcagcatgaagtccagttgaatcgtggacatcgtttcttcgttgcccagggccgtcttggtttgaatatccagctttggaccgtagaaggcagcttcaccctcagcttcgtagtagtccagacccagtgagtccatggcagccttcagcatggattgcgaacgttcccacatttcatcgttggcaaagtacttttccgtgttcttagggtcacggtatgacagacggaacgtgtagtcggtaatgtcaaagtctttgtagacgtccatgatcagtttcagaatcttggcaaattcgtcttgaatctgttccagagcaacgaacgtgtggccatcgttcagcgtcatttcccgtacccgctgcagaccggaaagcgcgccagacttttcgtagcggtgcatcatacccagttcggcaatccgcagtggcagttcacggtaggagcgaatgtggtgcttgtagacttgaatgtggcttgggcagttcattggccgcagttcaagcatttcgccatcacccatgtccattggcgggaacatgtcttcgcggtagtgagcccagtgaccagaagtcttgtaggcatccaggttcatcaagactggcgtgtagacgtgctcatagccgtcagccagttccttgtcaatgatgtagcgttcaatcgtccggcgaatcgttgcccctttaggcatccagtatggcagaccggcaccaaccttaggatcaacgaagaacaggtccagttggttcccaatgacgcggtggtcgcgttccttggcttcttgacgagccttcagatcagcttccagatcgtcttttttgtagaagaccgttccgtagatccgctgcagcattgggttggatgacatacccttccagtaggcgccagccacgctgagcagcttgtagttcttaaccaggttggcatataccagaactggtgcattggcaactgccagcacgccatccagatcatacatggctaccttgccgtccttagcgttttcgttgatcagttcggttgagaatgggtcgtccttgacgctggccagggcttcttcaacgctgagctctttaaactcaaccttggcttcggacttggcaattgccttgatggcagcttccagttgtggcagttcgtcagcggaaacctgctgttcgtctttgtcagagtcaacgtaaaaaccgtcttcttcagcaacgtcggcacccagacgaataccggcaaattccttttgcagagccgctttcagcatcagagcggacagttgacgcagggcgtccaaactttcttttgagtcgcggtcaatcttgttgactgagccatcgacgttcataacagcaacttgagccatgtaaaatctctcctttgtggtaataaaaaacgtccctttgattgccaaaaacaatcaaagggacgttggttgttaacataatcagcgtggttccaccctaatttacggcgcactaatggcgtcgcctcataagtgtggtaacgggcacgacccgactgaccttatctcggccagtgacaattcaaaaaggtggtacgctgatgtgcttggtcaacggtacttccagccaaggtaccgactccctggataaccagccgcatcaggcatgtcctttgtcattagtttgaattatatgcacctgacaagagcgtgtcaagaccgttttataaatctgggctattgtgcagtattggattgaatcgggccaccgggatcgccgctgacagattctgaagacgtattgttgttggaagtagttgaactgctgttgccgttgctattgccagagttaccgtagtttccgccgccttgatagctgctattgccattgttggttgtttggttattgttgttggcagttgtttgactggatgagctggccgccggagcagatgatgaattcgtcgtagtgtttggtacgtaataggaatcctgatcattggtgtcgtaattggcttcataagatgagctggaagaagaatgcttctttttgtgactgctggacttctttgagctgctggattttttcttagaagacgtagagacggtcgtatcactggaattatcggttacggggtcctgctgcttgacggcaaagacgatgaccatgacgaccaagacggccaaaaggattcctagggcaattttaaatgggcgatggctaggctttttgttttttggctgcttgtttttgcctgatttagcgcctaagccggttattttggcggtacttgcctgaccattgcgagcgcccagccgttcctgactacggctggaacgcgtgttgctgctgattggttgagcgttcatgctggagcgcgtaccattagtggttggctgagctttgatattcagatctgcattgctctgtgatgagcgcttggcttgcttatcaagcttaaatgttggcgcagcttcttttttagccgtacggtcggcttttttatcgaagaagaaatgcgtctttttttctgggcgcttgtttggttgatcatatagttcaacccgggttgggcgccgcttttctttattatcgtggttgtccaaaatattcacctcaaaattattttggccgcgcagtcagcataacgcggctgatgcctaaacacaggctattatacaccaaaaatatcaaaaaccgctcgaaccaaggcgttcaaacggttttttattgataaattaaaatatttgttttgttaatcttgactggctggcttttgaccatccttatgttcccaaggatgatggataccttctgcaacgagccgcttgttgccttggtacatgtcatagattgtccaggccaacagcaagataataacgacgattgcaatccaagccagcatgtcggccgtaccctttttccagataccaaagccttcaaaggtgcttggcaggttgtagaggttcaaaaacgtcagtgcaattgttgagatccagccacaagccttgacccaacccgtgtttctgaactcacccatttcatctttactgtcggtcatcaagagtaatggcagcatggagaatggcaaggcaaaggccaagaagacctgtgagttttccatcagcatgtttaacgcagcgtgctgttggatagcattgtccttagccgtcatcgccacacacagcagtactggtacaacggagattaaacgggtaaccagacgccgtgcccacaaaggcatcttcatatgaacaaagccttccatgataacctgaccagtcagggtaccggtaatcgtagaattttgaccagatgccagcaaggctacggcaaacagtgttgacaacagaccagatttggcaaccgagatcagaatcgggttgctcagcatggaagtgttgtttaaggcctcgtacagaccaaagaatgacgtatccttaaccgtaccagacttaaagacggcaacccccatgatcaaaagcagacagttaaccaagaaggcagctgacagctgaatgttggagtcccaagcagtaaagcgaatcgtctgcttgatgtcctcagcattggtgtggtcgatcttacgtgtttgtgaaattgcggagtgcaggtaaaggttatgtggcataacggttgccccgataattcccaaagagccagacaaaggcgtgatgcctagtcgttctggacttgttgcaacggcagccgatgaaggcagcagaccagcaaaagcagcgccccagtttggatcggatagtgcaacttcataaacaaagacgaacaggataactaaaatcaagcagacaacaattgcttcaatcttgcggaaaccgattttagtcaacagcagcagaaccaagacgtccaatactgtgatgaagaccgctggaatcaatgaaatatggaataaaaggtttagggcgattgccgcaccaataacttcggcaatatcagttgccataattgcaagctcggtcataatccacaaaacgataccgagcgccttccctgtacgagctcgaatggcttgggccaagtccatttcactcacgatcccaagtttggcagccatgtattgaagcagcatcgcaatcaaacttgaaatcaggatggtcgtcattaaggtataaccgaatgcctgaccaccagtgatcgaagtagaccagttaccaggatccatgtagccgacagcaaccaatgcgccaggtccggaataagctaaaagtgtcttccagaaacctttacctttaggaacttcaacggtgccgttgatttcttcaagtgatttgccgttagcatactcgatcagtttgtgcttgcggcgttggtcattcgtgttgttatccacggtaaacccacctttcttaattgaaaatttgcattacccaataaaaaacgtttaatgcaataaaacacctttgttaggctaacataaaaattaaagtcctgcaatggaagaatgcctatctaacggtattttacagcaattttacattggcaatcaaatgatagcgatcttgatatgcttaatattgaaacgcttacgattttttgtcgcgaaaaattcaaaaaaattaactactgaaaatcaagcgttatcgtatagttaaacgatcgcttaatgtcaaacgattatcaaaaatagtgataaccggttgacatacgattgagacctggattatactattggcaaaatttaaattaatgttttcacaaagaaagaggtataaatcgatgaaggcacttgtattacaagggattaaagatcttgccgttcaagaatatgacgttcctgaaatcaagccagatgaagttttgattcacacggcctacgctggtatctgtggtactgacaaggcactgtacgctggtctgccgggttctgcttctgcagttccaccaatcgtacttggccacgaaaactctggtgtcgtagccaaggttggcgatgccgttaccaatgttaaggttggcgaccgcgtaaccgttgaccctaacatctactgtggtcaatgcaagtactgccggacctcacgccctgaactgtgtgaacacctggacgcagttggtgttacgcgtgacggtggttttgaagaatacttcatggcgccagccaaggttgtctaccaagttcctgacaatgtttccctgaaggctgcagccgttgtagagccaatttcttgtgcaatgcacggtgttgacctgctgactacgcacccataccaaaaagcactggtcttaggtgacggttttgaaggtcaactgtttgctcaaattctgaaggcacgcggcattcacgaagtaacgctggcaggtcgctctgatgaaaagctggctaacaaccgcgaacacttcggcgttaagacgatcaacacgaccaaggaagaaattccagccgatgcttttgacatcgttgttgaagccgttggtctgccacagacgcaagaacaatgtctggcagccgctgccaagggtgctcaggttctgatgtttggtgttggtaatccagatgctaagttctctgtcaacacttacgatgtcttcaagaagcagttgacgattcaaggtgccttcatcaacccttacacgtttgaagactcaattgcactgctggctagcggcaaggttgatccactgccattgttctctcatgaactggccttcaatgaagtagaagactttgtcagcggtaagctgggtaaggtttccaaggccgttgtcaaagttggcggcgaagaagcctaactcacttagataaaatgttcaaaatagtcgtcaaaatggcggctgttttttattgtctaaagttgacacggtgtcactatcgcggtatgatcacatagtagttgacacggtgtcacttaattaggaggggggaattcagatgccgaccagtacttttgaaaatttaaatcatgaaaaacggcaaaaaattgagcaggcactgctgcatgagttcagtgagcattcactggcaatggcacaggtagcacggatcgttaaagaggctgaaattgctcgtggtgcattctataagtattttgccgatttaaaagatgcctatcagtatctgtatgccaaggcaatgcgagatattcaccaaaacgtggcaactacaccgcatcagttgatgagtgcccaggattattttgaacagacgcgtgaattcgtccaaaaggtccatggcagtcgctattatgatctgatcaagcttcatctgcggtgcaatgaaggaatgctgccgctgcgcccggtctcaaggattccggctttgcagtggaccatcatgacgatcaatcatgaggcaatcaaggagtgtctgaattttcccactgaacagacaatgattttacagcgcttgttgcaggctctgcagcgcttattagaaaacgaaggtgattaaaatgtttctggccgttaaggaaattcgtcatgagaagttaagatatggtctgattattagcatgatcgtcttgatcggttatttgatgtttatgctgatgggcatgatgctggggctggccaatgaaaatacggccgcaatcgattcatgggacgccaagagcgtggttttaaacaaaaattctaatatcagcctgagtcagtcgctgatcgccaagcaggatctgcctaatctgaatggtcaccaggcattagtcggccagacgccggcagtgattgaaagagccaagggagcgactgacaagcagacgattcagtttgttggtctggacagctcgcagtttatctaccaaaagaaaatgaagctcagcagcggtcacaagccacacggtaaaaatcaggtcgtcctcgatgaaggattaaagagtaaaggctatcggttaggcgatcagatcacgcttaacggcagcacgcaaaaatatcgggtcgtgggttttgccaaagatgccaagctgaatatcgcctcaatcgtctatggcaacctgacaacctggcaaacgcttaaaggaacgggtgatcagttcgcggccagcggaattttttctgatcagaagcagacggtcaaaaataagaatctcaagcaatactccatcggtacctttattgaaaaactgcccggctatgcagcgcagaatatgacctttgagtttatgatcgcctttttgatggtgatctcgctgatcgttatcaccgttttcctatatattctgacgatgcaaaagattcctaactatgcagtcttaagagcacagggaattccggcagcttatctgatcggggcaacgattggtcaggcggtgatcttgatggtcagcggtacgcttggcgcattgctgctgatgatcgtttccaaggcagcaatgccaagttcggtgccaatgctgatcaattggccgctgactgggatcttgagcctggcgttggttgtattaggcgttgccggctcattactgccagtccgcatgatcagccgaattgaccccttagatgcaatgagatagaggtgagcaggatgacggcaattgaattaaaaaacattaacaaagactatgggacgggcatcagcaaggttcaggtgctttcagacgtcagcttcaaggcgcacagtggcgaactaagcttggttttaggaccctctggatcaggcaagagtacttttttgacgattgccggtggcttgcagcgtccaaccagcgggcaggtgctgattgatggtcaagacatcagtcgattttctgaaaagcagcgagacgagattcgcttaaatcaaatcgggtttgtactgcagtcctataatctgctttcctacctaagcgttgcggatcagtttgccctggttgatcgcgttcataaaggaaaccttagtccggatcggcttgagaaactgctgcaggaactggggatcgatcagctggtcaacaaattccccgatgagctttcaggcggacagaatcagcgggtcgccattgcccgtgcgctgtataccgatccggcaattatcctggctgatgaaccaacggctgccttggatagtgagcgggtcaaggttgtaggacgcttgatgaaagaaatggccaagcagtatgacaaggcagtggtcgttgttactcacgatttgcggttaaaggattttgctgatcgcatctatcagattatggatggcaagatgaccgagcagccattgaatgcttagataactgcagattttatattaaagcgcattataccggtcaatggagtaatgcgcttttgactttacaggctgacaagaataattgcccgaatagactggatcttttacaatttgagagacagtttttgaagacagcagaatgtaaggagtttgttatggcatatttggagcttcatgatatccataagtcatatttcctgggaaaagaagagtttccggttctaaaagggatcaatcttgaatttgaacggggagaatttgtctcaatccttggagaatctgggggcggcaaatcgacgctgatgaacatcattggcggactggatcgtgaatttgatggtgaagtcattgttgatggtcaaaagctggatcatcggcaggaaaaacagatggataactatcggcgggcaacgattggctatatctaccaagcctataacctgatcgcgcatttgacggttttagaaaacgtactgatttctttggatatgacggacctaacagcagaagaccgcaaaaagcgtgcagtatcgctgttagaaaaagttggcttgaaagatcagctgcgtaaatatccgcatcagctatccggcggtcaaaaacagcgcgttgccattgcccgagccttagccagcgatccacaggtcattatcgctgatgagccgactggagccctggatcggcagaatacgcaggaagtattggaattgctggacagcattgctaaagacggcaagctcgtgattgcggtaacccactctcaagacgttgccaaccacgggacacggatcgttcatttggcagatggcgttattgatggcgatcagcgcttgcggccagcctatgatctgccgcaggacccaacgcagcttaattcgcgtccgttaccggcattggccagctttaagacggcttttaagcattttaaatataatttttggcgcaactcgctgattatgctgggaacggcgatcggtttgtttgccgtgctgctgttcagtggtctgggcaatggcgtcaacggctacattgaaaatcagatcaattcgctggctaatccacaggttattacggttctgcgcaataccaacggcaaaaagatgaatcaggatcagctgcaggcttcaatgcagaacatggcagccaatccacaggcaatgtttttgaaaaatcaagacttaaaccgcttgaaaaatattgccgacgtagcaaaggttcagccggggtactcgattgcggcttataagataaattatcaagacaaggtgcaaagcggtaccaaccttaacagctggagcaaggcctataccacgaactcaatcaaaaaaggccacgtaccgcatgccaatcagattgttttaaataagcagcaggcgattcagctggccggcgcaaaacattatcagcgcttgttgaatcaaaccgtgacgatcacgtttaactgggtcaatgctgacggccaaccaacgcagtcaacgcgggccgtgaaggtagtcggctttacttcgggagtttcggcaaccacggcgatgagctatcagacaatcaagagcatgctcaatgaaagcggcgcgtcaacgcagcccaactatgctgccgtcagtgtgaaatcgctggaccgggttgataagacggcgactaagatcaataatctgcgggatataaagaccaacaagcgaattttaggcgccattacggttggttcgatgcttaagacggtcaacacctacgttcagctggcaacgatcgtcttggcagcaattgccgggatctccttattggtatcggctttgatgattatcgtaaccatgtacatgtcggtttcagaacgaaccaaggagatcggcgtgctgcgggcattaggtgaacgcaaggtggacattaggcgtctgtttaccgctgaatcactgtttatcggctttttcgcagcgattttggctttggtcctggcgtatggcgagcagctgatcttgaatcatgagctgtaccacttgatcaagtacgatatcgttcagatttcactgggcaacgtcttgtttgctttggtcagtgccttgctgattgcttttctggcggccctattgccagcccggcgtgccgcaagattaaatccaatcaaggctttggcggctgattgattgcataatattcaagcaccagctgaaaaaaagccggataaaaacggcagactggcttttaagtgctttcaattcatagtattataaaagcagtgaattattatgcatgttggaggggtacaatggatcgtaaagaaagacgtcaattgattcaagaactggtaacgcagcagcggatcaacacgcagcatgatttgttggcaatgttggctgagcatggcattgatgctacccaagccacgatttctcgcgatattcacgctctgaacatcgtcaaggttagtgatcagcatggacatacctactattcaatcctgcatacccatgcggatgaatatcagcggctgtttgatggcatcagtcacaacgttgagaaggtcaccaacgttcaattcatcaatgttattcaaacgacattgaactccaattatgcaaccgtactggcgggcctgttcgataatgcgcagcttccggaagtcgttggtacgcttgccggtaatgatacgcttttgaccatcagcaaaaataatgaggatgctcaggcaatcaatcgtttgattaaagagcacatgaccgaagactaaaaaagcgcactggattttttccagtgcgtttttttatgatgatttaacgattttttcagcatgactgacgacatcggcaatcaaagtcatgactttaggatcctgtaaatgatagatgatggtcttgccatgccgaatctgcttaaccagcccatatttgcgcagcagctgcagttgatgagaaacagctgactgttcccagtttaaggctttgctgatttcggaaacgctcattgaatgctgaatcagcagatacagcagctgcagtcgtttaggatgtcctaagagcttgaacaaacggctgatttcatccaggtcttcgatttccattgaacggtaattgatcacaacaccacttactttcttggtaacgatgtactaaatgttatgctttcaataataggtcgctgccatttaaaattcaagcagcgtaaacggcgtgccaaacgttagacatgattttggtaaaacagccagacggaagcgaatccgactggctgttaagcttcaaatacgatgaatttacaggctcagcttctgaccaacgaaaatgacgtttggatcgctgatgccgttttgcttggccaacgtctgccagtttaagccattagccaaagcgatgccgtaaagcgtgtcgccggacttgaccgtgtagctgccgttgctgttggttgaagaagcagcttgagaactggcggcagttgccgttgcgctgaccttgattacctgacccacgtaaatgtcatttgggttgctgatgctgtttgttgaggccagtgcctgataggtcgtcccgtatttggcagcgatggcagacaatgtgtcgccagccttgaccgtgtaggaagcggcagtcgttacagtactgtttgctgaagaactggttgagctgctggtcgaggtatttgagctgactttaaggacttgcccgacataaatcaagttgggattgctcaatgagttcagtgaagccagcgtgctgctggaagtactgtagcgagatgcaatggcagacagcgtatcgccagccttaacggtatacgtaccggcagtcgttgtagcagtcgacgatgatgacgatgacgagttggttgtctggctgtttttaagcttcaagacctgaccaacatagatcagatttggattgctcagctggttaagcgaaacgatctggttaaccgtcgtattatactggctggcaattccagacagcgtgtcgcctgatttaacggtgtagctggcagctgatgcttccgtattcgtcgtagtagaactggactgaccagaggagctggagtttgagttgctgctctggttgaccagcaggcgctgtccgacataaatcaggttcggattagaaatgctgttcaactgtgccagcttgctggaagtcgtggagaacttcaaggcaattccagacagcgtgtcgccgctttgaacggtgtagtagccgttggagctgtcggcattgccactgttggagtagttatagtcattcttgttgttgataacgggctgcttgccagaaaaggcgatgttgtcaagctgagtcagattgtacatctctaccagcttgatcaaagatgaggcatatgatggatcggtagcatagccgtctgcctgcagcttgcgcgctacgctggcataggactgatcgtccaacagattggcgtagcggctgttactgtaaaggaagttgccgtgatcttcaacggattcagagttgttggcgtatttacggaagttgtcatagatgtagtagctttgaccattgtagacttcccgcgtctgcatcgtaacatactgaccgttgtagctgcccttgatcccaaacaggttgtgagcttgagtggaaagtgctgattgtccccagccgctttccaagatagcctgggcaacggtaactgaaggtagaacgccatacttggtccagccgttgatggcaccttgcgctacgctttcgatgaagttttgcgacttggcattgctgctgaagtaaagcgagctcaagtcgacctgattgctggcagtgtcggtattggcagccgctaaagttgtagttgcggcggcggcttggctggcactggatgcagcatcactggtctgagtggcagccgcgctttgaaccgcattgctggaactagcagcgctgacgctggatgcagcagccgtagctgattcagcagctgagctggcttgaatggcggtgctggcaacggcgctggtagctgaagcagaactttcggaagttgcttgagcactagcggtactttcggcactggcctggctggcgctggtctgactggctgctgagctgtcagctgcagaactgctgtcagaatcttgactggcatccgagccattggcactgccagagaccgtaatctgatgagtggtttgatcagtctgatcggcgtgggcaactgagccggccgccgtcagcatggttaaagcggcgatgctggcaaagacccattgccggccgctcttgtacatcttataatgctgatgcgtttcgtcgatgattggatttttcatacgtgagcatactcctttaaaaactagctgatcagtggttaagtcggctatatatttagaatttatattttttaataattcgttaagaatagcagctaattaaaaagtagcattcacaacgggttacgtcaattgatttttaaatgaaaacgaccaaaatctactataaattaatagacttttatgcttgagaaatttcttcactgatcgcactattaaacaaagaattactttttgactattaaaaatatgaaaataagatttaagagccgcgaaagcgattcaaatctttttgataaacgattgacaaaagaaactaaaacaagttaaaataatcctcgatgaaattgataaacgtttatcaaaatgtctgttgagaacgttaaatacaacttttaggggaaaacaacatggacaacaaaaagtcgattgtgacgaaactggcttttctgtcggtttctttcatggtgaccagtgcgtacgcgattcagggatcgctgccacagttgaaggcggctttgcatatcacgcaaacgcagtctgaatacctggttaccacaccatcttttgccgttatgatctttgtggtgctttcaccgctgctgcagtcttggttccacatttctgataagaagatcatcatgctgggggtcttcatcgttggcctggctgggctggtaccaatgtttgtcaacaactatggcatcgtcttggcatcgcgattggtcttaggggctggttatggtctctataactcgcaggccatttcaatgatctcagtttggtatgaaggcaatgagcgagctcaaatgctgggctggcgggcagctgctgaacagatcggtcaagccacgaccctgtttattgccggcctgctgctgagctcatttggctggcggcagtcattcttggtctacgcactggccttcttggttctgcttttctttgctgcccgcgttccagacgacagcaaggtagaagcagctgaggaaaaggaagaaaaacaggaagcagaattgaaagaagccgttgaaggcgaagacaagggcaagatcagtccagtcgtctatctgctcatcttatttgccttcctgctggttgttgactatgtcggcatggaaaatcgtttctctggggtagcggttgccattaaaggtgccagctacactggatcttccaacttcttgtcgttgatgctgattggagcaacgctgggtggtttgttctacggctcaatcaagaaggtcatgggattcgggacggtttactttggtctgattctgatggccatctcgaacttcttgtttgcctatggtgccagtcaccgcagcttcgtgatgctggtcattggtctgcttttgattgggttcccattacagctggtctctcctttgatttttaacctgctgcctgatcttgcgcctgctaatcggcaaccgctgattacctcgatggttctgatcggttttaactttggggccttcttctcaccaacgattgctgaatggaccaaccacattatgggacagccgcaagctgggttgagcctggcagcgcctttcgtaccatacggaatcggcctgctggtgattgccttggttatctttattgctactcgtcgtcaagctaagaaaaactaatttacatttttggaggattaaacatgccaattaaaaacaaagccatgctgatcacctactctgactcgctggctaaaaacatcaaggaaacgcatgaagtcttgaacgaatacatcggttcagcaatcgggggcgttcacctgctgccattcttcccatcaactggtgaccgtggctttgcaccttatgactacacggttgttgatccagcttttggtaactgggctgacgttgaagcattgggtgaagaatactacctgatgtttgacttcatgatcaaccacatttccaagaagtcggttatgtaccaagacttcaagaagaaccatgacgactccaagtacaacgacttcttcattcgttgggaaaagttctgggcagctgctggtccagatcgtcctaccaaggaagacgttgacttgatctacaagcgtaaggacaaggcaccaatgcaggaaatcaagtttgacgatggttccgttgaacacctgtggaacacgtttggtgaagaacagatcgacatcaacgttaagagtaaggtagcccaagaattcttcaagcagacgctgactgacatggttaagcatggggctgacctgattcgtctggacgcctttgcctacgccgttaagaagatcggtaccaatgacttcttcgttgaaccagaaatctgggatctgttgaatgaagtacgtgagatcctggctccttacaatgcagaaattctgccagaaattcacgaacactacacgattcctgaaaagatctctcaacacggctactttgtatatgacttcgctctgccaatgacgacactgtacacgctgtactctggcaagaccaaccgcctggctaagtggctgaagatgagtccaatgaagcagttcacgacgctggacactcatgatgggatcggggtcgttgacgcgcgcgacatcttgactgatgaagaaatcgactacgcttccaacgaactttacaaggttggtgccaacgttaagcgcaagtactcttcagctgcctacaacaacctggacatctaccagatcaactcaacgtactactccgcattgggcgatgacgaccgtgcatacctgctggcacgtgccttccaagtattcgcccctggtatcccaatggtttactacgttggtctgttggctggctccaatgacctggaactgttggaaaagactaaggaaggccggaacatcaaccgtcactactacactaaagaagaagtggccaaggaagttcagcgtccagtcgttgccaacctgctgaagctgctgagctggcgcaatgaatttgctgcctttgatctggatggttcgatcgacattcaaacgccaaccgaaacgacgattacgattactcgtaaggacaaggaaggccaaaacgtagcagtcctggaagccgacgcagccaacaagacgtttacgattacggctaatggcgaaaaggtcatggaacaaaactaattaaaggtctgtttcagctgatctgccgaatagttcacaaaaatcgcatgagcttaaagctgatgcgattttttattttaaaaatgacgaattgtcgtaaattggtctataatagtgtgacaatcatttcaacgaggtcaagaatatggtagctaaactaaaagatgtcgccaagctggcgggcgtttcagtcacgacggtttcccgcgtcatcaacaactatggatcgctaagcgaaaaaaccattaacaaggtgcatgaggcaatgcgtgagctgaactatcagcccaatgctctggcgcgagcgatgcaggggaagccatccaaatttatcggcctgatcttcccgaacattattaacccgttctatgcggaattggtaaatgatctggaatatcgtctgtttgctaagggctataaaacgattattgcctcatcagcccaaaatccagatatcgagcatgattacctggcgatgctgatggcgaaccaggtcgatggcattatttcaggctcgcataatcttggaattgaggaatatcagcgaatcaaggccccaatcgtatcgtttgaccgctatctggccgacaatattccaatcgtgtcggctgacagctatcgtggcggaaagatggctgctgagtacctgattgctaaaaacgtcagccatccagcaattctgattgatgaggatacttcggtttcgccaacgcttaatcgagttcaaggggcaattgactgtttttctgcccaccaaattgagtatgtgccgctggatgccaagaaaacgaatcttgaaacgacatttcctggagaatatgatggcgtgatggcaaccaatgacgttgatgccttgaagatcatgcgcctggcggtacgagccggcaaacgaatcaatgaggacttccacgttacagggtatgatggctccaagatgatttgcgagctgacgccagaattgccaacggttcagcagccgactgacgagttggcggacctgctgatcgatacattgatggaacgcatcaagaatccagatgccaagctgacgcctgcaccattagcggtggcttttcactatccagaagaccaataaacgaaaatcaaggcgtaattgctcgattttgacgttttacggccgttcaatgaagaatttgataatttatatgcaaacaaaaaacgcgcctgctaagacgcgttttttgtttgctagtgcttggcctgcatgaagcgccgcaagagactggcttcctcatcagtagcgagatcgctttgtgacttgatatcatgcacgcgctcaaccgacaattggctgccaaatgcgacttggttgtcggtcattgcatggacccgttcgaattcgatgatttctgctgcaagactgttgactggttcgctcattaaaactttctcccttcctggtcaccattcataatgacgatggctgcatacgtacgatattgcaatatttattgtaaacttttcttttcgtagatgctagaaggcttgaataatctttatgattccaatcacgatcaagtagaaagaaatcagccaaaccatggtgattgccgaaagcatcggcgagaagagcagaactaccccgatgatcagtcccagaatgtcgagaatgaacaaaagccagtagtaaccaacgtttagctgatggaagaaaccagcaatcgttaattcattggctgagctgataatgaaccagagcgcgaagatgacggcaattacggttgtaccaaagttttgatataccaaaaagacgatccccaaaacaatgtctagaataccggtaccgagcagccagccggaacgatagccgagccattcctgcatcttgctgcgggcccaaagctcatagatccctaacagcagtaagccaacgccaactaagatacagagcaggtgcagcgatttgtctgggtgcatgattgaaacgcagcccagtaccaccaatacgattcccaaaatcaaactggcccagtcaaaacgctttttgtatccgtccatttccataatcattacccccttagcgatcggaatgcaaacacatcatggataattgcaaaaatataaagagacaataactaatcaaatgttaactatactagccacatcaccacttttatgggtgaaagcgtttttatttatacttctattgtaacttattttattaataacggcatgagaaataaggaacaattgccgcgatgtgttacaatttatgtatagatttttatgttgtctgacgcacgaatacggtcattgatttaggagcaaaaaattatgaattggaactggttgggatggctgctttggatcgcggccattgtttttatgatctgggttactcactacatccgcgtcaagcaactgatgctgattgccaagacgaagcgccgttttgacaaaaaattgtttgcacgttatgtagtgctggtcgtcttggcgattggatggctgggcggaatggcatatctgtcgtttttccggcgcgtttcctacgacgatacccaagccgttaagataacgactgaatatgaggcattgcagctgaacagtcaagacaatgattactactatgtgattgccaaacatgctcagggtggtacgcggccgatcgtttcctacacctactggacggataatgccaaaatgacgactgacgcgcggggcaccacgatcgttgacagtgatcgcctggttactggtcaggcagccggctatccttggaatatgaaaaagctgaagtcctatgactcaaaaacgggtcatgctttcgttgccgtaatgacgatcaaatatcgcaatacggtcttaaacgggatgggcgttcgctgcggcaagctggctgatacgcatacgctgatcagaattccggctgccaacatggttgatcaaaaaaagtaaataaataagtgggtttgtcaaggcaaatcaactgattacatgatatagtaaaaggtggatgctaaaattgcgacagtgcaatggcgagcacacgataaaaggcgatgaacgacgcctcgatcgcgaagatttgaacgatcaaaagctcacggtacgcgtggccaagttcagtaattaataaaaggagtacttagtacaatgattcaaacgattgatttgaaaaagggcatggtttttgaacgtggcggcaagctgctgaaagttttgcaaatcaaccaccacaagccaggcaagggtaacacgttgatgcaaatggacatccaagacgttcggactggctccattgtgcacacgacgatgcgtccttccgaaaaggttgaacaagtcaacgtggacaagaagaatgctcaatacctgtacgatgaaggcaacacggcggtcttcatggacatggaaacctacgaacaatacgaaatcagtgatgaacagctgactgaagaaaagaagtacttggttgaaaacatgcaagtgcaaatggactttgttggcagcgaactggttggtattgaactgccaacgacggtcgttctgacggttgaacacacggaaccaatgatcaagggtgcaacgattgatggcggtggcaagcctgctacgatgagcacgggtctggttgtcaacgtgccagccttcatcaagaacggtgaccaaatcatcgtcaacacgatggatggcagctacaagtcacgggcctaactaataaaaaacgattcgtcaaaacggcgaatcgttttttatttgggcaaagaagcgcggttaatgactttggccgcgattaaaactaatcctgattatcagccagcgcatgctcatcaatccaataagttcccatatcatcggcaatgacgacgcgaccggcatgctggcgaccttcgttttgggtaagcccgattttgttgaaggcaaacgtaacggttagatgggctttgacggcaattcccatgaccgcaccagtatcagtattgattccagaaggcatatcaacggcgacgcgaaaagcctttgtatcattcatagctttgataacgtcgacgtagtgtccagcaaccggccgatcaatgccaataccaaagattgcatccacgatcagtgaggcctcatccaaaatgctcaagtcgctggtttgagggatgcgatagtattggcagatatgggcttgaatctggtgctcttgggaggcatgatcaggattgccaacgttgagaatcgtcactcgggcaccggcaatcttcagcaagcgggcgacggccagaccatcgccgccgttattgccgctgccggcgacaacgacaacatggcttaaatagatcggcagggcattgagaatctcgtcgcgaacggccagcgcagctcgttccatcaaaactaatgaaggaatgccgatgtgattgatggtgtagctgtcgcagcgtttcatctgggctgcggtaacgattggtttttccataaaaactacctccaaaattggttttcttttagcctaccactttattgaaccaacctaaaagcggtacactaaacatacttagacaaaagaaggtgagcctatggatttaaatgcatacctgccatatttcaaaagcatgattgatcgtaaaattggctggaccatcagcaatccagaagatggcatcgtacgtgttggctatccgctgtatgacaaaccgatgctggaatttacgcgcaagttccgtgccagtgcggaatatgacccccattaccgcaagactttaaaggctaatcgaattaagccacgcgttgatgaagcaaccattgcgcaagtcttaaagtcagatgatgtcagcttgattggcgcgatgatttctttaatcgttgactgggaagaagttgaggaaggaacctgggctcaggcgctgcagtccggtgaattgtatcgtttgaccaagcgtttggcagaactgaccagtcagcgtccacagctagaaaagtagagggaatttgatgagcaaaaaagatcaatatccggtcagtcgctatacggggctgccggtcgaagacgatggcaatggcggctatcagctgcattatgatgccaatggtcagatcaggctgcatacctggcggacggggaaacacaccaaaggaagatttcggcggattggtcaattgatgctgacggaaaacggcttgatggtcatgatcgttaaaagcgaaccgatggcattcaaggatcgtcacagcgaggtgccgctgggacgattcctttcagtggatgctgattcagcaacgctggccaagggactagctattttggatcagcagtcataagacaaggcgcaatcgtaatggcaacgattgcgccttttatggtaaacagcgttaaaatagttataaattcagctcttgtttgataagctcggctaagatgattccttggttatgctgccgatcttttgcgccataaagcagaatcacgttatcggtctgcagatgttttttgacgcttgccaataagtctaaataagcaggattgctggctagctcctgcaagtagcgttccttgaattcggcaaatctagcgggctcatgattgaaccatttgcgcagctcttcgctgggggcggcttctttagcccattcatccaggtgggcgttaaccttagagatgccgcggggccagcgccgatcgatcagaatgcgccagccatcaagatcagcgggcttatcatagatgcgttctagttttaatttcaattcctgtcacctcttggaaaaataaatcataagaccattaaagcacttttcaaaaggatggtttcgaatgctttcagaatatcaaaaattttttacggctcgcccaaccccacagatcgccaaggaccttttaggacggcttttggttttccatggtcgcaaaggcgatgttggcggctggatcgttgaaaccgaagcttatgtcggcgagcaggattcagcatcgcatgcttttgggggacggcgaactgactattcagagtcgctctatggcatgcctggtaatctttatatttatcagattcgctcacattactgtgtcgatattgtagttcaagacccagaagagccgcagggcatcttgattcgcgcgctggagccggcgttgggcattgagcagatgatcgagaatcgtggccaggatggctttaacttaaccaatggaccaggcaagctgatgcaggcgcttggcgtgcagtcgcggtcaatggatggtcagccgatggagcatgccgcgctgcaggttgacttacgcactgaacggcggattcctgtaaaaatcattgccggaccacgaattggggttaatgcgcaaggaaaggatgccttgaaagactaccgctttatcgtggccggcaatccatatgtctcaaagatgaaacgccgtgatgcagatgatttaacgcatggttggagatgatttgaatgtcgcttagctatcaacaaatgaagattgcagtaccattggtgatcaaggctggcaacgtgcccagtatcgttggtgaggccggcatcggcaagtcggcgctggttcaggaaattgccgcgtcaatgggggcgaagctttatacgacggttgtcagtctatcggaaaaaggggacctggcaattccggtgccgccgttgacggagcgctcatttgtgaccactcagcattatggcacgctggctaatgttcagtttggctattcagagacgctggtggcaatcgtcaagcaggctgaagcacaccctgaccagccgattatctggtttttggatgagtttaatcgtggtacgcaggccgtgcaaagcgaattgatgaacctggttctgcagcggcaggtcaactcgctgaaattgccggatcaggtacatatcgtcattgccgaaaatccggacagtacgatggaaaattttgctgacagcgactatggcgtaacagctggggatgctgccattcgcgaccgaaccgtgcgcttggtcatgaaagccgcggttgatgactggcttttgtgggcacggcagcttcaatcagatggtcagccgcggattcatgaattggttgccaagtatattcggctgcatcctaatcttttggcgccagccgatcatgaaaaggatctttatccaacaccgcgagcctgggcccgggtttctggcaatctacggcagctggaacaattagatgaggaaacgcagacaacgctagcggctgatctgttcagtggtgatctgggatcggaagtcggggctgcttttgccaaatttgttgcacagcatggtcagcagctatcggttgctgatttgatcgaccattcaacgcagctgcagtttgttgccgaagtggatcgattaacagcagtaagacagtgggttaaggaattgaccaagtatccaatcacgcagtatccggctcagtttaagaactgtctgtacgcgctgagtcctgatggccggtttgccgtagttcaggatctgggggaacaagcagttgctgctgaacagattaaggcactctatcaggctgccaatgaaaatcctggcggcgaccaagaacagctgtatcggctcttggaacggattacggttgaagctggtgattagatgactgatttgaatgaaacggcaagacagcggctgactaaggccgtcgtcagtctgttgacaacgcagcggctaagcggtgaggtgctgcttgagatgccgcggaccagaaatcaggatctggatgcaccaattggcctggcatggcagcataatcagctggtcttggaatataatgaccgccagttgaatgagctgacagccgatcaattagacgtcagactgcagcatgaggttctgcatgcaatctggcagcacccattacgatacgtcagcagtacgcatccgcgtagagtggccttagcaacggatattgccgtcaatcaatatttaaaaacgccgccccagggaaccatgacgctggctgacctggaaaaactgctgcagcggcctttagcagcgcatcgtgattccaggtactatctgcggatcttgacgcatctgacgccggctgagcagggacggattgaaaaagtctggggaaagctggatgacaatgatcaaagcaaaccgcagcgcagtgaaaaaaaggctggcaaagcgcaaaaagctgctgcaagtcaccaaggctggcagacagatcagtcggttgacaatccagacctgcaaaaggcgcgattaaaggcgctgctgtctaaagcatggaaaagtctcagtcagaagaatcgtggcctgttaccgggtgagattcaagaagagcttgagcgtctaagcaatcctgagccgttaaactggcgtcagcttttggtgcggctgttgggtaggatcccaagcggcaaacaggatacccgcgccaggtttaatcgtcgtcagccactaagaatggagctgccaggacagattgatcgcttaaatgctgatatctatgcatttgttgataattctggttcaatgagcgatcaagaaattgcgggtgtattaaccgaactgcagtgtttgactgttcagctgaattcgcaagttgagatcattccttttgatgccaaggtgcacagtgagcaggcaacccgtctgcagcccgggaaaaacgtgtcataccagcgaactggcggtggcgggacttgttttcaggctgtttttgactggctgcaaaaacagcacgtcagtcgacagcaggcaacggttgtgattctaacggatggctggggcgaaagcgagcttgcagtgcatggctatcgcaacgtcttgtggctgctgagtacggaaagcgaattatcggtaaagagcccggtgatgcgttccgttaagattggaggaatttaaagatgaacgagtatccattgctttcgccaagctatctaatggcagcgatgagacatgatcaaactttccagcatgcagcagcaatgcttcatgatgactgggatcccaatgaaggcggcctgtttcgagaaatgctgcaggcacctgacattgaaatggcacgggcactgcagcaagccggcatggttaagggaaggtggcaattagatgactacggacaggtaaaagatctattggcgctgcatgctgagtggttctcgccaacggcccgcaatgcgctgctggccccatttgagtagccagaattctgcctggcgattttgtttcacgtggaacttaaaaattgttatgattgttttcataaaaacgatggatggagtgatatgatgacgattgatttggcaaaggctaaagatgacctttatgaagccgtcaatggcgaatggctaaaaacagccaagattcctgcagatcggccagcaactggcggatttaacagtttggttgatgatattgacaagacgctgatggatgattttgatgcgtttttgaacaaccaaaaaaacagttcggatgctcgctttaacgagatgatcaaactgtatggcttagccaaggattttaagcgccgtgatcaagaaggcacggccccattaaaaaaggccctgctgccaattgagaatctgcagagttatgctgactatcaagctcactgggccgagttgatgcttaatggcgtggcttctcccgtgacttttgatattgatgctgatatgaaaaatgcacaggtttatgctttgtttgccggcgctcccagtttgattttgccagaaaagaactactatgatcctaaaaatccacaaggcccacaattaatgcagctttggacggcgatgatgaccacgctgctggctaagctgggctatgaaacggcagcggctcaaaagctgattgaagaagccaagcggtttgatgcactgctggttccccatgtcaagagcgcggaagaattagctgactacagcaagatgtacaatccacaaacgctggcggaatttgctggtcatatcagtcaattgaatctggccgcggtagttgaggaattgattggcgccaagccagaacaggttatcgtaatggagccgcgatatctggccgcgcttgatgaaatcctggctggtcattttgaatggttcaagagctggcttttggttaatgaaatcagttcaatggctggccttttgactgatgagctgcgtgagatcagcggtcgctttagccgagcactttcaggagccaagcagcctgccgaccagcgtaaatttgcctatcgcctggcgcggggcacgtttgatcaggtagttggcgactattacggcaaaacttattttggacctcaagccaaggctgacgttcatcatatggttgaacagatggtgaaaatctatcagcagcgactggcccaaaacgactggcttggcgaaaaaacgcgtgccaaggcaattcttaagcttgatcggctgggaattcaggtcggctatccagatcagattccagcgctttatgatcaattaaaggttgacgagcaggccacgcttttggaaaacatgattcaattgggcaaaacggccgccaaggaaatgtttagtcgttggaatcaaccggttgaccgcctgcgttgggaaatgagcgccgctacggttaacgcgtactaccacccgtttaagaatattatcgttttcccagcggcgattctgcaggcgccattctacagcttaaagcagaccagcagcgaaaactatggcgggatcggcgcggtaattgcacatgagatctcgcatgcctttgacaataacggggctttgtttgatgaatatggcaatctgaataattggtggacggaagccgatttggcgcactttaaacagctggcgcaaaaaatgattgctgagtttgatggcctgccgtttgctgggcaaaaggtaaacggcaagctgactgtttcggaaaatattgctgatgcgggtggcttgagctgtgccctggccgctgccaaagaagaagatagctttgatgctcggcagttcttcatcaactgggcccgaatctggcgaatgaaggcaaccgaccaatacatgcagctgctgctttcaattgacgttcattcgccaaacaagctgcgtgccaacgttcaagcgcaaaaccaagctgagttctaccaagcctttaacgttcaagcaggcgatggcatgtacctggctccagaaaagcgggtcaatatctggtagcagctttgaaaggcggataaaatggctaaaacgattaaagtagagcgcggtgatattaccaaatatcaggttgacgccatcgttaatgctgctaatacgacactgatgggtggtggcggtgttgatggcgctattcatcgggcggctggtccagctctctatgcagcctgtgaaaaatttcatggctgtccaacgggggaggcccggataacgccaggttttcagttgccggctaaatacattatccatacgcctgggccgatttggcgtggtggtgagcatggtgaggctgatctattgaaaaactcataccgcaatagtctgcagctggcggagcactatcattgccagacggtcgcctttccgtcaatcagcacgggtgtctatggctttcccgttgagcaggcggcagtcattgcgattaaaacgattcgtgaatttctgacagccagccgctgggttcaagaagtcattatggtggcttttgatcctaaaactgaggctgcctatcaaaaagcactttaaaaagacccctggttggacaagccaggggtcttttgaaacagagtagaaatcagatggtgtaagttaggcagactgaatctgagcggacaattcagactcagttcgccacttatccacaagatattgtggataagtggcgatatctgtggaaaacccacaatatcttgtgctgccaacctgcaacgtcatttagtataacggtatcaaaatcaattcgcaagcagcaagaattcaaattgatcaagcgaccagcgcaattcaagccatcgtttaaacctttatgccgattgaagaatttttggatttggtcagtctggctggtttggcttaaccgacttcatcttgatttaccctgacggaaacgaccttaacctgatattctccctgcggcgcggcaaccaaggcagaatctcccgcgctgagcccggtaattgctttgcccagtggcgagtcaaatgccagcttgccttgcagaatatcggcttcttgacgaccaaccagcgtataggtctcagtttcatcgtcgtcgtcatactgcagctcaaccgtggaccccatgccaactttaccagtatcctgcggtgtgatgattttggcataggtcagctgtttgttcagatagcgcagtcggctttccaaatgtcttagatcccgtttggcagtactgtattcagtattttcggaaagatcgcctaaagctcgagcagccttgagccgtgcaatcttttcaggccgttgtttcttgagggcctcaatctggtcttcaatttgccggtagccggctgccgtcatttcttgataatagaagtcagggactttgatttttttggatggcatttaaattcctccaattttatagatcgtaagcgaacgtgtgtactaagtaattatgttatgatagttattgaaattcaagttgaagcaacaggagtgaaagttttaatggagtatcaacagaatcaagcccacgtacaagcattcttagtcgacgcggcgtttgatcggttgtcaaaaaatcagcaggaacatgcacaaagaatcttgcagcaggtcaatcaattgatggcagatcgtcatcagcttgatgattgtcactggactggtgcggcattggcagccgttttggatcacgagctctatcaggatgggcaggcgccatatcgtcaggtgatttcgaccattccagttttaaaggcctatcaaaagtttttaaaagttgagcatgttaaagagctggctcaggtaatggatgagcaccgcaagaccatgcaggcaaactggaaagcggctgccgaccaaccagctgctggaaaggcaccgcgagaatggacgccagaaaactacctggcctggcaaaaaacaatggtcgctgtggcccctaaagctgccctgcttaaaaatatcgagggccttgatgaaactgatgagcagtacctgatcgatgagtttttgactctgatgaaccaagaagcgcaccagtggcctgatggctggacttttgaggcgctgcaacaggtgctggggatgacgatgccattggacccgcacatcaagccgtatcaaatcatcaagatcgtggctttatttgatgccttttttgactatctgcatcagcaaggcgatcttaacgatgatcaatatgccatcgctaagcggacgctgttgcacatgcagccagctcaagaagcactggcctcgcttgatcgcaaggatcgtttgacgcagctggtattgtcactggctcaggcagaaggcgttgatattaatgatcgtgaaactgcgcaaaaatggatggcaacccatcggacgcttttgaccagttttgttgggacgatcatgcatccatggcgtgactatgatgctcgtgaacaaaacaacgagatggctaagcgcgttgctgaaaaaagaacggcttcccaaacgccagcggctaaaactgttaagggcaaaaagcacccgccagttggcatttcatttcggaatcgtcggcagaaaagtcgtcgcaaacactagaaaccgaggggatttttatgagtattcaaattccagaaaatatggaagaagttgcaatgaagatcgcacagtatcaagttcatggccagcatttggaaatggatgacgtcattaaggatgccgtgcgcgataccttgcaggaatttatggacgaagccttggaaggtcattatgacgacgttgcctgggtaggcgaagatctagtggtaaccgatatcatgggtgaaaaagttggttcagcctcaccgattcatgccagctttattgaagattttaaggctgatgccgatgaattggtgctgcgcttagaacaacaggcagcgcagattgtcggcggccgctaagctgttggagtcgaccatatcttgacatgaccttaaataatgacgagggaccttgccaagcaacggggcactcattattaatcgtgactattcaataaaaaacgtcgaatcagcttgctgactcggcgttttttgtttggctagagatgctctttgacgtcataaggctgggctttggcgtgatcggccggcaaggcgtccttggcataaaagatggcatattcttcatcatcaggacctttggcaatgaccaggtcgtcgattttacgctcttttttaaaaatctgtcccttgcgtacggcttcgttatagtcatgaatattggcaatcgagtcgccgggattaaagaagattcttgtctccatattgacacctccatcagcgttagtttccagaaaacgcttgcttttggtttattataccattagtcgcggtacttatgacgcaatgcctgcagatcagaatcagaaagctgcatgacttctttaagatactggtcaacggagccactgattttttgaatggcatcctgggccgtctgcaggtattcccgtttaacgctggccatatcaagcgaattttggatgtagtttgacgaaaaatgaccagcagtcagtttctgcttgatgtcttgctgaacgtctttaacgagctcattggtcagcaggtagtctttgatgatgacatcgggctgcacttctaaggcgtttaatagcagataggcgccaataccggttcgatccttgccagcagtacagtgaaacagaacggggcgatcagccggcgcgcttagcagctgttggaaaaaatcgcggtaggcctgttgtggaccaggctcagcgaccatttcatgatagacggtgcgcatatgctggcggccacggttcggatcagcattcaattcatcgctaaaagatgagattggctgcgaggctctggtttcgtcggttgaaaagattggattggcgatgtattcagtggcacctgggacttggtcaggctcttttttggtttctcgcggtgagcgcagatcaatgtctttagccagcttcatatcagaaaagtattgcagatcctgactggtcaggcggtgcagactgccagaccgcagcagtcggcgccacttgatggtatggccgtcaagcgttggatagccgccaagatcgcgatagttgtaaccgccattgattggcagccgacgagtaggaattggcatgaaaatctctcctttgtttggcttggcagaagcgtgctgaagtgcccagatgctattgccggttttggttcagcagctctgccaaaaccggcgttaaatgctgggcaatctgtaaagaaccttgctgatcggggtgcagaccatcagtaaatgactgacaccagtttttggtaggaacgaattcagtatgacattccaaagcggtttcttcaatgatatcggcataggtctgagcaaaaggcaccattaaggccagtggaacgtttggataggcggcttttacctgtttgacaaacgctgagtaggctttttgaaactgctggctggcaaaacgccgatcattgacgcccagattgatcaaaaccagtttaggcatgacgctggggtaccatggcgtttgggcgtccagatggctcaagaactgggcggccggggggacgttgcctaccgcggctcttaaaacgccgcctgctgaataggcgatccgatcgacatcgattcccaaggcgtcactaacaagaccgatatagcagctttctgggcgatagtcggtgctgggccgtttgccatttacccaacagccagccgtaattgaatcgccaatgacagttacgtgtttttgcggcttaggcgaggtcatgacggcttgatcagcaatcgaaatcgcggccacagccagtccctgattgccaagccagacatcatcaaggtcggtattgccagccgcgatgatctcaacttcagcattatcaggcagcgacagctcaaaaggagcattgcgggttgaccagcgctgccaatttccatgattgactcgcacggcccagtattgtggcggcatttgcggattgccgttatctaaggcctcaattctcaaaactggactagcttgcagatggaatttgatcagactaccaagattggtcgtgtataagacgcttttcccatgcagctgtttaatggtccagcgaccgagcagcagagtctgtttttttaactgatctgggagaatttttttcatagacggccatcctttctcagattcttttgttaagtaaaatttattttagcataaaaaatagcgcaaacagttgctaaataaggattgttaaaaaacctacaaatcctttaaaaataataatgaaagcgcttattgacaaattgtcaaggtgagcgtaagctaatatttagtaaaagtttactaaccgtttatggaggtagctagagatggataagcaagaattactgaaagaatatcaagatgtttttaatggtgaagctaaggatgtcttcttctcacctggtcgaatcaatgtaattggcgaacacactgattacaatggcggtcatgttttcccatgtgccatcagtctgggcacgtttggcgtctacggtccgcgtgatgatgacaaggttcagctctactcagccaacatggaaggcagcacggtcgttgaattcagcatcaacgacgaaaagccagaaacggatgccgacaagacctggaccaactactttaaggggatgctggtctacttaaagcaggccggctaccagatcgaccatggcttcaatctgctggtacacggcaatctgccatatggcgcgggcctttcttcatcagcttccattgagcttttgatgggtaatctgctgaaggatgaattcaacctggatattgacgaaatctcgctggttaagcttggtcaaaagacggaaaacgattttgtcggcctgaactccggaattatggatcaatttgccgttgggatgggtaagaaagacaacgccatcttcttggactgcagtactttggaatatcaatacctgccattgaagctgggcgactacgaaatcgtgatcatgagtaccaacaagaagcactcgctggctggctccaagtataacgaacgcgtcgaacaatgtgaagaagccgttaagcgcctgaaccaaaagctgaacatcaagaagctgggtgaattggacgaaaacacgtttgacgaatactcctatttgatcaatgacgatgttttgattcgtcgtgctcgtcatgcagttgccgaaaatcaacggacgctgcgggcgattgaggctatgaaggcaggcgaccttgaaaagctgggccgtctgatcaatgcttctcacgtttcgctgcactttgactacgaggtaactggcaaggagctggacacgctggcagaaacggcatgggaacaaccaggctgtctgggtgcgcggatggtcggcggcggttttgccggcagtgccatcgcaatcgttaagaaggaccaagccgatgcatttaaggaaaacgtcggcaaggtctaccgggaaacgattggctacgatgccagcttctatgatgccgaaatcgttgatggtccccacaagatctagtcttaaggtcagtttttgagaaagaggtttgcgacatggaactcattgaaggatttgcagaaaaggcgattgccagcggtgcttttcagccaatggacaagatctatgtgatgaacaagattcgagcgctggtgggtgatgaagatgctgaggcccaaccagatacgccactggccagtcagttggtggaattggcagttcagcgcggcaagattgaagatggccagacagcgcgtgaaatcttaaacgatcagctgtatgatctgctgacgccaacaccggccaaggttaatgggacgttctggcaaaagcatgaacaatccccccaacaagctacggactggttttatgatctgtgtaccagcaatgactatgtaaaggtatccgcaatcaaaaaaaatattgagtttactaaaaaagtcaatgatggcaacgagctggagattacgatcaatctttccaagcccgaaaaagatcctaaggcgattgctgctgctgcccatgatactcaaaagaagtatccgcagtgcgcgctttgtatggaaaatgaaggatatctgggacgtttggggcatgctgcccgcagcaaccaccgcatcgttcgcatgacgatcggcggcaagcagtggggcttccaatactcaccatatgcctacttccatgaacactgcattttcttggatgccaagcacgaaccaatggagatcaatcaacagacgctgatcaacttgattgagatcgaaaagcagctgccacactactttgtgggcagcaatgccgatctgccaatcgttggcggctccatgctggcccatgagcattatcaaggcggccggcataccttcccgatgatgaaggcgccaatcaagcaggaactgagttttaaagactatccagacgttaaggccggcatcgttgactggccaatgagcgatctgcgcttgatcagcaagaacgatcaggctttgattcagctgggaacgcatgtcatcaacgtctgggaccattatgacgatccagaactttcattgaaagctttcgacggtaatacaagacaccacaccgttacgccaattatgcaccgtaatggcgatgaatttgtgcttgacttggttttgcgagacaataatactagtaaggagtacccattgggcatcttccatcctcatgaaaagctctggcacattaaaaaggaaaacatcggtctgattgaagtgatgggccgggccattctgccagctcgtttgaagagtgaattggaagaagtcaagaagtactggctcaatgaaccaaacaagattgccgacagtcatctgccatgggctaaagaagttcaggcacggcatgatgacattaatgccgacaacgttgaagagattttagaacaagaagttgctcaggtcttcggcgatgttttggcggatgccggcgtctttaagcgcaatgcccagggtcaagctggctggcagcggttcgttgaacgactgtaacctattttgaccaaggaaaggatggtttttgatggcagtaacgctaaaggacattgcagatcgtgcgggggtttcactggcaacggtatcgagagttttaaacaatgaccctcaactgtcggttggtgaagagacacggcgcaagattctaacgattgccgaagagctgtcctataccaaaaaacatcgacgcagcgcagccaccggtcacaagattgccgttattcagtggtattcgccagctcgcgaactggatgatctttactacatgaatattcgcctgggcgttgaaaaagaggcccagcaggttggctatacaacggcgacggtttttgacacgcatttggaacagattcctaatgacgtcagcgggatcgttgcgatcggcaagtacagtcaaaaacagatcgatcagctgcagcgtttcaacaagccgatcgtggtgattgactatgatgaattgtccaatggctgtgactcggttttgccagactttgatggcggcattaagcaggctgctgattttctggttgccagatatgccaagatcggcatgattgctggtcaggaaaaaacgactgaccaaaaaccggttagcgattcacggcgcgacactttcgccaagactttaaaagctaaaaatctttaccaatcagaatggtttatgatgggtgattactcagaaaagagcggctttgaccagatgcagcgccttttgcagctcgatgatcgtcctcaagccgttttggttgccaatgatgcgatggcagtcggtgctttgcgtgccctacacgaaaagcagatcgacgtgccacatgaaatggcgctgatcagttttgacgacacgtcaattactcactacacctatccaacgctgacctcgattcatgtcccgaccgatcaaatggcggcaatgggacttgaattgctgggacgccgcctgcagaacccggatctggctccgcagcgcgtagtagtcggtactaagctggttttgcggcaaagtaccgaaaaatgatcaaaaaatcctaagttacacatcaataattgccgactcctgccgtgccgttttggccagcaggagtttttgcttggctgatacttactttttataagataaaatcatttacaaaaagtaagtaacaagttataatataaataacaaatcttcagaaaaagaggaacgactatgacaaatcaatttaatcaacttcaagaaaaacgccgctccatttatgcattaggcaaaaacgtcaaggaagacaagcagacgttggttgacctgatcgaaaagacgatcgaactgtcgccatctgcttttaacagtcagacggtacgtgcggtgattgcttttggccaagattccgatcgaatttgggatatcgtattggctgagctgcgcaaagtcgtaaaagatgatgaagcttttgccaagacgcaagctaaggtcaacagcttcaaggcgtacggaacgattctgtactttactgaaacggcgaccgtaaagcagttggaggctgacttcccagcatatgccgccaactttgctggctgggctgaacaggcaattggcggtgctcagcaggcggtctgggaagccttggccgttcaaggactgggtgcatcgctgcagcactacaacccgctgatcgatgaagcaattgccaaggcgtttgacattcctgaaacctggcagctgcgggctgaaatgccatttggatccgttgaggcaccagctggcgaaaaagacgtcctgcctgctgaaaagcgttttaaggtatttggcgcttaatgagcttaataatcgagcgatccgcgcaatacgggtcgcttttttgatagcgtaggcatatttttacgtcaaaacgatgccagatgatacaatgaccaaaatcaaaatgctgaatgacaagcaatcaatcgttcagcaggtacgaaatgagggattgcgttgactgataaaaacaagctgactgaaatgcagtaccgcgttacgcaagaggctgctaccgaaccgccatttaccggcaaatatgatcagtttttcgaaaaaggcatctatgtcgatgttgtgagtggtgagccgctgttttcttcgctggacaagtttgattcgggctgcggctggccggcatttaccaaaccaattgacaagctgaaagaaaagcgcgaccagtcgtttggcatggaaagaaccgaggtgcgcagtctgaaggctgattcgcatctaggacatgttttttgcgatggaccgctggatcgcggcggtctgcgctactgcatcaattcggccgccctgcgttttattccgtttgatcagttggcagaagctggttatggcgagtaccgaaagctgtttgtcgactaattaacactgacactaaatcaaaaaccgcactgtcattagacggtgcggtttatttgtttgatgcggaatcagtcaacggctttaacgataaacatgtcagcgtggaaatcagatggtacctttggcgattgcaggcggttcatgacgcgtggcacgaaatacccagcattcatcaattcggcgcccgagaagacttccgagccatcattgaccgtgtagcgccgttcaggatccaggcccttgaagtagtagcggatgtaggcagggttggctccgtttagaatctgatagcgcatgccaatggccgtctgcttgtcagggctgacggtttcccagccatagacattatcgctggtatccggagtttccagccggtagaacgttccaaactggaagagcttgcggtattgcttatagaaggccacctgctgcttgatggtagcctgttcttcatcgctgagctcagtgacgtccagttcatagccgaatgcaccgaagtaggccactttagcccgcatgtcgattgaagtcagccggccgacttgatcgtttggcacggctgaaacgtgagcgccccacattgaaggcgtgtagccatatgaggtgccgtcttgaatcttgatgcgttcaacagcatcggtatcatcgctgcaccaggcctgtggcgcatagtacatcattcccagatcgaagcggccgccaccagaggcacatgattcaaacaagacgtctgggaaggctttggtcaagcggtcatagagatcgtatacgcctaagatatagcggtgtgagaattccagctgctgatcggcaggcaggtcggcgccgtacatttcggtgatattccgattcatgtcccatttgatgtagtccagcttggcatcttgaataatgtggctcatcaatccaaacagatagtcaacgacttcctgacggctcatgtccaagacgaattggtgacggcccggcgtctgcccgcgacctggcgtcttgatcatccattctgggtgggtttgatagagcttgctgtcaattgagatcatttctggttcaaaccagagcccaaacttcatgtcgagatcgtgaacgcgcttggcaaatccagcaatgccatggttgaacttcttttcgtcaacgaaccaatcgcctagactggaacgatcgtcgtcacgatgaccaaaccagccatcatcaagtacgaacatttcaattcccagttccttggcacgctcaacgattggcattaatttgtcttcggtaaagtccatgaacgtggcttcccagttgttgatcagaattggccgttcctggtgggcaaaatgagggttgatcaagtgctgagcataaaaggcgcccaattgctgagaaagcgcgttgaagccattgtcggtatagctgaagatgacttctggagtttggaatgaatcaccactgttaagcttccagccaaattcatccgggttgatgccaatcaggacacgcgtggtatcaaactggtcgacctcgacggaatccaaaaagttgcctgagtagacaaagttaaagccgaaaaccgccccttggttattgtcggtgtgtggccgggccagcataaagaatggattttcctgatgactggaggcggtccgcagactggagatgctttgcgtaccgggacgcagatggctgcggtgcagatgccgttcccgcgaccaagagccggcaaactgaatgaagtcatagttggcatccggcagatccagctgtgcgctcaaggctcggtttaaaaagacggttttgccatggttgacaaacgttgtgctgcggacaatcacgtcttcatcagcaaaaaccgtgtagtgcagctgcagctctaaatcgccatccgccagtttaacggtcagcgtctgagaatcattgctgtcatcggcaaatgttgaaggcaggccggtcagccgcgctttaccgtccttaagctcatagtcgcggtattggaattcagaggtccgggagccgtttggataggtgatctggaaggctggataacggtaatcgcccttacctagtccggcgtattcctgttttagcagctcagcttgaaactcaacgtcttcatcagtgcgcgtgttggtacagtcgtgttcttcacgcgtgttgaggttggcgtagtcgtctttgaatggaatcttaggaccgtagtagagctgacccagcgagccgtcctcaataacgtggaagacgtagctggtatgcttggtctgcaggtgaaacagtcgattgctggcattaacttggatactcatattcaaattcctccatgattaaatgacaaacaaaaagcccgaccgctgcagccgagcttttttaggccaacagactttttgatcattcaattagtctaattagtctttcttgacttcgatttgcataatggtgtcgccaaccttgacttcaccatcctgcttgacataggtcaaagtgtaatcaggtgccttttcagacttggtaaaggcaatcatgaccgtatcatcatgacccgccttcttgattgctggggcccagaattccatcagcttttcgccggctgccacgtgctgacctttgacgacatagttgatgaagccagtcccgcgcatctgaacggtatcaacaccaacgtgaatcaaaaccggaacgccattgtcggtttccagaccaattgcgtgacgagtggttgggaagtcagcaacaacggtcccggagaatggtgcaaagacttggccgtcagatggcttgatggcaatacctaagcccatggtaccatcagcaaatggcttggagcctacttgagacaatggcatcaaagtaccactgactggtgccttgaagtcgataaccagatccttggccaggctggcgtcttcagccagttcttcacgaacgctgtcattgccttcaaggtgttggtgccaggattgttccagttcgtcaacgatttgagcgtgcatcttttcatccagcttaaccttgctcttaaagcacaggacacccaaaagaatcagaattgcaggaacgacgaacatcatgagcttgaagatccctgcaccgtgagcagtaatgtcggatgccgtagcaccagagatcatgccggcagccgtagccgtcatcccaacgacaccaccagcaacggcaccaccgaacttgtccagcaggggacgaacggaaagcgtaacggcttcgtcacggtgaccaagctttaattgaccatattcaaccgagtcggtgataatcatcaaaacaaccatgaaaatcagtggctgtggcaacatgtaaatggcaccaccaagaataaccattggcagagattgaccagcaaaggcgaagattgccaaaccgatcaacagaaccaggattgagtaatagaagaccttcatccgactgaacttcttagccagagcagggaacagagcaaccgtaacggcaccgataacgccgttgatcagtgcgtacagcgtgtaggtgcttgcccgaccaagaatgtaggtgaagtagtacagttggaaggaattaacgatctgaatcccagtcgtgtaaaccaggtaggtaacagcaattgccattaattggtcattgtgaagcagaaccccaaagaccttcttgaaagtagtgttttccttattttcacgcagttcgttcttcttttcatgagtgaagagaccaaccccgcaggacgtaattgccgaaatagcagctacgatcgcggcaaatgcgaaccaaccgcgactgtcaccagagccaccgtttgaactgatagaaaatgccaagacgattggcattacgacaacaccgaccagctgaccgccaagtgttgaaccaacccgggcgaaggtagccgtcttttcacgttctgccgagtcaaatgagattgcaggaatcattgaccagaaagccacgtcgttaaaggaatagaaaatatccatcgtaatatataaaattgcaaatacgacgaggtacaaaactggattcttgtaggtcagaccccacagattagtgaacagcagggcaattgcaacggcagaaacgatcccaccagcaacgacccatggcttaaagtgaccccatttggtatcggtcttatcgataacgttaccgataaatgggtcaattaccaattcaacgatccgcagcaccatgatggtaatcgtaatgaaagaaaccatgtgggctgcttggccaccactgttgctgttgaacaggtggccggtaacaaacatcataaagtaagtcgacagcatcccatagaacatatcatgcccgaaagcaccaaatgaatatgcaatccgagaagccattgattgtgacttagaactcgcctcattcataatctagccttcctccttagaaaagacatttacttaaaactctctggaattatattaagcgctttcaaaaattaaatcaataaaaaatagtaaaaaatttagttaaaaatacttgttaaaaaatgatcaaaacgtttccaaggcgtcctaatggcttttataccctggataaaaaataataaaaaattttgcgaaccttattattttaaagttaaataattttcggaaattcttaagaaacggtttttagaaatcgtttacaataaacgcaaaatccggactctatacaacttgttaccgaacaaatcaacttaatctaaaattaattgttcactttttataaataacagtgtaaaataagctttcggacacagatgaacttaatttgtgagtgaaataacgatacgaaaaccaaaacttttacgtacttttgcgaccgcatgcttttaataattcgtacaagatgggatgggctttgctggaattgattctggtacggtccattaattggaaataatttaaacgcggccggttattcaaccataaacttatgaatgcatcgttatgacaatccaaataagcggaaggatggaacatcatatgaaacgttatcgctttggccggctgtcgctaggctggcagattatgatcggactgattttagggattatcgttggggccatgacctatcaaaatactggcgccatcaaggtaatgcaaagcctcggtacgatctttctgcggctgatccagatgattgtaatgccgatcgtaatctcatgcttgacggtagggattgccaatatcggcgacattaagaagcttggccgaatcggggttaagaccttgatctactttgaggttttgacgacgattgcgctgttgttggggatgatcgtgggcaatattttgcatcctggtacctacatcaacatccatgatctgcatgcctcagacatctctcaatatctgaccacggcaaaatcggcttccaagcacagcggtatctgggatctgctgatcgcaatcgtgccgaccaacatctttaagtcgattgcagacggcgacatgctgccggtaatcttcttctcagtcttctttgggctgggagttgcctcgctgggcgaaagcggcaagatcatcatcgactttatgaatgccgtttcggaaaccatgttcaaggtaaccaactgggtaatgaagttctcaccaattggggtctttggcctgattgggatgacgattgccgaaatgggtctgaaagccttgctgccattgggactgtttgtggtgatcgcctacgcaacgatgattattttcgtggtggtcgtcttgggaatcgtcgccaagattttccatctgcgctattggaagacgatgcacgtagtaatggaagaaattgcgattgccttttcaacggccagctctgaagcaaccttgccgcgtctgatggctaaaacgcagaagatgggggtcgacaaagggattgcctcattcgttattccaaccggctacacgttcaacctggatggctcggcaatctaccaagcactggctgccttgttcttggcgcaggcttatggcattcatctgacgattgcccaccagattacgctgctggtggtcttgatgattacttccaaagggatggccggggtgccaggggcttcgtttgtcgtgctgctggcttcggtatcaacgattggcgtaccggttgccgggctgacgtttattgccggaattgatcggtttgtcgacatgggccggacagcggtcaacgtggtcggcaacacgattgcaactttggtaatcggtcaatccgaaaaatcattggatcacgaaaaatacaaccaatacctggatagctatcaaggctaaaaataaagcatcgctgagaaacttagcgatgctttttttgtataattaagttaaatgaggaaaggacggaagacaatggaaaaacagcttaaacgcagcgaggtacctgaagcgctcaaatgggatctgacgctgctgtatgaatcagatgaggcaatggaacaagcacttgccaaaacgcagcagaaggcttctgaacttgccaagatggcagggcattttgccagtgatggtcagacctttttaagaaatctcaatgaaaacaaagcgatcagcgaagaactggaacgcgaatttgtctatggcatgctgcggcgagacagtgatacgacggattcgacggcagtcacgctctatggtcaagtcgtcaatgccgcgacgacgattgaagctgagctggcctttactcaacctgaattgacggccattgacgatgcggactttgccaagctgatgcaaagcgagccgggactggccgagtatcaatatgagatgactaagctgcggcggcagaaaaagcatgtgctctctaaagccgaagaaacgctgctgggtcatttgaacaagtcgctggacagtgcggaagaaatctacaatacgcttaacgatgcggatctgaaattcggcaaggttcatgatgaaaaggggcagttagttgaactgacgcatggcaatcgcagccagttcaatgaatcgcaaaatcgttccgtgcgcaaggaagccgttttggcatatgaaaaaccgtaccatgagctgcgcaatacctttgctcaaacgctgaacagctttatcggcacagaaaatgcactggctaggattcgtcactatccaagtgcgcgcgtggccgctttaggagccaataatattccagaaagcgtctatgatacgctggtggcaaccgtcaatcagcatcttgatctggtttatcgctggtatgagctgaagaaacgggttctgggcctggacaagatgtataaatatgatgttaatgtcccattggctggcgaggatatgctgaagacgacttttgaacaaggtaagcagctgacgtgggatgcattgcaggtgatgggtccagagtatctgaaaggcctgaaaagcgaatttgagcatcgctggatcgacgcggctgaaaatctaggcaaacgctctggtggctatcaagtaggcgtctatacggcaaatccattcattttacttaactggactgataaactttacagtacgtttgttttggcacatgaatctggtcatgccatgcacagttggtttgctcaacaggctcagccatcggaatatgctgatgcaccgatttttttggcagaagtggcatcaacgtttaatgaaaacatcttaaccgactatctgctggaaaaataccaggatgatcctaaaaagctgatctttatcctggaacaatatattaccggcttcattggtacgatctatcggcagacgcaatttgctgaatttgaagatgccgcctacaaagcagagcaaaaaggacagacgctgacggccgactatctggatcaattaagcggtgagctggttaatagatactatggtcccgcagttgaggaaaccggcacgcgaacgcagagctgggcctatgtaccgcatttttacatgaactactatgtctatcagtacgcaacttcctgggcggtctcaacggcgctttccgaggcagtctggcagcatgagccgggtgctctggaacgctacctggatctattgcgggcagggggcagtgatgatccggtaacactgttaaagcatgcgggagttgacgttaccgacagccaatatctggaacgggcttttgcgctgtttgaaaagcgtctgaatcagatcgaaaagctgctttaattatcattatcggttttgaaaaacgcctgcgatcgtctatgaccgcaggcgttttcttagtctttaacttcttcgggctgtggcagtttgacgcctcggtgatcgacactggttgaaaagacgatctgagtactggttttgccaaagcgctgctgaatttcattgataaaatcatcgagatctgaagtggaagggaaaacaacttccatgacctcggaaaaatcgccggtgacgcaattgcattcaatgacgttgggaacctgggcaatgtaaggataaaattccttcttttggcgtggttccagttgcagctgaacgaaggccttaacgtgataatccagtttttctagatttacgctggtgtggaagccggtgatgatgccagacttttccagtttgttgatccgagcggcaatagctggtgaagagatgtagcaggctgctgaaagctcctttaatgatacccgagcgttttcctgcagcatgttgataatttgacgatcgatcttgtccaatgaaatccactccttttaactaatcacaaaataatgtctttaaattgtgaaaaaatacaatgtaaatggtttattgtcaaaataatttaactaattattgctttttcacccataaaaatcaaatgattccgctgtcattatggtacaataagaataacaattaagtcgtgtgaattggaggtcataactatgaatcaagaatatcaaaacattctcgtccctgttgatggttccaagcaggcagaacgggcactgaacaaggcaattgccgttgctaagcgtaacgatgcacacattgacatccttaatgttatcgacacgcgagcaatggcttacaactttgccggtatgtcagacagcagtattgcttaccagttggtcgacaagtcaaaggactatctggatgaactgtacgacaacgctaagcaaaagcagggctttgacaacattgacattcacatccggctggggaacccgaagacggttatttcctttgatttcccacgcgatcaccaaaacgatctgattatgatgggtgcttgcgggctgactcgtctgcagcgggcaatggttggttcagttacgtcctttgttaagcggaatgctcccgttgacgttttggtagtgcggaccgacttaaacaacgaggtaccagctgacgaaaaggacgctaagaagaaataagcttaattaaataaaccattcaaaggtcgtaatccaagcaattgggttacggctttttgatattttaacactcattttaaaaactgacgattaactttcttataaatttttaatctttccttgccaaaaagttggcttttcccatataatgagcttgcatcaaacaaatttggagggatatttatttatacgattcgcaaggccgagcctgaagacgccggccagatagtaccgttaatgtctttgatttatgatgaaatggaactggaggaatttgagtcggttcccgacgaagacccccagaggatgatttataatgcttaccgcgaccgagccttacttggctatgtggcaaccacgtttgttgctgaggctgatgggcaggtcgtgggggtagcgtttggctatccagacaacaacgaaaatgcggtcaaccgagtatatcaagaagctgcagcgccaattccgtcgattcgcgatgtcgatttcttcgcggaccccgaatcatttgccaatgagttttacctagactcattggcggttgatgctgattatcgcggaatggggattgcaacggctctgattgatgcgattataaaacatgctgcttccttggaatacgagacgatcggcttaaatgtcgatgtcgccaaccccaaggcagaacggctgtatcgtcgcttagggtttgatgacgcgggtcagatcatgataggcgatcactggtatcgtcacctccagcgttcaacttcccaagtactgttaactgaataataaataaagcgtcctgccagccgcgggacgctttttgagttcttagattacgataatagtataaaaaaaagcgccgaacactaaggatcgacgctttgaaatcaagtctaactgatttttattgttcaacgtaccagctgtagtggaagttgcctgggcggtcaacacgttcgtacgtgtgagcaccgaagtagtcacgttgtgcttgcagcaggttagcaggcagaacttcagcacggtaggagtcgtagtagttgatggcagcagccagggatggtacaggaataccagcgttgatggccatggatacgacttcacgcgtagccttttggtacttcttggcaatgtccttgaagtagtcgtccaacagcaggttcttcagttcaggatccttttcaaaggcatccgtgatcttttgcaggaattgagcacgaataatgcatccttcacgccagatttgagccagttcaccgaacttcaggttccagtcgtagcgttcggagtcgatccgcatttgttcgaagccttgtgcgtagctcataaccttaccgaagtagagggcttcacgaaccttttcaaccagttccttcttttggtcttcagaaacagttggcttttcaacgtcttctggcagaaccttgcttgcagcaacacgttcgtccttcagcatggagatgtaacgagcataaacggcttccgtgataacggattgtggagcaccaccgtcaagggcagtttcagaactccacttaccagtacccttgttggcaccacggtcaaggatcatgtcaacgattggcttggacttgtcttcgcccaggtcatccttgcgagtcagaatgtcggcagtgatttcaaccaggtagctgtccagttcgcccttgttccattcagcaaagatgtcagccatttcgtcaacggaaagacccagaacattacgcataatgttgtagctttcgtcgatcagttcttcgtcaccgtattcgataccgttgtgaaccatctttacgtagtggccggcaccgttaggaccgatgtaggaaacacatggcttgccgtcttcagccttggcagcgatttgcgtcaggataggttcaaccaggtcgtaagcttccttttggccaccaggcatcagggaaggaccttgcagggcacccagttcaccaccggaaacacccatgccgatgaagttgatgccggattcgtccagcttagcgttccgtgccatcgtgtcgtggaagttggtgttaccaccgtcgatcagcacgtcacccttgtccagcaatggcaggagttcttcaataacagcgtcagttggcttgccggccttaaccatcatcaggattcgacgaggcttttccagagagttgacgaattcttcaaccgtgtagctaggaatcagcttcttgtcgctgtggtcacgcatcatttcatcggtacgtgaacgactacggttgtatacaccaacagtaaagccgcggctttcaatgttcagtgccaggttcttgcccataacggccaaaccaacaacaccaatttgcgctttttgatctgacattgtgttgtcacactccttaaaaacttaattacatcatttacagaaactattataccagaaagcgctaaaagttgaaaatatatttgctaaactttgcacaatccaattagttaccaggttttgtagaaaatgagtctataattcacttaaatcaattaagcaaattgagggcttgacgaaaaataattaggaaagcgttcaattacctattgctgttcatctaaaaccaaatgcaaatgtgaacgtatcaaataattaagatcgtcaatgttacaatcgctaaaagcagcaatgatctgctcacgctgtgccagcagggtctgtcaatcaaggccaggaacctttaaacacagacgctgaaaacgatttaaccagaggctgttaagatgcagccagtcccaaatctgacggcgatcggcaatttggtaaaaggtttggtgaaatttttgatctaaatcaaagaaaaggtcagtttgatctgctttgacagcttttttaggggcattaagattctgctgtagagtttcaaattgagctgacgaatgtttagctagggcttccatcattacttgcggttcaatacattctctgacaaaacgaccttccttggcgatgttcatatcgatagttgcgatataggtaccactttgcggaacaacattgattagcccttcgcgttccatccgaatcaagctctctctaactggtatccgtagttaatcagtctttctaaactaaaatattagttatcaaagattctatggaaaaaagcttttgaaagcaaatcaataaaaatagtactgatcggcttggtgcttttattggtaagtcttgatcacgttaacataccgcttgattaagttaaacaagtagggaattgcattcgtgatagcatttttgtagatcatgaatcacggaataaaataaaaccagcagttgtttgttactgctggtaaaagaactaatgatccaaagcctcattatttttattgatcacgttaacatattgttgcgaaatttgatgggttaggttttgtgaggtattagcagctgttaggttgctacttagcatagctataacgattaagccacgaaatagttgcatgatggtcactccttcaatcaattctcttgtgaaatttattttttctcttacttacaatcattattatagtaggcacaaattgaaacacaagtatgtgaaagctctttatttaagtgtaagcggattaattttattggcgatgacattagtctgaatcagctgatttttaaaaaatatgttcgatttaacaaataaaatatttttcacgttcacataaaatcgtgtaaagtcagtggtgataaggactagtgcaatctatcaatgatcagcaaacataaaaataacaaaaaagcgctttacaactttactaaaatgcaatatgataaaagcgttttcaaggatagctagcaattgtggaattccaggatccaatgaaaactctattttttaccgcctttatgttcacgtgaacataaaggcgggggtgcagtaaaaacggaggcatgaaatggatagtacaaatgttaaagcaagtgggccaggccaagcagcgcactcagtcgacaagcaagatgatgtgaagctgaacgactctaccaaacgaattcctaagcgtcagcagattgcctatggttttggggactttggcaatggcttcatgtttgacttgggccagtcatatttaaccaagttttggattgatggtgttggcatcggttctggaattgtagctgggatctttgcgtttactaagatctttgatgcattcatggacccgattgctggttcggtaattgataaccgcaagcatatcggcaaacaaggtaaattccggccggtaatgatgatttctgccattattctgggcattatgacggtgattacgtttacgatgccagatggactatcgatgactcagaaaatcatttacgcctatgctgcttatatgatctggggtttggtttattcatttaccaatgacccatatggatcgctagcatcggttatgtcgagaaactcgcaagaccgtagttttatggcaacatgtcgtcaggttggttcagtcggggctcagtttattgccggggtggcctttattccactgacggtcatgattggcggtaaagatcagcgattaggatacttttgggcttcagtaatctttgcggtaattggggtctgcatgttcttggtctgcttcttgggtactaaagaaaacgtacatgttgatcgtcaggttcatgaaaaagaaggctttaaggactatattcgagttattttccataatgggcctttgggtgctctgattctgatgacgctgtttacgatttcagcgatgaataccaacaatcaaatgatggtcttttacgctgaatacaatcttggcaacattggtctgcagccaatcattaacgctatcatgatgggttgctcaatcgttggggtctttatgattccaacactgacgcggcggtttggtcaaaagaagacggcgatgtggagctttgtgattggtgcggttgccaatctgttgaacttctttattcctgataacgtggtaacgtttattgctctggtcacgattggctatacagccttagcgattccaaatgggattacctgggcaatggtttccaatgcgatcgactatggggaatggcactcaggtattcggaaagaagccattacctacgctgcctttaacttctcgcggaagatcgcacagtcgttggctgccttagttagtgccggtgttttggcattgactggctatgttgctaatgctaagcaaacgccaggtgccttgcgtggtattaaggctgcaatgacgttgtatccaggagtttgcttgattctggctgccattatcattgggctcttgtacaagcttgatgatcgtcgcttcgccaaaatcgccgatgatttggatcatggccgttgggaacatggcaagattggcgaaaaataatcgtttttgatgataggtaaaaagtattaaaagttgtatgcattggaggatttaaaaatggatttaaagtcacttttatcagatgttcatgaaattttagctgacgttgatgctggaaaaggctttgacagcttaagcaatcaagaaatctatgcaccatcgattcaagttgaccggcgcaacgtttacttcattcttcaccataagaatgaaaaaggctatgttgaaaagagtctggtcgtttatgaaaaccggctgacagcaggtgattttgaagcgcgcgaatcaatggaagacgttgactcaacgcttttggttggtgatctgaacgaaaagaataatgtcgctttggctaaacgctttgcttggattcgtccggtttcacggcgcaactacaagtacagttttggacttggtgaccggcttggcaatgcctccaatgctcacctgcgcttgtttaagaaccgtggcattctaccagttttggcacaacaatcgattcgggaactgatgctgatgcaccggacaaatacggatgtgttcctgtctgcttcctgggctgtatttgaagaaggttttgactatggctggggtgcagatggcgaccacgttaagacggaatatgaagttgactatgccgttaaggttggttgctcaatgattactttggactgcacggaagttatcaataatgaagccgtaaacctgagtgatgaagaacttgacaagcgctttaacgaactggatgaggatcaaaagaagtactttaatgatacttacctggacaagacgtttaaggttggcgaatctgaggttcactttaccaagcatgacttggaagaatccgtcttgacgttctacgatgcaatcctgtttgcagctaagatttatcgtgactatgtcgtaccgtataacctagactttgaaatctcgatggatgaaacgccttatcaaacgacgaatccaaaccactacttctttgctaatgaattgcatcgtcgcggcattacgccagttaccatggctcctcgtttctatggtgaattccaaaaggccatcgactacattggcgataaggatcgctttgaacgtgaattagtcgttcatgaagctattgcggaacactttggctaccgcctgagcattcactctggttccgacaagctttcggtttatgaaattatcggccgagttgccaagaatggctggcacgtaaagacagcgggtaccaactggctggaagcatgccgcgtgattgctcacaaggatcctaagctgatggttgaaatgtacacctacgcttatgaacacttggatgacgttaagaacttctacgtctttaatgcgcaaactgatggcaaggcacctaagccagaatcaattaatgaagaaaacgtcttgagcgtactcagcgatgatgatggtcgtcaagtaatgcacacgatgtacggatcattgatgaacctgaagcacaactatcactatgtcttccgtgacaagttctgggatgttttgaagaagaatcaggatctgtatgaccgtttcctgaacattcatatcgctgaacacattgacctgctgcaaggcaagtacaagagtaaggaagaagccttggatgccttggaaccaaagactgacatttcaaaagaatactaataacgttttgacaccctcaaaggagcagacgtacgatgacgcttttaaatgatgattttttactgagtaatgaaacggctaagaaactgtttcatgaacacgcggctaaaatgccgattattgactatcattgtcaccttaatccggttgaaatctatgaaaacaaaaactatcctaatctgacccggatctggatcaatgaggaccactatggcgatcattacaagtggcgcttgatgcgggctaacggtactgatgagaagtacattaccggggatggcgatgaatatcaaaagtttctggaatggaccaaagcaattcaaaatgcttatggcaatccattgtatgaatggacgcaccttgaattgaagcgtttcttccatattgatgatgaactgacgctggaaaacgcgcctaagatctgggaaaaggctaatgcattgctgcagactgatgactttaagccgcgcaatctgattaagaacatgaatgtcaaggcggtctgcactactgatgatccagcttctgatctgaagtatcacaaactgctgaaggaagatgaagcggcaaatggctttaagactttgccagccatgcgtcctgataagctgattcaaattgatcgtgatggatttggcgcctacctgaaggaattgggcacggcagcaggcgttgagattcatagtttcaatgacatcatcaaggcaatgcggcaacgctttgaattctttagttcaatgggcggtcggctgtctgatcactcgctgttgacctaccactttaaggaagcaacgccagctgaactggatgcgatcgtggctaaagggattaacaatgaacctttgacgcagtctgaaattgaccagtatctgacaatgcttttggaagccttgatgcatctgaatacggaatttaactggacgatgcagttccacattaattcaattcgtgatctgaaccacccaatgtttgaacagctcggtcctgatactggctatgatgcggtcggtacgcaacctgatattgttgccaacatcgctaagctttatagcaaggctcaagacagcaatgacgtaccaaagacgatcttctactcgctcaacgataacgactggatgcaattggcaacgctgatgggatgcttccagggcgatggcggcgttgaacgtctgcaattaggtgctggttggtggttcaacgacacggcagaaggcatggatcgtcagttacggatctttgctcaacaaagtctgctgccgcactttgtcggaatgctgactgattcacgcagtttcctttcctacccgcgtcatgaatacttccggcgcgtactgtgcaatttctatggcaagttggctgaacaaggccgggttccagacgatctggataagcttggtaaaatcgttgaagatatttcatttaacaatgccaagaattactttgggttctttgattaattactaaccaccttgactgattcaacttctaacaactatcaataattaacaactgtacttttactgattaatttcagtatctttgaaatttaataaatgactaattcccccagattagtttaaaagatgcctggtagcgtgtgcttgttgcctggcatcttttttatatgtttaagaacgtttttttgaaaatgtagtaaacttaatattatcggaggaaaatgatgaaaaaaaaagagaaatcatctgtaactattcagaccgtagctaaactggcaaacgtttctcatacaacagtttctcgagctttaaatggatcgtcgttagttaaaccacaaacacgccaaaaaattgaagaaattgctgagagtgttggatatgtacctaactataatgctcgacgtttagtaacccaccgttcttacaatataggtattttcttttctaatttagatcaagggacttcttttagctttttagctaatacgattgaaaaaatggaagagacattgtcaccaaaatatactttttcaatcggtagtgtagaaaatgctgctaccatagggaaaatgtctcaacaaaattatgatggaattttaattatgagccaatcagataaagataatgatttcatcgaagctattcacagagaaaatattccattggttgttttgaatcgtaatttagtagcgtctgatattaataattttgcttttgatgatgaattaggtgagcagctagctactgaatatgcaattcgaatgggtcaccgtaaatttgctctaattaaaggaattgaaagctttgaatcggctaagcagcgtacgattggttttcaaaaggctttaaaaaactatggtattttttctgaaaaagtaatttatggacagggcaactatcgtccagaaagcggtaatcacgaaatgcgcagaattttgtcatctgtaaatgtgcctacttgcgtgatctgtgagaacgatgatatggcaattggagctattaatgcttgtatagatatgggataccgtgttccagaagatatttcggtaattggatttgatgatatgccatattctaagtatttgattccagaattaacgacggtgcgcaaaccaacgtcagaattgattaaaaaaggtgtagaacgtttatttaaattaattcaagatgaagatcaaacaattgtaaaggaagttttaccgccagaaattataattcgttcttctgttgcacaattaaatacagctcaaaaatgaaaatggcttaggatcaatatgcactagttagtgtcagattctaagtcatttttagattgattattttattaaatatcaatattggtaaaatagtttggatagcgctcaacgactttttgctgttcatcaagcattaagtgtgtatgaatatgagtaagatatttaagctcatcaatgtctttatttataaaagcatttagtatattttgatgatgtctaagtaaggtttgccaatctaagcctggtaccttcaatcgtagacgtcgaaatctgtcaagttgaatagtattaagctgtaaccactgccaaacactatcatgtcccgcaatcttataaaaagtatgatggaagtcttgatctaagtcgaaaaaatcgtcagtagatttactttgggcagctaattcttgcttcttcatatttcgatttaatagttgaatgtttttatcattgactcttacgacagcctgttgcataacgttttcttcaatactttctcgaacgaagcggctttctttggctaaatgcatatcaatggtagtaatatatgtcccgctttgaggtattacttcgattagtccttcacgttcaattctgataatagcttctcgtactggggttcgacctagctttagtgaagtagaaatcattttttcagaaactttttgttgaggcaagtagtgaaaatggatgatgttgtatttaatttggttgtaggcatcatcgcggatgttagtatccataatttaatacagtccttattttaaaaattattacttagctattatgataacaaaccaggtatttatcaatctagcttgttattttgtttcttttccaggtgctacatcatcagaaaggttgagtttagtaggatgcagctcaaattcttcgtcagtacgtgggttactttcgttcatagagaagttagatttatgcacagttacggttccccaagctggtacagagaaaatttgccacatatgagaatgcccaacaatatttagagcagctttgagtggattccctgtaggattgtaaatttgaacggcaattgaattgtcgtcttccaagaaagcggtcgatgttaaataacctgtataaccagttgctgaatagctagatgacttgattaatttgccattagggacgtcttgagataaattacgcaacatgtagtactctaggtttctttgcacttttccagtttgatggtcgattgttatgactcctcgtcgcccagttgaaccagcagcgtttggtaaaccacgttcatctaatgctagattccacagagtaattgatgatagaccttgacgaactaaccagttacctatcaaccccatcataatatgggatgcatcttcgatagtatctttaaataaacaacgtcgctcagtcataactaatttccaatttggaaattcgcgactagcattaaaaagattggtatagggtgcatcataagtatggaatgcaaagccatcgaaagcactagcttgtgtttgtgtaatgtaattagatagaggcttatctagagtgtttaagctaccatcccaataaaaaagtttagtttcgggaaaagttttatccaaagctggacgtaggtaatggtatccgaattctgctagttctttaaatgtccaaatcatcgctggccacatagcagcgtttgatggttcattttgaatagttaacgcatagattggaatgccgtaagaggcataggattgtagatattttataaaataattagcataaacagattcaaaacggtctttatcggcaaaaccatttcctgtgaattccccaaaacgcaaatgacctcccatggtaagctggcctgaattttttatccaagcagggccagaccatggtgaagcgatgattttgacagcagggttgatcattaaaatttcttgtaacacaggaataatgtactttaggtctttggtagcgtttgaggtacccggcttaccttctccaatggagaaatatttgagatcatggtcgttgctaccaaatggcaagtcatcgtatgaatagtaattttggctagaaaaatcgcaagcaccaattggaattcgaataacagagaaattacccttttcaggcgaaaaaagttcttctaacaaatcatgacgttgattagctgtttgattccagatgagttttgcagatgcatcggtgattgctgctccaacaccaatccaatcttgatattttacagattgatccacaacgattttatagacatcattagttggagtattgctatactcgggcgcttcaattcgataacgtttagatgatagatcaccagcagtgacagtccaatattcatttttgaaattatttgacataaaaattcctccttaagatttttgttttgttaactgtttgatttttttaatagtaataaacatacaataagctaaggctaatccccaagcagcaggattaattaaacaaatagtggtaaaacttgacatagtaatggcaataacactagttaagcttcgaccagttagttcacaaatacctgataggattgcttgaaagctatatccaagtccttgcaaagtattacggtagatcattaatgatccgtgtagaataaatgtcatagacataattcgaagatagaggctggataaaacaattaaatcatgatgataaccaagcataaattcagataattggggagcaaataacatgataattactagacaaaagatacaatagacaaattgaatctggatacccgctttaattccttgctggacgcgcttaagcgatttagctccgatattttgccccacataagtagtcatccccattccaatactttccattggtaaagtaaatgtttggcggattttttcgccagcagtttgtgcaattactattgccgatcccatatgattaatggctacttgcattacaattgcacctaacgcagaaatagaatattcaaatcccattggcagtgaaatgtacaataggcgtttgacgtgaacggtagagaattttaatttaggagttttcaataaactattattgtatttctttttaatccagaaaatatttaataatccactaaatagttgagctaaaattgtggcccatgcggctccagttacaccccaatggagagtaataataaataaaaaatcaagggcaatatttaagaagctagctaaaactaaaaaatagaaaggatgtcgtgaatcacccatagctctcaatacacttgctgaaaaattatataaaatagtgactcccaagcagctgaattgaggccgaacaaataagatggcactatttaacagattggctggtgtttttatgagagctagtagccaaggggtagaccaagtcatcattactcctaaaactatactgacaataatgcatagccacgttccattccagaagaatctttgcatatcaattttatttttagcgccaatactttgtgacaagggtatgcttaagccaatacaaaatccttggataaaaccgatgattaaaaaatttagtgagtatgttgcaccaacaccacctagtgcctgattactgatgcaacgaccgataatgattgaatcaacaaaactgtaaaattgttgaaaaaatgttcccaaaactaaaggtatagaaaaagttagaattttgtaaaggggtttgccttgtgtaagacttaaatttctattttccaaaaaattacaccatttctaatttaattaaattatagaagaatgagagaaaagcttatttcggtattttctaaacagaaatgacgctatatcaatttttaaggttgatatagcgtcattatttattacttgagtaagctaatgttagttattagcagattgattattttctttggtagtatttgctgcgtgacgtttcatcaagatcttggcattttcttcaacttgtttacgacctaatgggtaaacaaacaataataatatgatagccaagaaagcacaaactaccggaattagagtggcagcgctgtagatagcgttaactgtatgagtagattgctcagccccaccagttgtagatgatttataaccaacgtagcttaataagaaaccaccaaaaccaccaccaattgcttgagcaactttacgagcaaaggaattaactccgtaaactattccatcttcacgatcgccagaacgaacttcaatttcgtcaataacatcggtaatgaaagcccatacttgtaagttgaagacggcaaaacctaaagatccaaagaaaataaatgccaggtaaacataaggattcgtagttcgaattaggtaaagaactaagtaaatagcaaaactaataattaacccaacaatagaactgtttcgacgaccaaaatgtgaagcgatgtagtgactaaaaggtgagagcaaaataacagttgcagtattaacaaccatggcgatagccataacgctactattcttaaagtagtcattgtagacataggcgatcattgtaccagctaaattctggttaacaactaataccaaatctgtcaagattagtcccaataaagatcggtcggtaaacatggtgtgcataacagattttaaagaaactttttctgatttctcggtctgaacacgttcggttgtaagatggatcgtcatttgatagcaaataaagccgagaatagcacaaacaataacaacttcccagaaacgcattccagaaatcttcttagtggcaccaatgtaaatgaacatagggataatgtaagaagtaatagaactacctaaagcagaaccgatagagcgccaagtggaaagagaagttttatcgttagggtcgctgctaatagcagatgccaaggaaccatatgggatattaactgtagaatacagaaccccccaggcaatataagtgacccaaacccaagccatcttggctgccattggccaatctttgaccataggtacaaataatagtaccagagcaattaacagtgggtattccattctttgcatccaaggaataaaacgaccacgtttatgcagtttactattgtctaccaaacgaccaactacaacgtcactgatagcgtcgacgaaacgggctagcagaaaaacaatagcagtttgagatcctgtcaaaccataaacgttagtgtagaaaatcatcaaaaatgaattaactacgttaaatgaaaagttattaccaatgtcaccaaacatatagccgattttatcgtgccaatcgaaagggtgagcatcaattgtaatggtacgttggttacgttgtccgctattatccataatctaaaacccccagaacagcttaaacattattagataactaacagttaagttgaataattcaaaattttaaaaatgtcaaaaaataatatctaatatatcagttattagtgaaaagtaaagagatctcttaacgcaaatgattgtagcaccaccaggtagcgctttcaacgattatttttttttaaaacaacatttttctatgtaattatatgtatataaaaatgtttgatttgtagtaaaaagcgaatcttttattgacaacgaaactctgaaaacgtattctttaatcaaaacatatccattgatgcttctttttgattttaatttttctatttgaaaaatcgttttcttgatatatcagtttggtatatcagttagtatgaatttcttctggatatggaattgatagttgtttagtttagttgtttaaggagattgcttttatgaagaacagtaccaaactattatcgattaataatcaaagggattacttggaccttaaaacgaatgctgctcagtttaggatttatttgctagatcaaaacattatccgtattcgtgggacatttgatgatgaattttcgcccgaagaatcatatgccttagttaaaacggcttgggatgacaaaaccgatgaattaatgaaagacgagagacagcatgttaaaccaattcctattaaactaaatgaaattagaaagggacattttgccgttaataacggaaagtatacgttgcatatttatgcagaacctttttacatggaaattgaagatgagaacggtaatattatccacaaggatttacctaaacgttcatatgtggaagatgacaatggtcgtcgtacacactattcacaaatgggagatcacgaaaaattttatggatttggcgagaagtctggtccgctgaataaatatcggcgacggatgagaatgcataatactgactctttaggatgggacgcaaaaaagtctgatccgctttacaagatgattcctttttacattgatttcaacacggatagcaatgtagcttatgggatgtattataacaattctaatgattctgtatttgatatggattgtgaacatagtaattactggttacgctacagttattttcaaacagatggcggcgatttggatgttttctttattggtgggccaacgattaaagacgttgtagaacactatacagatttaactgggaaaacagtcatgatgccgaagtcttctcttggttatatgggttcaacaatgttttattctgaacttgaagaaggcgatgatgatgccattgttaattttgttgatacttgtaagaaaaatgatattccttgtgatggatttttcctgtcttcaggctatacggctggggaaaatgatggaaaacgttactactttcattggaacaaaaaacgttttccagaccctcaaagatttgttaatgatttgaaagaacgaggagttttagtagcaccaaatatcaagccaggaattttgaccacgcatccattggatgatgactttgctaaagaatgtgcctacgttaaagatcgaaacaatgataaagaccaagttgatcaatattggggtggccctgcgcactttatcgactttacaagtaaagacgggcggagagcttggagcaaacatatgacagattcgctgttgaagttaggtattacatcaatttggaacgataataatgaatatgaaacggttgatggctcagctcgtgttgatatggagggtgccaaagataaaaagatgagtgaggttcgaccattaatgtcgacgatcatggcaaagacagctcacacagctattcatagctacaatccgaacgcacgaccatatgttgttaacagagctggctttgcagggattcaacgttatgcacaaacctgggctggcgataactttacgagttgggatagtgttaaatataatattccaactattttagggatgggcttgtctggtgtagcaaatcaaggttgtgacattggcggcttttatggtccattgccagagcccgagttatttgttcgttgggtacaaaatggaatttttcagccaagattctcaattcactctgccaacaatgacaatacagttactgaaccatggacgtatcctgcttatactaagtacattgcacaagctattcaactgcgttacaagttagtaccatatttctactcgttgatgtatgaagcacatgtgacaggtgctccaattatgcggccattggtttatgaattccaaaatgatttaaaggtcgctgatgagagttttgaatttatgctaggaagttcattactagttgctaacgtattggataaaggacaaactgaaaaagatatctatctaccagctggtgcaacgtggcttgatttgcatactaatcaagtttatgaaggcggacaaactattacgattcctgtggatttgggtagtattccaatgttcttacgttctggtgcaattattccaagagcattaaatttgatgaacattcataaacaaaccattgataagcttgatattttgattgaaccaaccgaagattccgagtttactctgtatgaagatgatggtgagtctatggcctatcaagacggtcactttttgcagacccatatcactactaagttcgatccagaaggagtattgattaactttaaacgcaaaggtgattacccaactaaggttaaggtaatgaatctttcggtttattgcccacgaatggcaccgattaacgtagttgtagccggcaaaactctgcatcgttatttgaatgctgatgaatatgctaaggccaaaaacggttggtattttgatggagttacacgtcaggcaaaggttcgctatgaaaatccagacgttaatgattatcaagccaatctagaatttaccatgaaagatttaatttcaattcaataactagatagaaaggattagttattatgactttaattgatgataattttttgttaacgaatgaatggtctaagaagttatttaacgactatgcaaaagatatgccaattattgattaccattgtcacttgagtccaaaggaaatttacgagaacaaacattaccaaaatttagcacgtgtgtggattaatgacggaacagctggtgatcactataagtggcgtctgatgcgagcaaatggtattccagaaagtttaattactggagatggtgatgattacaagaaagttgaggcctttgccgaaacgatggaaaaagccattggtaatccgttgtatgaatggacacaactagaactaaaacgttattttggctatgataagccatttactaagaaaaatgctaaggaggtctggaaaaaagcaaatgcattgctatctcaggatgatttccgcccacgccaactgttacaaaaaatgaatgttaaagttgtctgcacgactgatgatccagcttcagatctaaagtatcacaaactattgaaacaagaagaacacgaaaatggttttaaagtgctgccggctatgcggcctgataaagcatttaatattcaatcggataagtttgctgactacattcaagaattagctaatatttctgaaattgagattaaagatttttctacactaattaaagcgtttgatcagcgttacgaatactttagttctttaggtgcaaagctgtctgatcatggaatcaatacattccattttgcgccagcttcattgtctgatgtagatgctgtctttagtaaaggcttgaacaatgatgaattaacggcgcatgatgtagatgtttatctgacggccttaattgaagcattgatgcgtatcaataagaagtacaactggacaatgcagttccatggcaatgttattcgtaacggaaacaagcaattattcaatcaaattggtgctgactgtggtggagattctattggtacacaggctgattttgctcaagaaatcatgaagcttttgcagcatatgcaagctgagaataatatccctaagcttattttgtattctttgaatcctaatgattggatgcagcttgctagtggtatgggtgacttttatggtgatggtattgatgagcatgcaaccaagcaaaaactacaattaggctgtgcatggtggtttaatgatactcgtcgtggcatgaacttacaattgcagatgatggctgaaaatagcctgttagggaactttgttggcatgctgactgactcgcgaagcttcctttcttacacacgtcacgaatatttccgtcgagtattgtgcaactatttgggaagtttgattgaaaatggtcaagcacctgctgatattgaagttatgggtaagatggctgctgacatctcctataacaatgcacatgaatacttccaatttggtgatgttgaatagctgaaaggcaggcattgatgaatgcaaataattgaaaatgaccaatttaaagccgaaattgatgaacacggtgcacagctaacacacttgttcaataaatctgaaggttttgattatatttggaatgatgatttgtggccaaaacatgctccagtactttttccagcaattggtcgttcggaaaaagatgcatatttctacaatggtcaagaatataagatgcctcaacatggtttcgtagctgaccaagactttaaagtagaaaaaaatacgggaaattgtttaatcttaagtttaacagataacgaaattacacgaaaatactatccttttgcatttaagcttacaattatgtttagcttaaatttgacaggcataacgtttaagttcaatgttgaaaatattgataataaggatttaagtttttcattgggatcccatcctgcgtttaatgtaccgattaatggtgaaggaacatttgatgattaccagatagattttgaaccatccggattaactttaaaacagtttgaaattgttaaaactccaaacccataccgagatggcaaaattataaaactaaatgctgctaatggtagtcatattaatttaaatcatgaaatgtttgaaaatggtttgattattatagaaaatgatggcattcaaggggctttattgagttcatcaaaaacaaagcattccattcacctaagtttggatgattttcgctatgtttgcttgtggactaaagagggggcaaatgctccattcttgtgtattgaaccatttgcaggtttacctgatattgcaggccatgaggttgaacttatggataaagaagctaacacgcaattgcaacctgggcaaaagaaaacctttgagtacatgattactctacgctgattttacaaattgagaagagttagtttgactgctgattcttcttttcgtataccaaggaaaagagatgccttcgatcgatgagcataccaataatcaaaaaaatggatgtatatcctgttgcgggttacgacagcatgctattaaatcttagcggagctcatgagccattttttacgcgtaatgtagttatactaacggatagtaatggtattttaggagttagtgaggttccgggtaaccccaaaataactcaaatattgaaaaaaagtcggtctgacgttttgggaacacgattatttgactataaaaaagtcatgcgtgttatgggagaaaaatttagtcaacttgatcaagatggtcgtggacaacaaacatttgatcaacgtgttttaattcatgctttgacagcggtagagacagctttcctagatttaatcggtaaatttgttcatgaaccagtagctgaattattaggtgatgggcaacaacgtactgaaattccaatattaggttacctgttttatattggggatcgtactaaaactaaccttccgtatttatcttgtgatgatgagtctgatgattggggaagaattcgtcgcgaacctgctatgactcctgaagctgttgttaaagaggctcaagcggcttataaacgctatggttttaaaacttttaagcttaagggtggagttatggatggtaaaacagaagtggccacaattaaggcgctgcatcgagcctttcctgatgctaaattggatttagatcctaatggtgcttggtcactggatgaagctgttcaatatgccaaagaactaaagaatgacttgctttatattgaagatccatgtggtgctgaaaatggtttctcaggtcgtgagattttagctgagtttcagcgactaacacatattccaacagctacaaatatggtagataccgattggcgacaaatgtctcattcgttaatgttaaacgctatttctattccgttggcagacccacatttttggaccatgcaaggatcagtggcagttgctaaattatgtcaggcttttagaatcaattggggaattcattctaatagccattttgatatatcgttagcaatggtagcaaatgtcgctgctgctgctccaggcgaaatctatgctgtagatacgcattggatttggcaagacggccaatttctgacgaaacagccttatcaaattaaaaatggttacttacatgttggtaaagatattgaggggttaggaattgatgttgacattaaagctgttcaaaaagctcatgcattgtatataaatcaacatttaagttctagaaatgatgctttggcaatgcaatatttgattcctggatggaaattcgatcctaaaaggcctgcttttgtaaggtagttaatttatagtagaaaggaaagatgaaatatgttatatcctgaacaaactgtcactagaacattagaagatttatcaggactttggaagtttcaagtcgaagatcaagaaattgaccctaagcaagctttaccaaatccaatgtggatggccgtgccagcttcgtttaatgaccagattgttgataggaaactacatgatcatattggatggttctggtatgaaacaaaatttaacattccagtagaccaaatgaaaaaacgtaacgttttacattttggatcagtgacgcaaaattgtgaaatttatgttaatggactaaaaattgcagaacatattggtggttttacgccttttgaagtagaaattgataaagctattcatgagggtgaaaatgatctaaaggttcgctttaataacttgttagacaatacaacgattccaacagctgatctaaaaaatattggaagcggcgattatcaaatgcgaacgcgctttgatttctttaattattccggaattcatcgtcgtgtacaattatatacaactaatcggacgtatttggatcatattgctgtcaattacgatgttgaaggttctaaaacaatgattcatccagatatccatgtttttggcaactacggttctgctaaaattaaagttttggatgaggataaccaaattattgctcaaagtgattcgctagatggaacattggtaattgccaatacacatcgttggcaaccaatgaatgcgtacctttaccgtctgcaagtagaactttttagtaataagaatgaactgttggatgtttatacgcaggaatttggagtacggacaattgaggttaaggatcataaattctttataaatggtatgccattttacttcaagggatttggtcgtcatgaagattcgctagcaagaggtaagggagtaaatttgccattagttaatttagactatcatattatgaagaaaatgggagccaattcattccgtacatctcactatccttatgatgaggaagctatgcgtttggctgataggatgggctttgttgtaattgatgaagtgccagccgttggactttttgaaaactttaatgtttctttaggcggacgtatgcaagctggagaaacttgggtgcatatgaatacgatgaagaatcataagcatgcgttacgggaaatgattgaacgtgatcatgatcacccaagtgtcgtaatgtggtcggttgcgaatgaaccagctagccatgaacctggggcgcatgagtactttaaagaaatcattgattatacaaaaaaactggacccacaaaaacggccggttacggttgttaatataatgcatgctgatgcaactaaggacttgatcggcgacttattagacgttgtttgcttgaatcgttattatgggtggtatgttgactttgatgatttagagcaagctaaggatcagctacaaaaagaattatctatttggaatgaaaagtttcctgataagccaatcatctttactgagattggagctgatactgttagcggtatgcattcagttatgcggactccatactcagaagaatatcaattggattactacaaagctaactttgagatctttgataattgtgattatgtacaaggtgaacaattatggaattttgctgatttcgttacggaacctggtatgatcagaataggtgccgaaaatcgaaaaggtgtctttacgcgcaatcgtgaacccaaactaattgctgaatatttaaataatcgttggaataactttcataaaaagtagatttaataaataatttgggcctttatcaaatcgtattgatgaatattaattccctgcttcaaaaatgagaagtggggaatttttttaatcgcggatgcaatcaatgcgtcacagcagattttaaagagtaagcacaccatattgaaccgtgttgtctgctaagcagtgggcaatttcaaaaattaaagaataaaaaagcagcggtcgaccggcgcatttctgcgtggtcgaccgctgttcatttatcaattaggctttgcagctttcttgaatttcacgagcccatggcaaataagcctctatttctggcgtttcgcgttttgtaaaggcgctaagcagggtctctaaatatttaaagacatccaaatgatttagttttgcggtttgcacgatgctataccagatcgcattggctttggccccagccgtggacttcgcaaacagactgttctttctgaccagcgtggtgggacgaatcagttgctcattgtgattattatgcaatggcagctctccatgcctgaacatctggtaaacccgtttcttcaatttgagggcatttttgatcgcattgcgtagcggtttgagtggcgatttcgtcaaggcttcttcaatcagctgatagaaatcatcaatcatcgcttttaaatgctgacgcctttgggctgccttctcacttgctgatgaatatttcaaccgtttttcgatgtgaaatactttggcaaggatccgcacagcgtcactcgcaatactttgcccttgaaagcgggtaatctttggatcaagcagtcgcttaaattggcgattgatatgaaccagacaggtcccccaatacgcttctggtaagcgattatcagaatatccactaaacccatcgcacataataccgccagaaaagtcatcacctaagatttctgtaataacctttcctgatcgtgaaggggcatagtggaaataagatacctgatgcggactgaattcttccgtagaacaggctgaccagaagtagccatgtgattgatcaagatccagaacttgaaatggcgtctcatcaagctgcaccacaggtgctgccttgatttcttgacgcagacgttcataaatcttttgcccaaacctttcgccagcttcaattaccccacgagccatatgtttactggtgattggaagcccgaggcgctcccaatactgcgtctggcgggtaaacggtactgccaggccaaacttttcaaaaagtacttcggcgattaccgagcttgaaaggtaactgtgtggaaacaaaggctgtggcgtctttgcctgaacaagtacatcattgccagtttccggatcttgacagtgttcgcatctagccgtttcagtacatacgattttgcagcacaagtgggcaggaaccagtttaacttcacgatactgttcatgtttgccgataaccgtcatcatttgaccgcattgatcacaagttagttcttgcttactcagctgatgaagttcttcaacttgttctaagcaatcaagccattctttacgtgattcctttgatttgcattttctctgatgactggtaacggtagtggtcaacttttcgactgttgaatcattcgttggcgcggtttcctgttctttatcatcaaacagatccagctggccagcacttaatttttcagttttttttccaaaaagttgcttttgcagatagtttaccatctcggtcagttccgcgatcttagcctttagttctttgttctcacgcaaagcttcttctagagtgatcttctcagccattaccaatcacctcctctattatctgatgaccattaggttatcagataatggaggcaaataaaagaggaacttgttaataccctggtcccttaatagctggcctgattcgtttctgaggcagtggcgagataccttctaacaatgccttaatctgactcttggttaatgccactgcgtcttctcgatgtcgcggccatcgtaatccaccattttcaaagcgtttatagagtaagatgaatccttcaccgtcccagtataagcctttgaagcggtcattacgattgccacaaaacaggaaaagcgaatcattatctaattccaagccataattctctgcgatcaccatggccaaaccgtcaatgcccttccgcagatcggtcttgccacaaactatgtagacgtgctgaggagcactccagttaaccagcataagcggctactgctttaatgatctcactaaccaaagcgggatctgcttcttggtagacattaatttttacttggtgcagtgaaacgatagctgccaagcgtgagtgcttagcaaccggcttctttgttcgcggtatatcaacttcgacaaaatcttgcttcataaaaaagtcctcctccttgaatatgtcttcaagtataggagaacttgggatttaatcatatgcggttggttatagtgtgcttactttaaagattgcgtagtccgttgttcattgtttttgattaaggtcgaaaggctgtaatcaggataatgctactcaaagggatacgacaatgcgtccttgatgatgttgcggatctcgccatcagggactgtggcagaaaaatcaagaactttgatattagaggtttcgattttaaagaactctagcatggaacgattagtaagaggtagctaagttgtaacttaaggggacggttttgctatatacaaaatctaatattagtaaaatagtatagacttaataaaacagaggtcgaacatgcaaaaatgcatcgatcgacctctgttttttgtaatctttcattttggaaattggatgtcaattgcttattagataaaaatttcaatatgaaatgcttgcttttaagtttcttgacgtcattacctattattgataaatttctaattactttgttttgtgtagagtggattttgacaattaaaggaatttaaagaatattttagtctttatagatttttgaaaattcacgttgataatcggcaatgctttcgtattcttttgacaattctcgactaagtcgaataaagatagggattagtttacgataagctttgtagttatctttatttggctggtacttcttttctttaccaatatatttagtaataccagaaagattactctccattcctaagctcattttagccagatacatggcagctagacaaccactttcataagaatcgggaatcgtgacatcatgttcataaacatcagccatgatttgtcgtcctagcgaagattgtacaaaaccaccagcggctaaaatttcttttggctttccagttacttccgttaaagctaaagttgtcatatataggttaaagacaattccttctaaaacggcacgaatcatatgggctcgtgtatgattacgatttaagccaaagaaactaccacgagcattggcgtcccataaaggagcacgctctccacccaaataaggatgaaatagtaagccagctgaacctgcagggacagtttttgcgatatcggttaacatgttataagagtcttgcttaagcaattttgcggtttcatgttctgcgccgaacagagcatcgtgagcccaattaaatacgatcccgccgttgttgattggaccaccgactaaatacttaccttccataataggatagcagtataaccgtgctttgggatcaattaatggcttatcaacaaatgaacgtacagcagctgaagttccgatattaattgctaaaacaccagtatccaacgcaccaacaccaatagttgatagggcaccatcagttgcgcccataacaacactaacgtcggcactaatgcccataaccttggcatactcggaacgaatacctttaatactatgggttaatggcactaaatcaggcaattgtgaacgcttgatccctaatgaatttagaatttcgtcatcccaatcaacagtatgcatattcaaaagtccagtggctgctgccattgatgtttcttcagccaaaacattagtgtaacgccaaataatatattctttaataccaacccagaatgcaactttgttaaaaatatcaggatgctcatttttaagccacagcattttatagaaaggtcccatgggatggattggtaagcctgttcgcttatatatttccattcctttaccattttctttgtatttacgagcgtatttttcagcgcgattatcggcccatgtaatagattttgttaatggtttgtagtctttatcaagggcaaggatactatgctgttgcgctgaccaggaaatggcaatgacctgctgtccatcaatgcgtgattctgccacaacttcttgaatagctgaaattgtagcattaaaaattgcatcaggatcttcttcggccatgtcaggtaagtcttgataaagtttatacccaatatttgctttagcataaatcttaccgtttaaatcataaagtaatgccttagtacttgtagtgccgatatcgattcctacaatatatttcattttttatacttccttgtgctttaatatttgtttcaagcgcgaatatggaaaagtaatatatcagatatgtggatatttacattttagttgcttttacatagttcgtcaactactactgaaaattaaaattacaagttaattataaggacgattaaacattaatagactaaaaatatttaatttaagagttgacaagtgtataaaacaatatataatgaaaacgtattcaagcgatgctgatatatcagtttttcggagcaaaactttggaggttttcctaatggttaatatcacggatgattatttgaaaaacaaagatgaatttactgaagtcggcattaaggtgccaaactacgatgataaaaaaatcgctcaaaatacgttagccaatccgcgctgggttcactttggcggcggcaatttattccgagcctttcatgcagcaattgccagtcatttaattgatcaaggcaaaatggattccggcattatcgtttcggatgcctatgatgacggtacgattaatggcgtctatcgtccgtacaataatcgaattctgcgggtagttaccaaagcagatggaaccaaggatcttgaattgtttgcttcagtagcaaaggctgtcttttcaggtcgagctactgaggatccaagcggtctcaatgaaatgaaacagatctttaccaaacctagtttgcaagttgtttctttttctattactgaaaagggctatgccgttaaaaatcctgatggtcaatacctgccggcagttgcacgtgatctggaaaatggcccagcaaagccggaaaatacgatgtcgatgattgccagcatgctgctgagccgttatcaaaatggtgccaagccaattgccatgctgagcactgataacttctcgcaaaatggtgaccggttaaaagaaagcattttaacgattgccaatggttggctggaaaatggctttgcagatcaaggttttatcgattggctctcagatgatgctaaggtctctttcccattgtccatgattgatcgaattacaccgaacccatccgaaacggtcgaaaaagacttgaagaaattggggattgagggtgtcgacattgttcataccaagaaacacaccaatattgctgcttttgccaatactgaagaggcacattatttggtagttgaagacaagttccctaatggtcgaccagaatttgaagcagctggcgtaatcatgacagatcgggacacggtcaacttagccgatgagatgaaggtaacggtctgcttgaaccctctgcacacggctttggcaatttatggttcagtattgggctttaactcgattgctgctgaagtcaaggaccctgatttaaatagtctgattaaacagattggctatgtcgaaggtctgccggtagttagagatccaaaggttattaatccaaaagcgtttatcgatgaattagtccaaaagcgtctgccaaatccatatactcctgatacgccacaacggattgccacggatacgtcacaaaagctgggaattcgttatggggtaacgattcaacactaccttgatgatccagaccgtgagccaattcaactgaactttattccactggtaattgctgcttggctgcgttacttgatggctattgatgataatggcgaatcgtttacgccaagtccggatccgctttgggattcactgcacagtcaagttgctgatctaaaactaggcagcgcggatcaaaatgttcacgatgatgttaaggggattttgagcaataagtcgatttttggcaatgatctttatgcagttggcttgggtgacaagattgaagctgactttaaggaaatgctggccggaaaaggcgctattcgtaagacattggaagaaaaactcgctaagtatggtaaaaacgtcgattaatcaaaggaaggaatttattaattatgtcagaatacaagattgcagtcgttaactctagcagctttggtcagatttttaaggaacactggtcagaattggaaaagattggtcaagttgatcgctttatgtttgcaccagatatttctggcaaagagctggctgaaaagctgcaaggctacaacattgtcattgctagtgttacgccaaactttactaaggaattctttgacaatattactggactagaactgatctcacggcacgggattggctttaacagtgttgatattgcagcggctaaagaacatggcgttaaggtaactatcgtgccgccgttggttgaacgtgatgccgttgccgagaacgcggttgccaatttatttgcgattgctcgtcaaacttgtgcggcagccaatcgtgaagctgctggtcattatgaagatcgggcacacttcatgggccatcaatttaatggcaagcagtatggggtgattggttgtggcaatatcggcagtcgggttgccgagatcttccatttggttagtggaggcaaggacgtcttaattgctgaccctcattcacgtgctcgtgaaggatggtgggaacaaaacccatgggctaagctggtatcacttgatgaattgctggctaactgtgattacatctcactgaatgcttcattggatgaaaaagattaccacatgctgaatgcagaggcccttaagaagactaagcagggcgtttactttaccaactgtgcacgtggggctttgattgatgaaaaggcaatgatggatgccgttaagagcggtcaagtagccggttatgcatctgatacgatggaggttgaaccggttcctggtgatcatccattcctgcatgatgaacatttcttgattacgccgcacacttctgcttacacttatgaatgtctgtatggtatgggcgaaaagtgtgtttccgatgttaagaatctggtagctggcaagccattggtacgtgaactgaccagtgaattagactagcaacaaacaaagtcgcagcgatttttcgctgcggctttttgaaaggagaaaattatggccgatcctttaaatatcttgcatacggttggctttgaagctttatatccaattgtgcgctgtgaaatcaaatttaatcaacctttggatgctgaaagattagaaaatgcagtagtttctgtgactaaggtcgttcccgagttgatggcaacatatgatatcgataaaaatgagttccaaaagctgtcaacacctgcaattagcgtgattcactatgttcaaagaattaatgatcaagctgctgcgaaactggattttgaaactcaaccccaatggcaaatttattggtcagtcagtgaaaacaagttggtaatctatggcagccatattttaactgatggtgcaggattcaagcagcttttatatttattggcagcttgctacaccaaagagcagtcagtagcgattcaaaatcatacggatatcaatggcatcaagaaattattagagcagattaagccatctcagctgaataacgaccatccgcgaacgccactgtctttgccgcgactttgtgattctgcaaagcagcagcgtcactatcaggtcattcatgatgagttggatcttaggcaatcgcatcatctgcactatcagtgtcgaaggctgggaattcatttaaatgatgcgtttatggcagcatatggcaaagcagttcagcagtattgtggagtcgagacgattagtttggcttgtcccactgatatgcgcaagtttttggcagtagacgatcaaaaacagctacgaatccaaaacatgaccggccgctataacatgcagattgaagcccctttgagcgaatcaatggcggatacggcatggcacgttcatcgggcaatgaatgagcaaaaagagcaatacgcgtttttagagtcatttcgttcaatgattgccagcctggctaatggcgcttcagttgccgaactgcagcaagatgtgcaggagcattatcatgttcgtggaatttcctataccaaccttgccattattgatgctgaaaaactgaattttggtgatgcggttcccgtttcttgtttaatgagcggtggctttcgtgaaatgcctaaatatcaaattgccgtcagcacgtttcgcaagcggatcaatctggttgccaacattatcggcacaccccaagaaatttggttggccagagcggtaatgaatcaaatgaaactgtttttgctgacaatttaaagaaaattaaaaccccctcgcttcaggtttctgaaacgagggggctagcctttaccagcttggcaaagggtttaaattagccgtattttagtgattcagatggtaaacccattgacggccatcgcgagccagcagttcgtcagaagcagctgggcccattgaaccaggcgtgtagttagggaattgaggttcttcaatgtcccagagcttgcgaataacgtcaacgaacttccatgcgtaggcaatttcagcccatgatgcaaagttggtgtggttgccttccagtgcatcgtggaagagacgttcgtatggttctggtgattcgttcttggcttcatcgctttgcaggtacttcaggtcaactggttcagtcgtgaagccttggccggcgcgcttagcgttcagacgcagtgagaagccagagtttggttcaacaaagatcgtcagaacgttggagttcaatgactgttcgctcttcatccgtgggttggcaaagatgtcgatcagcggcttcttgaagacaacgtcgatacgggtaaacttgtcagccagcttcttaccagtccgtacgtagaatggcacgccagaccagcgatagttgtcaaacatcagcttggcagcgacaaaagtttccgtaatggagtttggatcaacaccatcttcattgcggtaggcatgcgtgtcatcgccagcaccgtattggccacgaacaaagttggcagctgcttcggatggggtgtagactcgcagtgaacgcagtgctttaatcttttcaacccgaacgtcggtgtcggtaaaggcaactggttgttccattgccagttgagcaacgatctgcatgatgtggttttgcagcatgtcacgcagcgcaccggattggtcgtagtagccggcacgttcttcaacacccagtttttcactcagcgttacttggatgttgtcgatgtagcggttgttccacagcgattcgataatcgtgttgccaaaacgcagggcttgaatgttttgaaccatttccttacccagatagtggtcaatccggaagatttggttttcgttgaacgtttgtgacagttcgtcgttcagcttcttagcggattcgtagtcacgaccaaatggcttttcgatcaccagacggttgaagccatccttggtcagcaggtcctgcttcttcaagttcaaggcaatcgtgccaaagaattgaggagccatggacatgtagaacaggcgattgccttcagcaccaaattgcttgtccagttcttccaggcgttgcttaagcacagtgtagtgttcaggcttggtaacgtcatgggattggaagaagaagtgcttggcaaatgcctgagcttgcccttcttcgttttccataccgttgacagacttcaaaaccatttgttggaagtcctcatcgctcagcggacgccgagaagtaccgagcagagcaaagtgttctgccaggtagcctttcttgtaaaggttgaataatgatgggtacagcttgcgttgtgcaaggtcgccggctgccccgaacagcgtaattaaagctttattttccttagccaaaatgttcactccttctgaaaatatcagaaaatcactctaacgcttaaattatatacttttatgttcaaaactgcactagaaagcgtccccactttttgcggaattctcaaatggaccacgccgaaaaaaagcgcgttctggggttttgttaaacgcttatcagacaatggtataggccgaaaataaaattttattttagcgtttagcgttgatctaacgttaaagcaatcgcttgcacatatctgattttttagtaaaaaaacacgcctgcttcaagcacgcgtgtttttgatgatcagtaattagtcgacgtaaggcttgcgttcgctcaaaacgccaaaaatggtgaagacaacggcaaccagcatggtagtcagttcaccggcaaaccatgaaccgctggcagccttaagattaccgacgagcatcggaccaaatgcggccagcagatagcccaatgattgagccatgccggacagttttcccgtgttaaccggcgtcttggtctttaaactgaacagcgtcatgatcagggcaaacgttgccgaggttccgattgccaagatcaaactgacaaagacaaaccagccaaagctatgaaatggcatcatcaagccaagataccccagaatcgtgaagataccggcaccgagaatcagcggtgttcgattgcttagcttggttgcccataatggcgctaaaaaggctcctggcatggagaacagctggaacagccccgcgatcagacttgactgattgctgcttaaaccggcactgattgcaattgatggcagccaggcaaccgttgtataaaagacgaatgatgacagaccaaagtagaccaaaatcagccaagccgtcttgtttttccacatgttgatgccagtactggtggcttcgctggttccacgctggttgaaacgcagatttggcagccataataccaatgtcgccaacaccagcatgctgaggagcattactgagaactgccagctgctgttttgcgcaactggggtaatggcataagcaccaattgctgagaagagcgctaatgaaacattataaagactggtcattgaaccgatcttgtcaggcaggttttcagtgatgatggcaggcaggagcacattcaaaaaagtaatcccaatgccgaccagcagcgtgccgatcattaatgaagcatagttgagaacccgcagccaagagccggcaaataagatcagtagggcaatggcaatcgtcaattcattgccaagcttttgtccgatcattggtactacgaccgcgaccaaaccaaaacagatcaaaggaatcgtagttaaaatccccagactggtagtggcaacgtgaaatgaggcggcaatctcgccaacgattgaagggatcgaggttaccggcgtccgcatgcaggcgcccagcaggaaaatgcctaaaaccagaaaggcgctgtgtttgcgcgtgttgttcaaaatatcattcctttcttgattaatgaatagttggttatttatttccgcttttttctaagaccacgtcattgtaacatgaatctgcacaaagtttaacgatttacatgcaacaaaatctatatgaacgtcaaaatgcagtattcgtcgcaataaacgaccattagcgcttacctagctcttttttgaatcgaagtcgtgatttgacgaatgacccgtggctccctataatttaaaagaacactttatcggaggaaaattatgacggcaaaaatctatccgtatttgacttttgaaaatgcgcgcgaagccatgcattattacgtggaacaatttggcgccgagatcatttaccgtcagccgctttcagcagaacaagctgaaaatcttggcttggcattggatgatctggatgccacgacagcgcacggtgaattttcaattgtcggacagaaaatcgtctgtgccgatgcaacgatgggcaatccccagacttcttcgctgatttccctgcttttggattttggcggtgatgaagcaggtgccaaggaattatttgatcgtttggctgccagcgacgcacagcgcgtaaccctgccttttggaccgcatgaactgggcggcaatctgggacaaatcgttgatcagtacggcattacctggctgatcagcgcaggaatcccacaagaataaattgacgaagcaaaaagcgaatctggttattgacgactggattcgctttttactattcaaagctggcgggatcggcaatcacgttatcgatgccattaggattgcctgaccatttgaatttatcgtaccagatggcatgttcttcggtatccaaagtatcgatctgcatgcattcggctggtgacagttcaaaatcaaaaagatcggcattttcccgcatgcgttgtgggtgcgtggttttagggattacgatcagatcatgctgcaaagcccagcgcagttcaacttgagctggcgttttttgatgactttgcgcaatcttttcgataatcggttcgtgaaggagcgtaccattccccagtggcgaccaggcttccatttggatatcatgctgctggcagaaattgacgatggctggctgatgaatcttgggattgaactcgatttgattaatggcgggcgtgatctgggcatggtccaatagatcacgcatgcgctcaacatcgaaattgcagacaccgattgccttggcctgaccatcggcatagattcgttccattgcctgccaggtctggttgtataagtcgttgaccggccagtgcatcagtaacagatcaacgtaatcggtctgcaaagcttgcagctggccttcaaatcctttgcgtacgcggtcgtagtcgccttgatcgccattgtagatcttggtagtcaagaaaacgctggctcgggtacgcccggtagattgaaaggcatcctgcattccttgaccaaccgcgctttcattgccatactgcttggccgtgtccagcagcacatagtcgttcgtcagggcatcgcaaaccatctgccgggtcgtttcaagcggggtcttccaaacgcccaggccaatctgcggcattaaaagaccattgtttagccgaacttttggctgcaaattttgattcaaaaaatcatctccattactgcatgaaatcgataccattactaatgctattataaaactatttgttcacgtgaaatattaagaatttaaaaaagcatggccaaagactgccatgccgaaaatattgttgattagacgttgacctgttgccagcgcttggtcagaatagcgtagatctgctcaacatcctgactggtaccacgcagctcgtagtcagccaagaatggtaccttgaattcataggcatacttgcgggctgtcagacagtactgttcgttgaaattgcgattgccgctgccaaccacgcctaagcactttttggcattatcgttttctgcgatgtattcacccaaagcattggtcatcagttctttaacgccagagtcaaagccattgccaccgtccagataagttggcacgaaagcaaaaaatggttcgctttcggctgccggcagtgtttgatcggtaatttcctttagattgatggtgggcagctgcgggttgaaactgtgctgctgttgggcgtatgcctgcaagcgggtcagaaatgagcgggtgttgccctcgatagagataaaaaggatgttcatgtcgtttgatttcctctttcttattaattaatagtcgataacctatattctagccgatttttagagcagttgacactgtctttttagtttaaaaatggtttggtgccgcaaccacgttataataaaagcaaacgacttagaaaggatgattttccatggtcaaaatagtcacgcataatttgacgattgaagccgataatggcagtcggttgtcaaatatcgacctgacgctgcagtcgcctaacgtagtagctttttgcagtgatgatccgctgtttggtgagacgctgttttcattgctgcgcaaacatggtcagccaaccagtggtatgattcagatcaacgaccagcctttaaagacttttcgccatccagaaaagtcgctggtgatgctggatgatcttagatttaaggatcgttggacgattcagcgtgcgattcgtcaagcgcaaaaaggcagtgccaattcaattgatgatgaacaggcccgtcagattctcagtcagtttgatctggattggcagcttgtaatcagagacctcaatcgaaaccaaaaaattgagctgagcataattctgctgctggtcaaacagccgtctgttcttttgcttgaccacgcaacggatggcttgacaccgcgggaagcaaaggcagtttggcagctgttgcgcagttatgctcaaaagactgatgcattgatcttgatgaccagcagcaatatgacgaccatgatgagctgcgctgatgacatttattatttcagccgcggctatttgacctcgacacgccatttgcatccccaaagcggcgttgactgcgtagtcacggttttcggcactggatttccgattgagacggcccagaagctgggagccagaattctggaagaagcgccgcaagaaacccgttttttatacgcgggcaatattcaagcaattctgccgctgctggagcaaagcacgattactgacgttcggattgaggatgccacggtagcagacgaactgatgacctactagtaaaatgaggtgagattatgaatcgaatcgtattgattgggcggcgtaatgatggtttgcgcgagcgcctgctgtcattgctgccggatgctgtggtagagccaagttttcattttaagctgcaaagccaagacgtcttgtgctggctgcctaagcctgacgatccggttgaccaggatgtctatgacctggttgacctgattgatgacagtaacgtaacgccagcaaagatcgtaatgctctcaattgccggcacagccgatgatgcctctgatgaacagctgcagaaatggtatggcaaatcggctttggacatggtattggctcatcaatatgcgattaagatgattgacgagctggagtttccgtatgtgatcgtgcgggcgctgccaattgttccacgcgaaacggccttaaagattattggcgagggccagccgctaacgggccaagcagttggtttagctcaggctgccaatgtattgaagatggcattgacgactgatcaataccgcaatcaatctgtgggcatcgaagactaaattatgaatgctttaacgaccaatcaaatgtagtaatgctatatactggtttcgaagactatctaattactcgaaatggaggaaccaaaatgacgagttttaaacgctggcaggctaacctgggcaagattcagctgccacactgggatgagctgccagacttggatctttatgtcgatcaggttgttgccttggttaatgatcgcgctatgggaatgggcatcgcgccgattaccaagtcgatgatcaacaattatgttaaaaaaggcatcatcatggcgccagtaaaaaagaagtactcgcgctaccagctggccgcggtgattatgattgccatgctcaagggcagcttttcgattccttcaattcatgagggcatcaaacaggttacgatcaataattatccgcagcaggcctatgatcgcttcgtcgacttgatgaatgcccggctgcataatgaatcagcagcggtcgacaatcagcttgacccggtgaatgaccagctgatcaattacgttgtggaaacgctgttcaaccggatgcaggctgccgagctgctaaagaccatgcaggaaactcaacagccgcgcgacgtcaagaagggctaatcaagtgcttgagccagtctggttagataagcatgactctgcagctgttcttggcagtcttcctggttggagagattgatctcgtaaatgctggtagcatcaggattcaagcatggcaagacaccgcgccagtcaatcttgccggttcccagtggcagactgtcatgggtttgccccattgaatcgaccaaatgataatgaacgatctggtcctttaaatgccgcagcgatttttgcaggccttgattattgccgtgcagccagatgaagcaatgcgaggtatcaaaggccagccgataatgatgacttaaaatctcgtcttccattgctggatcgccataggcaaataccggtgcgatggagttttcaaacatgatgtgactaccgccagctttggcaaaacgatccaggcggtcaaatgcagcttgctgggcggccaccagattaggatagcagtcgatgtattcagttgtttcctgagcataggcgccgtgaatcagacattgaacgtcaagatccttagccaaaccgatcagctgcattgtggtttcttcaacaaaacgatacagttcgggaaactgtttttcaggggctacgatctcagcgtgggtagcgccaaacttcattggatggtgcagaacgatcctgctgacgccacggctctgcacgtattgaacggcttcatataagtgctgatagccattgggcgtgaagtcgcttgcgtcggtgtagaattcatagacgtcgggatgatgccgtaaccggtcgtcgatctgagcgcgttggctgctgccctttagtccaagcagtattttcattttttaatcgccatcctctaaaacagattatcttaattattatagggcaatcagcgtggaatacacgagctgattgttttgccaagccaaagctccattactaaaattaaaaaagtctaattttatattgaatttctaatttaatggttttataatgatgccaataacttggaaaacggagatgaaatcatggttcaagcatttgctaaggcaacgtcttatcaacgctatctgtaaatgatagtggttgtgttcgttatggatgcaggcacgcaacagcttgtatccgcggaagcttgacatgatgccgccgcgggccgtcccgtggcgattgatgattcatcaaatttgccgtcacggagcagcgtggcggtttttattttggaaaggatgaatggtcaatggaacagcggcatttgaaaatgacagaaagtttcggcgtaatcgtcgttatgtttttgattttgggaactttaatcatcaaatacaaaatgagcccgcagattccgattctctgcgtctttacgctgcttttattttacggcaggttgcgcggctttacctgggagcaggttatcgatgggattgctgaagggatcaaaccaggaattattccgatgatgatctttatgatgattgggctgttgatcagtacctggctggcctcaggaacgattgcgacgatcatggttattggctttgatttggtttcggtcaaattttttatccctactgtctttttggcttgcggcatcgttggcatcatcgtgggtaatgcatttacgacgatttcaacgctgggcctggcctttatgggaattggccacgttctaggctttagcgatgcaatgacggctggggccatcgtcgcgggcggctttttgggcaataatctatcaccgctgtccgatacttccaatctaaccacgagtctgatcggtaatcgcgttccggaacatttgaaaaacaccgctaaatccgcgatccccgcagcaattgcggctgccgtgatctacgcggtaatcggctttaaaaatatcaatgcggacctttcacgtgttgacgttatcagcagcgcgctcaaatccagttttcatgttggcgcttggtcgctgctgccgattctggtacttttggttatgtcgttaagacaggtgccggcaattcctactttattggctggctcgtttacggccctggttttgaccaagatctggacgccatcgctctcgtttgctcagatcagcagtttgttgatgaatggctttcagatgcatgggagtaagctgcttgactcattgatgtctggtggcggcattactcatatgctgaactcaattgcactgatcctttgtgccttgtcgatgggcgggcttttgatgaagtacggagtcgtcgatcaattgttgattgccctgcagaaactggtcaatacgccatttaagctggttttggcaacgatcgtcagtggggtcgctgtcaatgtgatgattggcgaggaatacctttctgaaattctgccaggtacggctttcaaatcagcttacgaagaacagcagctttcccaaaacatgctgacgcgctcattagtagctggcggggccgacatcaatccactggtaccctggagcgtcagtggcatcttcattgctggaaccttaagcctgcatgactacggctacgttgcctttacgctctacccgctgcttaatccattggtgactctgcttttagcagcattgccaaaatcgaaaaaacagcaggcgacggcttgatcaaaaacagtcaaaacccccgcatctcggctgaaatgcgggggtttagtaatgttagagattcttgtccataataaaggtcagttttgaaagctccagaccgtgcatgatcagctggctcatcagctctttggtgcgtttagccatttcggcaaccatttcatgcgtcttctcgcttaaaacgtcactggcttcattgttgtccattccttcagcaagtggggcagtctcatcgatccacttgtagaagtattggcgggcgtctttaaggtagtcaagatcagcctgcaaaaactctgcatgatggctttcaacgatcatagaaagtgcccggtacatccagtaggcgctcttcagattcatattgagctctttaggcgtgttcttgtagctggcatcgacatccgcggcattgccaaagaatggaacgtatggcgtgaacgttggaatcccaaagctcatccacatgatcgttgaggctgcttctggcagatcagggcgaacctgcagaatgtgcgagttttgggttcgattcaaagaaattggccggaacatgtgcttttcttcatccgtaccgtggcccagcggatcgtaaggcgtgttttggtagtgactgctcaaaacttcttcaacgtcttccagagtaatcttgtggtcggccttcataacaaatggcagatcaaagtccaggggatccatctcaacgtctgggctcagaaccttgtgaccataccattgccgaggcgtgttgtagtgctggtcaaaaacggtcgctgtaccaaaaatgtggcggaagttccagccatcgcgatccggattcagatggtgttctgccacgaactcgcgaatcgtgtcatcccacataaagttatcaggatcattgaaatcaacttcttgaatggcgatgcggttgccggttaccgcgtagcagtcatcaggaattcgctgggcaacccagtgatgaccagtaatgatttccatataccagacatcgtttttgtcactgaagattacgccattgccttctgcagagccgtattttttgatcaattgtcccaggtactgaactccttcgcgcgcgctgttgataaagggcaaagtggcggcaacgatcagatcttcgttgatgccggtatcttcaaccaatggatcaaaggccagcacccgttcattagaataggtactttccgtggcgctcatgccaacgttcttttcgttaaagccgctttcatcaaagacgccttccgttttgtagttgacgttgggcgttccttggtagcggtaaccatcggcaggacgatcaaccacgcatttgttaaggtaggccttaacctggttgggctggttatggtatgccgggtaggtaacgaagcgctgtggagtcaggggaccaaacgtatcatcgttacgggcagccatggttgagccatcaatggtagcatttttaccgactaaaaccgtagtgcaggcagacagatttttcttcattctttagaccttcttttttttacaaagattcctaattgcattataaaaataattctaagcgtatctgaatagcaggtcaattatcccaaacggctcagcagactcaaaattcccagcatcagcagattgatcaacagggcaaatgccaatgaccaataaaaaggagccagccaggttcgcaaagtctgggtaacgactgatcccgtcgtaaactgacaaagaatcaatgccgctgccaaaaaggcaataagcaaagtcatcagaccagtggcggagttttccagatcggcactgctaagatcaaaaccgccaatggcaatgttgccgatcaaaatcagccatagaatcgtgcggccagccgccagatgaatctgcggcgcctcagtctgagtaatcagggcatgccaaagcgtaaagattccaggaaccagccattgggtcagaccaatgattgccagcgtacagccaacaactggagcaatcccgataaagacattgccaacacgctgataaaaactgcgctcgttccaggcgtgattgacatagccaagagcgttgtcagctggattatgcggatcaggcacatgcagtagccgaaaactgacgatctgatggccgaaaaacaatgccgtcagcagatgactcagctcatgaatgacaacgccaatgccgccaagaaggatctgagcataaaagccgccgatgacaacggacagggccttgttgcggcgactgatcataacggttaatgtccctaagagtactgggatcattaccaaaaagagtcccagcgcgcctaagactttaaaatagccgttcatgatcttttaatgctgctgcaggtcggcaaactgggcatgaaccaattcagccagtgcttcggcattgacggcgacagaacgaccaatctgaccagatgagacgtatatctgctcgctggctttggcatcattatcgataaagatcgggtacttatgcttttcccagatgccaacgggggtattggcgccgtgaacgtagccggtcgtcttaagcagatttttcagcggcaccatgtcgacttttttgttgccggaaacccgcgctaaggccttttcatcaaggtggctgtcaattggcactacgccgactaatggtccggtggttggcccttccagtaccagcgtcttatagatcagatgctcatcgatgcccaggtgatcaacttgcaatgaccggacatcgccatcttcaaatgttggaaagactatttgctgataggggatgtggtgcttatcaagaatctgttcgacttgagtttttttaatgcgttgttttttcttactcataaagggtctccttaaataaattgaaatatcagccaggtaattaatcaaaaaccgcaagcccattatgacatgagttgccagaattgataaggcgatgattaggtgtccaattaaagattgggtattaaatttcaagtttttgtcaaatctgggacggaccaattaacgtaaaaatggcaaccaattatcttgagatttgatatactatgaactgatttagatactacaagttaagacaggggtcgatggaccgaccgaggggtaattacatggcagacttagtataccgctcagtaatgcgcgatataaaacataagatactcaatggcgactatgcgaatatgaagcttcccgatgaacgcagccttagcagcgactacggggtcagccgcagttccatcaagcgggcattgggaatcttggcgcagcagggcatcatttttaagaaacgtggttcggggacctttatcaacccgctctatttaaaaaatcaagcgatgtttcgctatgagggcagcaatctggggattaccgacagtttcaagcttgatggcaagaaacagggcatcaagcttttgaactatcaagtcgtgccggccagccaagaaattcaacaggatctttttttaaacgacaatgattttgtctatcaaatcaaacggctgcgcttgattgacgatcagccgttcatgattgaaacgggttatattccaattaaaatcatgccgacgctttcgccagccattgtcgaaggatcgatcttcaactatttggaagaatcacagaataaaactgttacgcgctcatttatgacgatttcggtttcgccttccaatgatgaggaccaaaaagagctgcatctgaaacctaccgagccagtcggtattatggaaggcgtctttttcctggatgatggaacgccatttgaagtctcaaacatgcgcgtgcattatcaatacatgaaatataatacgtttgtcaatctaaaccaggattagggggatcaatttgattaaggcaattgccgttgatatggacggtacttttttaaattcacaaagcacgtttgatcgaccgctgtttgaaaaagtctatgctcagctgcaggcaaaagacgttgaatttgtcgtcgccagcggcaatccaatctatcagctggttgaaaaacgctttcccaaagaagcagatggcatggctttcgttgctgaaaacggggttgagctgattgatcgtggtcaagagatctactgtggtcagtttactaaagaacaggttgagacgctggttgcgtttttccgctctatcccaggcggccatttgattatttcgggacggcatcatgcctttgcatttgccgatgaagacccattatttgtaaaacgcgttcagccgcattatatccacatgcagcaaatcaattcattggctgatattgatgatccggtagttaagtttatgatggatgttccgccaaaagaaaccagattttggatggatgaggtcatcaagcggtttggcaagatcgttcatcccgtatcaagcggctatggcaacatggacttgatcattcctgggatggataaggcaaccggcttgaagcggcttttggcagctcgtggttggcagcccagtcagctgatggcgtttggggatggacaaaacgatgccaccatgctgaaattagccggcgagagctatgccatggcgcaaagtgctcctgaagccattgcggccgccaaattccgctgcggcagcaatgatgagaacggcgtgttaaataagatcattgaacgttttgatttgaacgtttaaaagccggcccgatttgaggcgggcttttttggtttcttagcaaaaatttagagtgaaaaacacgcctttttcgcagaaattctgctaaaatttgggtgttcaatcaatcggagcagctttggtaaagccttttataataaaggctgaaatggatttttaataattggaccgtatcaattttcaaaaaggttgacttttagaaaaaatcctatatcatagatagcgtaaattgattgaggtttacgagacgttatagtcagaacgtagttattttatttaaggagtgtaatatcgatggcagtaaattacgattccaaggaatacttggaaactgttgacgcttactggcgggcagccaactacctttctgttggtacgctgttcctgatgcacaacccactgctgcgtcgcgaactgaagccttccgacgttaagccaaagccaattggtcactggggtacgattgttcctcaaaacttcatttatgcacacttgaaccgtgttatcaagaaatacaatgtaaacatgttctacattgaaggttcaggtcacggtggccaagttatggtcaacaactcttacctggacggttcctacacggaaatctacccagaaatcacccaagacgaagctggtatggctaagctgttcaagcacttctccttcccaggtggtactgcttcacacgctgctcctgaaacgccaggttcactgcacgaaggtggggaactgggttactccctgtcccacggtgtaggtgcaattctggacaacccagaccaaatcgcagctgttgaaatcggtgacggtgaagccgaaactggtcctctggctgcttcctggttctctgacaagttcatcaacccaatcaaggatggtgccgttctgcctatcctgcaaatcaacggtttcaagatctccaacccaacgatcctggctcggatgagcgatgaagaacttactaagtacttcgaaggtatgggctggaagccatacttcgtttccgcttacaacggcgaaggctttgatggctacaaggacaccatggaagttcacgaagaaatggctaagacgatggatgctgctattgaagacatcctggctatccaaaagcacgctcgtgaaactggtgacgactccatgccacaatggccaatggtaatcctgcgcgcacctaagggttggactggtcctaagaaggacttggatggcaacccaatcgaaaactcattccgtgctcaccaaattccaattccagtcgcacaagacgacatggaacacaaggacatgctgatcaactggctgaagtcctacaagccagaagaactgttcgacgaaaacggtgctccagttgccaaggttacggctaacacgccagaaggcaacaagcggatggctatgaacccaatcactaacggtggtttggatcctaagccactggttatgccagactaccgcaagtacgctgttgacgtacaaggccatggtgttgttaagaagcaagacatgatcgaatggggcaagtacctggacgaaatgttcaagctgaacccagacaacttccgcggctttggtcctgacgaatccaagtccaaccgtctgtacgctgttctggacaacgacaagcgtcaatggatggaagacattcacgaaccaaacgatgaagacttggcacgtcaaggtcggatgatcgactcacaactttccgaacaccaagcagaaggttggctggaaggttacacgctgactggtcgtcacggtttcttcgctacttacgaatcattcggtcgtgtcgttgactccatgctgactcaacacctgaagtggatgcgtaaggctaaggaacaatactggcgtcatgactacccagcattgaactttgttgacacttctacggtattccaacaagaccacaacggttacactcaccaagatccaggtctgttgactcacctgtacgaaaaggaacgtgctgacctggttaaggaatacctgccagccgacactaacgaactgctggctgtatccgacaaggccttcaacgaccgcgaatgcatcaacgtcttcgttacgtccaagcacccacgtctgcaatggttctccatcgacgaagctactaacatcgttaaccacgggctgggctacgttgactgggcatctactgaccaaggcgcagaaccagatgttgtcttcgtatctgctggtacggaaccaactgaagaagctctggcagctatcgacattctgcacgacaacttcccagaactgaagattcgttacatcaacgttgttgaaatcatgaagctgatgacgcctgacaagaacgctgaaggtctgactgacgaagaattcgaccgttacttcacggctgacaagccagttatcttcgcatggcacggtttccgtgacatgatccaaagcctgttctttgaccgtcacaaccacaacgttcacatccacagctaccaagaaaatggtgacatcacgacgccatttgacatgcgtgtgctgaacgaacttgaccggttccacctggctaaggacgctatcctgagcgtacctggctacgaacaaaaggctgctgccttcgtaaacgaaatggacaacatggttgacaagcacaaccactacatccgtactgaaggtaaggacctgccagaagttgaagactggacttggaagggtctgaagtaatttaacttcgctcgactaaaaccttaatatgaaagccgctcgattcatttgaatcgggcggcttttgttttgagctgtattgagaatgacttacatctgtttatagtcaaaaattggtacagcgtagatgattccaggtttgttaatcaatcaaaatcgtggattcttcataaatccatcttattatgatcgttgattgttttaatgccttagtgcagttttgttagaagtcataatcatcatctgtcatgacttcggcatcacccatcaagtagccggcaccaacttgactgaagaagtcatgattggcggtttcggttgaaatgccattcataacgattgggttgatatcttcaattgcagcatgtttaaaaattgcctcaaagcccatgttattcatggccttattagcattgtagcggacaaactgtttaacgtctgtaacgattgcctggccaagcggagcatagactgcttcagcaaacttaaattcattatccaacagatcggccaatagttcatccatccatttacgaaaactggcttgttctgctgtgcctaattcatgaaaagcctgctgaaacttatatcctagatacgttccgtgaactgattcgtcgcgaattaccagtttgatgatttcggaaagattggccagctgattacgcccgcgataccaaagaggtgtaaagaaattcgagtagtaaagaataccctctaaaaaaacgctggctgctttcttctgcagattatcgccatgctgataaatgttgttgattcgctcaaccttatactgcatacgcgggttattgttcatccaatgataggttgcatcaatcgtctgctggtcattaagtgaacttagaatcgtaccatagcttttggcatggattgattccatcatcaaaaagttgttgattacgccgacttccttgcgagtacgcgcatcctcgcgcattacgttgacgccttcttcggattggagcgtgtctagcagtaccagaccaccgactactttgttgatgacttgcttttcgtcggtggatagtgcccgccaatcgcctagatcatgtgatatcgggactcgcgtatcaagccagaactgtgtggtagctttgtcccatacatattcatcaaattcatcctcattaatgttccaattaacggtgtgatatgtcattttagtacctcctaaaagtcgtagtcgtcgttggacatggcctcaatcgcatcagcatcgactatttctggatcaacgggtgtcttttctgcctgagcttgagcattttttaatagtagaaggaacgggtcatctaacctggcagttgtttctggctgacttttgccaaatatcaatcgttgtgccgcattgcgtccccactgaacggccttggctttgctgtttgaagcctgcttgtctaaaaaatgattttcaatcagccaaagactatgggtcagctgattaacttttttaattgctgtttgccgttcggtcgtagtcagactacgcagggcctcacgaaacttatagcccagatagtcggtaaagatggcttgaccggtcatgatatttttgagcatttggttggtgcctctcaatccagagtattgagcaatcgtggctaatttgccatccatcagcatagtttcggttaatataaatgcggctcgtcttaccagaccgtttgattgacaacatgcagcagtcagcacagcgatttcagcttgcagattattattgtcatcggcccattgaaaatattgagcagcttgttccttactgagcaggccgcgaaaaattgtcgtgacagctttggtatgcacagattccatgaaggtaataatgtttaaaacagcttcttcctgctgagtgagattgctatcacgaagacttggggtaccgatttcggattcaaaggccgtcagcattgacatcgcagccagctgatgaccaattgagtcctgctgaatagtagtcagctgattccagaatgtacgatcaccagtaattggtacgcgtccatcgagccagaagttgttggttagtttcagccaaactgcttgatctttggcgtcttcggtttcattccagttaactgcgcgatagtatagatagtccatattttcctccttaaatcatgcaagacgtacattcattagcggtttgaatctcatcatcttcggtaaaggtccgtacgtaataaagtgatttaattccttgacgccaggcgtaattacgcaatcgattcaagtcgcgggtcgtcattttaggctgttcgggatgtttccattcataaagatctgcaggcagtactgagcgcatgaatagagtcaggctcattccttgatcgatatgcttttgggcagctgcataggtgtcgatgatacgacgctggtccatatcatacgctgacgtgtagtagggcatggtatgattggaaagaaatggtgccggataaaagattgaaccgacttgattttcttggcgctgttcaaccaactgcgtaattggctgaagagaagcactggtttcgttgatatatgagattgatccatttggggcgatggctaggcggttgcggtgatagaggccatcctgcatgatatttttctttagagtctgccaatcagttttggttggcagtttaatttttttaaagattgtctggttcttcttactggttaactgaaaattttcagttaagtattgattaaaatagcttccgtcggcatagcgcgatttatcaaagtccttaaagcattgaccacgttccttagcaattttccaactggctttaagcgagtagtagtttaatgccataaagtaagctgagacgaattccaatgcttctggcgatccatactcaatttgattaagtgccagtgccgtatgcagtcccattgcccctaagccgatcgtatgatactcgcgattacctttggcgatactgggaacttcttcaatgtctgtcatgtcggtgacgctggttaatgcgcggacggcggtttcgattgaatgaccaaaatcaggggattgaatcatgttcataatattggatgatccaagattgcatgaaatatccgcaccgattgatcgatatgacagatcagtgttcatcgatgaaggtgtctgcggctgcaaaatctcgctgcatagattgctcataataatgcgaccgtcaacaggattggttcgattggccgtatcgatgttcaaaatgtatgggtatccggattcctgctgcagccgcgaaatctcttgttccaactcgcgtgcgttaatgatggtttgacgaatattaggattattaactaattcatcgtatttttcagtgatatccaggtacgagaacggtttgttatattcgcgctctacatcataggggctaaacaggtgcatgggctgattggttttgagcagctcataatatttgtctggtacgactaatcctagtgacaacgttttgacacgcaccttttcatcagcattttcttttttagtcgccaaaaatgccagaatgtcaggatgaaagacgtttaaatagaccacgccggctccattacgctgaccgagttgattagaataactgaatgaatcttcgagcagcttcattacggggacgactcctgatgaggcattttcaatctttttgatggggtcaccagccgcacgcagattggaaaggttaacgccaacgccaccgccgattcgtgacagctgcagtgctgaattaacggtacggccgatggaaagcatagaatcctgtgtatcaattaaaaagcaggagaccatttgaccgcggcgtgctttgccagcatttaaaaaggtcggtgtggcaggttgataacgctgtgagatcagttctgcggccagctctctggctaacctttcatcaccatggcccagatacagagcgttagccagtacgcgatcggcaaagtcttctaaaaaccacttaccatcatttgttttcatagcgtactgattataaaacttgtaggcacccataaagctgcgaaaacgaaaatggcggttgtgcagctcttgatccagcaggtggacaaaattgcgattgtattgaccatagactgtatcatcaagataatcattgctcatcatccaatcaagtcgttcatcaaacgaggcaaacgttttggtgcgtggcaaaatctcctctttaaagtaggcagtgaccgcgtcttgatcatattgaaccggaattttaccatcttgtggaatgttgaccatattgttaagcgtgaagtatgtttttttcattagttctgctcctttgctttttccatcaatagcgaagcaatacgttcaatgtcattttggctgccccgcaattcaaaatctgtcagatagggaaagccaaaacgcttggcatattgcttggcagtcaaggcaaattgacggttaaaatttcgattgccactgccgataatgccatagcagcgttggtagttgccggcatatcccagccagtgactgagaatgggtgataagatctcatgatatccattgactcggccgttgcctccatccagaaatgctggcagaatcgtaacgaatggctgcgacagcttttgcatgtccggcgtttccttaacgttgatggcatgaaccgttacgtcatgacttgccagataggctgtcaaacgatggacaaagcttttcgtattgccggtcagactgatatacagtatatagatgtttttgttcactttttgagctccttatactagatgttgtgtaggaaacagactaacattgatatttcataatgtaagttagaaaaatttaatctatctgctgattggtttaaacggtcatgtcaataatgaccaaaccaagatttaatatttttgtttcattgatctgcatcatgtgtaacattaaatttttttaattttagacgactgatgaccgtcaatttagatctgattgctgatcaagctatcataataaataatgtttattgatctaaatcaatttttatcgaatcagcttcgtttatacttgggataccaactctaaggggcgacaattatgacaaatcacattcatcatcatcaacagcatctttgtgttgcgaccgtaccgttgtttaatcagctggctttatctgatcagcagaaagtcgaaagtctggtgcgtcatcatcggtttagtcgtggtgaccagattttaacgccggctcaagcagggaaaatgattattgtggaaagcggcgcggtcaagatctatcaactttcgccatctggacaggaacagatgcaaagaatgctggcagccggtgaacacgacggcgaggcctggctgtttggaattgagaataccgatacctttgcccaggcagagcaaacttctgagatctgtacaatatcctatgaagattttgctaagttactgaaccagtatccttcgattgccatgcggctgctgcagctgactttaaaaaggaatcggcagctggcgatgcaaaatcatctgttggggatggattcggttgaagaacggcttaaggattatttgaaagaacagatgcaggcaaaacattcaagcgagtttatgctgtcaatgaagctaaaagacctggcgacctatcttggtacaacgccagaaacgatttcgcgcaagcttaaggttcttgagcgtcaaggattgatcaggcattcagcccgtaagattgaaatcttgaccgagttttaagattcggtgctgcagtaacgcctatgcaaacgcttaaataatggtggaaatgaaaatgataacggtttataatatacgaagttaatatatgtcaaacggttgacatttagagaattgatgagggggacaaaaattatgccacaaatcattaaaggaattgccgccagtgacggtattggaattgctaaagcatatctgctgattgatccggatctgagctttgaaaagaaaacgattgatgatccggctgcggaatatgagcgagttgaaaaagccttcagcgcctcgattgctgatttggcgaccatcaagcagaacgccaagagccgcttgagcgatgaggagttggaagtctttgacgcgcacatcgccattttgtccgacccggaaatgaagagtcagatcaaagatgaaatcgaaaaccagcacatttccgccgaagaagccatgacggacgtaacgaccaattttgccaatgttctggccgccatgaccgacaacaagtacatgcaggagcgggccgctgttgccagcgggcgctgagccatctgctgggcaagcagctgccagacatcgcctccatcagtgagccagtcgtaatcattgctaaggagatcacgccatccgatacctcgcagatggatgccaagttcgtcaaggggctggcaaccgatctgcggccggaccagccacgcggcaatcatggcgcggacattgcggatcccagccgtagtcggtgccgagacgttacgagcacgatcaagaacggcgatatggtcattgtagatgggctgcacggtgacatcatcgttgatccaagccaggctcagatcgatgagtatcaagccaaggcggactcatttgaaaaagagcgagctgaatgggccaaactggtggacgcgccatctgtttccaaggacggccagcactttgagattgcggccaatatcggcacgcccgatgacgtactgatgccctcaagcagggggctgatggcgtcggcctgtttaggtctgaattcctgtacatgagcagcgatcacctccaaccgaagacgagcagtttgaagcctacaaaaaagtcgtgggcatgcagggcaagccggtcgtcgtgcggacgctggacattggtggcgacaagccgttgaactacctgccgctgcccgaagagatgaacccgttcttgggctaccgggcaattcgaatctgcctgcaccggcctgacatcttcaagacgcagctgcgcgcctgattcgggcctccgaatttggtcccgttgagatcatgttcccaatgatcgcaactctggctgagctgcgtcgctaaggcaatctaccaggaatgcaaggatgagctgcaaaaggatcacccggtctaggcgacaacgtcaagatcggaatgatgatcgaagtgccattggcggcattgtatgccgatcaattggctggaagtcgacttcttcagtatcggaccaatgacctgattcagtactgctttgcggccgaccggggcaatgacgcggtttcctacctgtatcagccgctcaacccagcctttttgcggctgatcaagcacgtgattgacgccgctcatgccaacaacaccaaggcgcatgtgtggcgaaatggctggtgatcagctggccatgccgtgctgctaggatgtggtgactggacgagtattccatgagtgccagctcgattctgcggacgcggagcatgatgaaggatctggataccaaggaatgcgccaagtgggccaacgacgccatcaacctgtgctacacggctgatgaagtggaaaagatggttaagacacggttgggcttagactaagcgcctgttttccgctaaaatgcaaaaaagaaggacatgcatccaattccgaatggggcatgtccttttatgattaattgaataattgctatttttgcgtccgagcaaccatgacgtcgggtttggcaacacgaattacatagccggttactgagcctaagacgatgcgttcaaaagctgataagcccgttgagccgattacgatcaaatcgttgttgtggtctttgggaaagtcgcggccgataacctgcttaggattgccaaaccgcacgtgaatgtcgactttggcaacgccggcatcgattgccctttgcttaaggtcttccaggcgttcttgagtcgtcttaaccaagtcataggtctggtcgggtgaaagcgagctggcaggcgcgtaaccatcggaaagctgcgtaacctgaacgacatttaaaatatctaggtgagcatcgcaggccttagccatcgcaatgcctttttccaaaacctgagccgtgacctttgagccatcgactggtactaaaatgttgtgatattgtccatctgccattgttgatccctcctgatttctataaaattagtatacaatatttttggccagcaatcggcagagtaattgaggtttacagcgctttctagtagaatggtgatgttgccaagcaaattatgaggagatttttttaaaatgaagaaagtatcgaacaacgtcatcaaagtgattgccatttccacggttacgatgctgattgcactgactttggaactgctgatgtatcatcaacacggcacgtcactggtcagcagcacggttttatggcgtgccggactgatcattgcgctttcagtagtcgttgattttttggcggcactggactggcgttttgatggttatgtaacggtattggtaatgctgtattatgctgccgcagattggggagcttttgaggtggtgcggcctaaagcttccgtctacgggatgttcgtacaggtgctggcaatcctggggatcattctttgtattgctggaatctggtacggcatgaaacagcgtcactattactcaatccaagaaatcaacaaaatggggcgataagcgatggaattaacggttaatgattatctgacccagcttgataaggccaaaacgcagacagatactaccgacgcggctcagattcaacaagctgcgactttgacaaaagggttgcagttcgtaatcgatcagctggatgccggctatctggctcgttatgtgtggcaggttgccatgccaagcggtgattcgcttgaagtagctctggaaacgaacttgatcaatattccaatgcaggaggccatgcgtcttgaccctaagctattagaaggtgccgatgccaaaccagttaatctgtatctggtggctacaggaaccgatttgaatgcttcaggcttacgaattgatgagttggctgctgctgacgagctaaacggctcaaccacggccctgactgaaaaaatgcaggcctgggtaactaaacagttggcacagactaatgagaatcgcgcggccaaggcggctgaatagtttgcatgaaagctttaagtgtgctattctagccattgcgatgagtcgagaggtcaggcagccgacccttgtttggctgccccgcgcgagcggaaatgacatttcgagcggggcccgttaacttgccggattgcaaggggcctggcaatgacgaaagtggacgttcgtcattagcctgagataatatcaatacgcagaaagaccaccggaggatttttccttcggtggtcttttgtttactgagccaaatagatctgttcgtcaatcaagtcaaatgagtggagctgtccattaacttttttcagctcgtcatcctgggttagatgagcattttgccagaatttagctgaatcagtagcaccgtttttctcaccaatgaccaataatttgacttctggatagtctttacgcagcagctgcaagacttcccaatcaatttccagcttgtcgggcgaccatgacatgatgacataatcgacttgactgccatactttttaattgcggccaaggcatccagaggctcaatcgtggtgacgggatgcttgccggtctcgttttccttggtccaatcggtactgtcggtggcaaagatcgtctgtgctggccgcagattccgcaagccgctggaaatatagccattgccagccatgatctcaagcgttggccgtccatgcaggtattctgaaagggccttgatgtaaggcgcgttgacgtaggaccacatgccataggtcgcttccagatagtcgcgataattacgcagaagccggtccagttttggcaaggcatccacgtagcgattccagagccggtcgccttctgggttgccttgtgggtactgctcgttaacttttttaaagatgatgtcttgaatattgtcgggcagcagcagtttaggtaatggctgcggtaaaagaccatttttgatcagccgatcgctttccaagacgttattgatcagaaatttaatctgcggaaaatcgtcgaatagatcacgataggtcatcaattgctcgatatatggctgctttttaacgacttgatgggcttttttaacttgttttttgagtttctttaactgcttggggttcatcgtttactccttaaaatcaagattcagttcttcctgcttgccataaaaggtgtcagtttcactgcgctggctgcgtccctttaagtagccattgattaattgaaaaatttcatagcgatcctggctggttaggacggcaccttcaaacagcaagtcttgatttgagaagaaaagttttgccaagtcgtgaccatcccgttcggttcggccgcatagataatccatgctgacgtcaaaaaattcggctactttacgaacctcaacgaatgagggattgcggatgccacgttcccagttgccgatctgagttggcgtgttgggtctttcgccaggtcccagatgctcgttcaacgcttgggcaagttcatttagggtgaggttttggccttttcttaaagcacgcagacgttctggaaacatacgctcacttccttaattagtttgttacgattattttatcattatttgagcaacagagcgtgtaaaaagaatttcgacaatcaaaataaaatctgctaaactgttagtcattgcaaatttgagaaaaagagggataattttgcataatcaatctaagaagcatcggtggctgcgctggctgatcggcgtggcagcaacgcttttgatcatgatttttgctgctggcggctacttttttcacgtggcaatggtaccggggcacaaagattttatcaataacaatacgaaaatcgttaagagcgatcccttgtatcagcagaaaaaatggtatcaagacgttcataaaacgcgctggacgatcaaatccgcaaccggcaactatcggctggatgcctggtacgtcccagcggccaaaaagactaataagagcgttttgatcgcgcatggctttatgggcaataaggatcagatgggagcctatgccgcgctgtttcatcagctgggctataacgttctggttcccgatgcccgcgcgcagggacaaagcgagggtaaatatattggctacggctggccggaacgctatgacgagcgcaaatggatcaacaagctgatcaagcataatggtcaagacagccagatcgtgatgtttggcgtcagtatgggtggagcaacgaccatgatgaccagcggcattcagcttccgcgccaggttaaggcttttgttgaagactgcggctattccagtctggctgctgagatcgattatgaggcacagaacctttatcatctgccatggctggtccgcaagccgctggaaggatcattgagcatcatcaatcgcatcgccaatggcttttatctgcgcgatgccagctcaacggcaatgctgaagcaaaatcatcgcccaatactgtttattcatggagctgatgatgatttcgtgccaacgcggatggtatatcaaaactatcaagcaactcgtggtcccaagcagctttgggtcgttaaaggtgcggcacatgccaagtcgtttgctacgaatcctaaagcctatcaaaaacacgtccagaaatttttggatcaatacgtaaaataggaaaaccccaatgatcatcaacgatcattggggtttttgggagtttgaggatagggagttggttacaggttgaacgattattccatgttgctgtgttctttggctgcctgatcattagaggtatggtcgcggcggcttagtttcaggcacaaaacatctaaaacgatatggacggtctggtcaaaaagggtgcttaagagttggatggatttaacctcatcgccagctttggtagcacctggaacgacgatgacgccatcgccaagttcacttagttttgagttggcgttgctggtaacggcgatgacttcagcaccattttgcttggctttttctgccagttcaacgatgctcttggtattgccagagcctgatacggcaactaagacatccccagcctgcacagaaggagtgatggtttcaccgatgacatagggcgtatagccgatgtgcatcagccgcatggcaaaggcacgcgccattaaaccagaccggccagcacccaggacaaagatgcgcttttctttggtcagcaaaggtgcaacggcatccagctgagtttcgtcaactaaatctaaaacggtatcgatttcttgtttgacttgtgcaattaagctcatgttatttaacctctttcataaattccttagcagcggctaccggatcagcagccttgacgatcttagagccaacgattacggtttccgtaattccctgtgccttgagttttcgtgcctgattcaggtcaatgccgccagccacgttgatgcgcttgatctgcggatatttttgatggaagctggcaactgagtcagcggcatcaaaggcaccggtatcatctttggcatgatgcaggccatagattgcattttcaaattgatcaatggctaccagtttttgatcattgacttccattaggtcgataaacatttgccgaccgtaccgttcggcaaccttataagtagtttccagcgttccttgcgaagccgcgcccataacggttagaatgtcggctccggtttcaaagcccttttcaaactcgtactgtccctcatcaatcgttttggcgtccaacagcagctcggcatgctgcagtcctaatgcttctttattcaatgcgtaaaagccgtaatccttgatcaatgacgttcccatttcaatgatgtcaacgattagatcaagctgacgcgctaaatccttagcctgttctaaggtaacgcggtcaattgctgcctgtagtttcattagtcttcagcaactccttcctgagtataaaatgcttttagctcatcaggagttgggtagccatcgttgtcgccgggcgtttgaatctggagtgcgccaacggcattgccccgcattactgcagagcggagcgatttgccttcaagcagggcagtaatgacacccagggcgaaaccatcaccagcgccaaccgtgtcgacgatatggtcaacgtggaagcccttgaccgtgtacttgtcgccattgctggtttttacgaacgcgccttctgcaccgatcttaacgatcaccgtattggttcgttctcccttgaggtagaagtcggcaattgcttctggatcatcagagcccatcaagatcttgccttcctcgacgccaggcagcacgatatcagcgtagccggccagttcattgatcgtcttgaccatatagtcgtgactcttccaaagcggccgcagattaggatcaaaggtagtaagaatattgttttcattcagtcgtttaaacagcgcgcggaacgtttcttctgcggtgtcagagatgccggggaaaattcctgacatgtgggcgattttgacgtcgcttaagtcaactttttcaatgacttccttgctgagatggcaggctgcggagttcttccggtagttgaaggttttagggtcgcccttggtaacgagctcttttagctgcggtttgccaatgcatccacgcctgtcaagcccaggcgctagctaacccgctggcggatgcacaagtgggagtggtgcaataagtttgacctgcacacccaatcggtgggggagctagcgatgatccgccagtactggcaagcgacaggtgaataaaacaggagtgagtggccaaccacctccttggcaggccgttagactaagctagggtgcaggttagcgcaagaacgcggtgttcttcgcccgtacttaggcactaggcctgcggttggttgccacgttacctgtctaacattcatgaatacaataagaggtcgggaaaagatgttttcccgacctcatttttttagttctgaagcttatttcccacccagctattccttgggtttttggtggtagacggcccgctggttgaccattgggacggcccagcggttcaagagaatggggaccttttcaaccgtcacctgggaggattcaaggccaaaccactgaaccggggtggtggagtggttttggataaagatccgcgccccgattaagaggtgttgccagccccggagctggatactagacgatagctggtcttggatgatcacgaagcggaagtcgccgacctggcgtccgggggtggtagtgtacttttgcggctgcgggtcgatgatcccttggcgcatcaggtcattaactacttgacgcaggtacaaggaaacttggtggttcatcttaaagcctaggtaaagttgcaagttgacgatgttgcgggtgcccatcatgtcgacggtgtagtaattggtgtagggttcactggtggtgttgaccgtcacaaaccagtagaccttagcccgcttgggggtcttgtctagaatcgagtagaggaactcacgcttgatggcgtcgccgtctctgaccttggtaagcatgaccaagttggagatgtacaggggaattgcttcatcatcggttagctcttggagggtccgtttgtaatcgcccaggtgggtccacgccgtttcaccatccaagaagtcacggagcttgttgccaaagtaccaggccaccatgatggcaacgatcaccagggtgatgaagagggtcacgtagcccccgtggtcaaacttggttaaagaggaaaccaggaagatgatttcgatgacggcgtagaggcaagcgaaggggagggcgaaccagtggtggcgccggctagctagatattggtagagcaagagggtcgtcatgaacatggtgatcgtgatggcgagcccgtaggcggcctccatgtgctcagaggtccggaagtaaaataggaccagggttgtgcaggcgcacagtagccagttgatcgtccggatgtagatctgaccacgcgacaaggacgggtggatgatcgccatcttcggcaagagcttgagcccaattgcctcttccaccagggtaaaggagccggtgatcagggcctgggaagcgataatggcggcgatggtggcgatggcaaccccaaataagtaggcccaggatggcagcatttcgtaaaaggggttaaaggccgaactagtggtggtaaagtggcccaggttatggatcaaataggccccctgaccaaagtaattgagggttaaagtcaaaaagacgaagggccaggtgatgtagatggctcggcgcccgacgtggcccatgtccgaatagagggcttcagccccggtcgtcgccagaaagatggagccgaggatgaagatcccaaccttgttttccggcgaaaagaggagcattaaaccatagtggggggagagggcgcgcaccaccagcggttctttaatcaagttggcgatcccaaagacccccaaaaaggagaaccaaatcagcatcaggggcccgaagcccttgccgatcaaggcggtcccgaagcgctgaattaaaaagaggattaacaggatcgtaaaagtgacccagataaccgtggtttgactgttaatcggggtagccgggccaagcacaacccccttgaggccttcaatggcggtggtcaccgtcacggccggggttagtgtaccgtcggccagcagggcggcaccaccaaggagggccgggtagattaaccacttacggcgcttacgaacgagggcgtagagggcgaagattcccccttcaccatggttatcggcccgtaaggcgaccaagacgtacttaatggtcgtcattaacattagggtccaaaagacgagggagaggcaaccaatgatgtagtcttcgctaagtttgttgagaccgccagcatcgttaatcagggcggtcattacgtaaagtggcgacgttccaatgtcgccgtaaacgatcccgagggtgatcagccccatcagggcgagatttttctttccttgctgcatgataatttcctttcgtttcccgggaaatagctgggttgattactattattttaatctaatttgccggggctgataaggaaagcccttcttgcgctataatggtggcaaattaacgaaatcaatcatatgctaagcgggacgaaattacaatcagaaaggggaaattggggtggaaattattttagaaaaaacaaccaagcccttctttaaaaagcacgctggcagccaagtcctagctaaggaacgcattggggcaatcttggaacgggagcaagcgactgggctgacaaaggtcaagttagccctccgtcggccagtggccgggcacccctgcttttagctccgctgcaacctggctaaactcggttcagtccgggtggccttcaccctagacggccaggtgacgcggatctggtttatttctactagtttacaaaaggcctgctcactacgctggtagcgtttgaacagctgtgttgaaaaattaccatgacggagtttaggaacgtgtagttcaagtgttcctactcgtgtggtaagctgacgaacccgataaccattccgtgaattggttcgctcatccgaacgttcataagccttagctttaatctgctcagtcgcttcggacttaagaatttcatcaaggatcttggccataattgattgcatggccttatcccgatcacctagtaatagctcctttaattcgtcatcctctaaatttaattcaacttttggcataatgaagttcctttcagatttcacaaagtcctatttagaatttacaccaattatacggacataaccgaatgtagtcgcaataaggtgcaagctgcttggcggccaaaacggcatcgaagccggtaaaggcccagttgccaagatcgtaaacgtagccgatgctgttgaggccagcgtttcttgctgcagtcaggaatttaatgattgcatcaggagttcctgagactggtgtttggtcattttcaacattcattttgatttcagccaatggcagcttgcttaaatcttttgccaggtcgccatggtagcttgagaagttgccagtgttgaacttgattttggcgatgcccatctgcttgccttccgcaaagtattgtggcagcttaggattgatcgtgccatcagcttcaaagatcacatccggcacactgtagttgacgatcaaatcattttcgcgggcggctttggcaacggcggctaattcaacatcaaagtctttgaagtattcgcgacgaacttcgatgccatctgcacccaaagtggcaacccgtttaaccaggtcaacttgactgacacctttcttaacatcattttcaaaaatccaagtgtttaagattaaagtcatttttttcgtcccctttttaaaatgtctcagtacttgtttaatgatttgactcgattcagcaattcttcaaaagtcagatcttgaaattttttctcatcaacccgcttgaaattggttctttcaatggcgttaaaatcgtcaaccagataataggcggttagatagctcagtagaaacttcttagcggcaatggccaggtctttgtctgcgattgcttccgtttgggcggtttgggcaaacttcaaggcaaaggcttctggatcgattagtgttctttcgttcaagatcgcacctccaaaaatgatttcgctttcaacgatttatagtgtaacctgttaacctaaaatattcaatactatttttagcttgcaaattccttttgtttcatgtggttaacctgttacctgttgatattaaagggtttataaaggttaacccgttaccttaaatttatcaaaaaatttaagggcttacaaaaagagagatgaattagggctaaattgtcatcaacagtcgccattgttataattaagtgtttagaggattagcgaaagagtgaattttatgtcgataaaagatgcaagtaaaaaacgccctacgattagagatgttgctaaagttgctgatgtttcagtggcaacggtttcgcgatttttaaatggcaaaacgcaaaaaatgtcagaccagactgctgagcgaattcgcgttgccattaaaaaaatgaattacgttcccaactcagcagcacgagagatggcgcgcaatagcagtcgaattattgcggttctggcggctaatattgcagattatttttcagttgaaatctatcgtggcatatcaagtcgggttgaagaggcaggatacatatcggtccttttaaattccggctcaagtctgactcatgaacgtcagctgctgcattcaatcaaccagcatggctttgatggcttggtttttcagccattaaccagcgatacggagcaggtcgctggtgagctaacgcgtgattttccagtcgtagttgtggatcgtgacttaccacgctcaacatggcccaaagtagtaactgacaactatgaggctgcgcgcagtacgacggaatatttcgctgatcaaggctttcaaagggttgtagttttgacttcgacgattgagttggcttcaacgcgaattcagcgttttcaaggaatcagtcaagcagcgtcgaccattgagacgattgaaattgatgggaacaactttcagccggatgcagtctatggtgcactcaaaaaagccttgagtcgaccaggtaaatgtcttttgtttgccctcaaagaacgctggttgctggaatttttgccgcgattgatgaaagagcatgtcattgacgaagcaagaaccgcggtaactggctttgccgatactgcgttgattggcagtatctgtccctatgctaaggtagtttcgcaaaatccttttttgatggggcagcgtgctggcgagattttgctacagatgctgaagggcaaaaagaacattccagaagaatcagtcattaaagctcaattcaagcactaaataaacgtaatcaaaaaaacagcactatgctgagcacgacaaagcttggcatagtgctgtttttgcttaattagtatgctaataatctgtttttacacaatctgatttttaatatgccaaaataaaaaatccctgcctcagtgcagagacaaggattactgacttgtaaactagaattcctggtgatgatcttgtggcttgcgtcccaacaaaaccgcgattcccatcgcaacgttgtagaccaaaagtactaaggccagcagcaatgcaaaagctgccaaaatgctgaacaagccgcctaaatgagccagattctgcatgttggctgctccaatgattacaaaaatcgcaatcatgtacagcaagggaaaaatctgactccagaaggccttaacagcgtttttacgcacctcgttgaagccttggtattttgcgataatccagacgatcaatggaaagatgaccggtaaaaagaaaatgctgaagtaggctagcgcgctgacgattcgctgaccgaatttgttatccatgaattggaatcctccaaatattttctttaattatatcgaatctgctatggtagggcaaatgtgataatctgtattaaaataatacttattatcaatattgaccaatcacgagccgttaatgtaatctgatgaacgctggtccgcgcgcgatcctcaacgtagccgtgtgattccatagcctgcgccagttggtccgaccaggtgatggcatgcaggattgccttgaaataaagcgttggtgacaaccaagacagattgatgccccgcatttgaccagccgcgcgaatcgttttaactgccattttaatccgtggaatcagattgacggctgccagcgttccataagcaaacttgctgggcagatgcagattttgttccaaagagcgggtgagctccagtggactggtggtctgcgtaatagccgcgccggtaaaaacgtagacatagattcgtgaaaacagcacccaggcataaaaatagtcatggccgggactgaaccaggcaatcgtgataaataccgcgactgctggaaataacggcattaaaaatagccagccaaacaagcggggccgaatgcgcttagtcaaaagatagattatggcaacggcaaccaagaccagattgatcgttaaatggcgcgtaaacgagacttctaaggcaatgatcagcaccaacaacagtttaaaacttggattcatttaaaattcctcccgatagctgagctgacagtctgccagttttacgtgccgatcaatcagcttttccaggccctctagctggtggctgataatgatcattgtttgcgggtagactttttggctggccttgatcagatcaacgacattgtgcagcgaatgaagatcaaggccgctaaaaggctcatccaacagcagaaccggttgccccatcatcagcattaaaagcagctgcagctttttttgctgaccgccagaaagcgagtagactacgcgatcctgcaatttattcaaatcaagcagcttaagtgccgcggctaggtgatcctcgtcaaagtagggattacggccctttttaagactcagcgccaactcctctttaaccgttacgctaagaaactggtcgacggcatgctggaagacgtagccgacctgttgagcataacggcgcggtttgattttttggctgtcctggtcattatagacgattgttccctggtaggccgccaagtgtgtaatagccttaaacaatgaggatttcccggttcccgtggcgccagtcagcagcgtcgcttgatttttgaaaaatgaaaagtcatttgccatgatcagcttttgatttccatgttcaatcactacttttttgagcgttagaatcggctggtcgctggcagtcggtagtttgacgtggtggaccgtggcggccagctgatcggcagactgaagcagtgcatcactggcagcggcatcaagcaattgggcccgctgattttcaaagtgaatgatctgttttgctaaaccgcgatagccatgcagatcatgatcagcaacgataatcgttttgtgatacttttgctgcagtaaggtcagctgctgaatcaacaaagtccgattatggttgtcgatgctggcaaatggctcgtccaacagcagaatatcagtatccatcgcgactagaacggccaaggcggcccgctgctgctcgccgcctgacatcgtggccagctgacgatcgcgcaggtgctcaatgccgcagaattttaaggcatgctcaatgcgggcgggcatctcgctagcaggcagctgcaggttttccaaggcaaattccaattcatgctgcggcgtatcaagcgcgaactgcatcccgggatcctgaaacatcatcgcaacggttaaaccattcggcagctcgatgcttccctgcagaatccggccgccatatttaggcagcagaccggctaaaaggcgcatcaacgtggacttgccgctgccggaagcaccataaaagagcgtccaggaatcaactggaattctcagcgcaacgtcttttaacgtcggatgctttggagtatatgcaaaagtcagattatcaattgccaaatgattcattagtcgttaaattcctcgcgtttcatgacgtgcgagcgttccagaagccgttcgatcagcattaccaaaacgccgcagaagatgaacattgaaagcagccggccgctaaagtagtaaacgtttttgaagccaaacttgttatagccattgcggaaccaatcccaggcaaacgttacgatcgtcgtggtaatggttgttgacacggcccctagccagtcgtagtgcttgtagccggtgaacgtaaaacccagttcgctggcaatcccttgaacggcaccagaaatcagattggccgcgccccattgatcaccaatcaaggcttcaccagcggcacctaaaaactcgccaaggaaaggtgcaccaggttttttcagcataaatcccgccatcggaccggccatgcaccaaagccccatggttagatcgttacccatcattggcagtttgagcggtgtaaagacaatggtcagcgcgttgtacataaaggcagctgcccagtagatcaccccaaagataatgccgaccagtgccagcaggatgatgtcgcgtagatgaaacttgttattttttttggccatgaaagaccctcctaatgattgaaattttcaatcacctgtccaaaagaaaacccactatggaaaagatccacagtggggctgattacaacagattatttaccgtatctcccttcgctggaattatccagagcaggttcaatgggtattatctcagccgtatggcaccccagacatgaatgattgatcgttttcatcttacaaaataacttggcatagtgcaagccagcagaaattttatcgaagtttaatttgaaataaaaaagaatttaagcggagaaattgatttgaatcaagctgggtttaaatttattgagattcactgataatcatttgatcagcctggacacaatatatggcgtttgaacataaaatgactactagatgtcgtggtagaatggtcctattgaatttcaataagagtaagaggcaaaactatgaagaaaaatcaaaaaggcatcctgctggttaatcttggaacgccaagtgatcccagcgttccagcggttaccagatttctacggcggttcttaagcgatcggcgggtcattcatatgccgccattgatctggcagccaattctaaacatgatggtgctgcccaaacatgctcctaagtcggccgctaattatgagcagctgtggtcatcagagattggctcgccgttgctgcattatatccagcgccaggcccagctgctgcaaaagcgactgccggattatacggttcgctatgccatgagctacagtcagccgctgattggtgcggtcttaaaagaatttgagtttcaaggaatcaccaatttaacgatcattccaatgtatccgcagtattcaactacaaccacggcttcggttcaagatgacgtcgctcggttttaccaggatcgcaaaacggttccagaaattagattcgtcagtgactacagcagtttttggccgtatgtcaaagcattatcgaataaactgcaaaaagcggttgctaaaatgaatccagatgcaatcgtcttttcatatcatggcattccgctcagttatcaaaaggccggtgatccttacgcccagcgctgccggcaaacgaccatggcggtaattgagcgtttggggctgcagattccctgttttcaagcctatcagtcgcgctttggaccggcaaagtggctgacgccggccaccaaagatcttttgaccgcgctgcctaagcaaggctatcgcaaggtactggtcatcgcgcctagctttaccgctgactgtctggagacgattcaagaattgggcgaggagaaccgggatgtctttttagctgctggcggaaatgaatatcaattgctgccagctttaaatgatgatgctgagtgggttgaggccttagcgcaattaacgcttctaaacgctgttatgccggctcagaacgcagctatggatctgccgtcagccaatctgcagactgaataggatcaaaaaacctcatcggcaagcaccgatgaggttttttgattagtaattagtgttctttcaagacgctgttcaaacgttccatgaataccttcaagtaacgttccttgtcaacgttaacggcaaccttaacgtttggattaggatcgttcaagcgtgagttgtcaccaatcgtccggccgtagttgtgttcttcgtagtcaaccttcatgaacaggctgatcgtttgaacaaaggtagggtcgatggagacaccgactgccagtgggtcgtgcagggcacagccgttcttgtcgatatccaggttgtagtaggcatcgatgtagaagtcggtaatgtcagcgtaggccttaccagctttcgtacccaggtcgcgccattgctgcgtttccttcttagtcaaaagcgtgcgcagcgtaacgtccaggccaaccatcgtcaatggcaggtcgctttgcagaaccgtgttggcagccttggcgtcttggttgatgttggcttcagcaacgtcagtaacgttaccttcaaccgtcaatgcaccacccatgaacgtaacgttgccgatcaggtgagcaatttcaggatccttttccagggcagcggccaggttggtcattgggccagtaggaatgatgatcagatccttgccatacttgtgagctgcttcgatgtagaagtcgacaccggattcagcttcaacggcatgcttaggggttggcagctcaacatcgccgatcccgttgttaccgtgaatgtctttagaaacctgcataacttcaaagctgtcggtcgtgctggagtgtggcagacctttgtagacaggcacatcggtttggccgagcagttccaaaagcttcagactgttttcagcacaaacgtccaacaggttgttaccgtatgaagccacgatcccaatcaaatcaacttctggatcagcaaccgcgtaagccagagccaaagcgtcgtcaacaccagtgtccaagtctaaaatcattttctttttagccattgattgatttcctccgaatgaatattgttagataacgtttacaattacataataaccaaaaaccaattaaaactcaaacattgttttgacaacaattaaaccgttttatcaaaattaaggcgccaagccgtggtacaatggcttttgtcgtagaaaagattttttaaaacgaggtaaagatgatggaacagacatatgacgtaacgattgttggtggcggtcccgccggaatgtttgctgctttttacgctggtctgcatgaattaaaggcgcagctgattgaaagcctacctcagctgggaggacaggttgccgcactctatccggaaaaacaaatctgggacgtagctggtgaggctggcgtgcaggggcgcgagttgattgctgatctcaaaaaacagatggccattgcgccggttgatcaatttttaggcgagcaggttaccaacgtcgtcaagctggctgatgggacctttaagattgaatcagcacagcgaacgtcctattccaaagccgtggtgattgcattgggcaacggcgccttttcaccacgcagactggcattggatggcgcagaccagctggagggacgacaggtgcgctattttgtcagtgatcagtctgattttgccgatcagcgcgtggcagtgctgggcggcggtgattcggcgattgatatggcactgatgctggagccgattgccaaagaggttcacttgattcatcgccgggatgcctttcgtgctttggagcataccgtctcccagctgaaaaaatctcaggttcaggttgaaacgccatacctgcctaagaaactgcaagtgaacgaagatgattcgattgatttgacgcttaaaaagatgcgctcagatgaagaaaaacatctggcagtagacaaaatcttggttaactatggctttacctccaacaacgccgcgcttaatgagtgggaactgccattggcaagcgagcgggggttgatcaaggttgactccaaaatggaaaccagcgtccctggcgtctatgcaattggtgatggcgttacctacccaggcaaggccgcgctgattgcaattggctttggcgaggcgccgattgcgattacggctttggccaaggcgctttaccctaaaaaacgaatggccacgcacagctcatcgatgcacatcgattcgcagcataagtaaaaataaaagatccaggcgatatgttcagcctggatctttttttattcagtaaattttacggccgtgccataagcaaccactgactgcatgtcggttccgattgagccggagtcaaagcgcatcatgaccacggcatcagcacctttggcctcggcatcctcgcgcagtctggcaattgcgacctcacgcgattcatgcagcattttggtataggctttgatctcgccgccaaccacgtttttcagtccggcgccgatattggaaaaaacgtttttggattgggtggtgacgccaaagacctcgcctaaaacctcatagttatggcccggaatcttttcagtcgtcgtaaccagcatttctttagccatgttcttgctccttgtctatttgatcgtgcggtagatgtcagaaatagcctgccgtgatttaggcttgatcggctcatcgcgatagccgaaacttaccatcacggctagtccccagtgctgacggtctaagacgcctttttcagccagataggattcgactttttcgcgattaaagccttcgattggacaagaatcaatctttagcgcagctgccgccatcatcatattagccatggcaatgtagcactgcttggctgcccagtcgaaacgggtgcgctcgtcgttgatgtccatgtcggtttcttgaaaatgcttaaaggcctgtgatgatttggaattgggatcgtattcgtggcgcttgacgtcttggaccatgtattttacgtagtcgctgtcgtaggtgacgtcttttctggcaaaaattaagagcagcttgtcagcgccattgatgctgttgacggctccccaggcgattggcttaaggtcttgacgcatctgcggattatcaagctcaacaaactgccacggctcatagccaaacgagctgggcgacaggcggccgacttctagaatcgtgcgccagtcatcatcgtcgactttgcggtcagaatcaaactttttggtagcgtagcggcggttggcaacttcaatcagtttttcttgaatctcttcatgttctcgcataatgcagctcacgcctttctaaatcaattttctttaattttatcacgaattttaggaccaattaagcagggcactgagcgaaatagtaaaagccccagaactgacttaacagccctgggacttaaattagattaacgaaacattaattgccattgccatcaggattggtgatcttgattcggttggaactcgtagcagaatgtccctgttctggggcgttggtgctatagctgtcggtagtggtcttgtcgttattcttggagaagatgctggttgattgaatgcccttggacttttcaatcttcttttccttctttaatccgttagcatagttgtagtcttttggattgacggtcttaaagccttttggatgatagaagcgcagcagattcttttcgttaagcgaatctgacagggccagttcttcagaaaccttcttttgatcggcccgcagctgttttttctcctgcttggtcagcttggccagcttgccagtcgagttgaggtagatcttgccactgatactggtgtacttcggtgtcacaaagtcttgattgcgcagggcaacgacttgatcatgctgtgagctgaacagatcagttccaaactggatatagcgtttagtgctgattcccaacagatgcaacagcgttggcaagacatcgatctcgccgccataagtactgtagatgccgccgtgaccaccagatcctggaataacgaacatcagcggcacccgctgcatctggacgttgtcaaaatcggtccagtcgtcagcattcttgcctaagacgctggccaggttcttgttttccgaattggagatgccataatggtcaccatagatcatgatgattgatttcttggccagccccgtcttatcaagatagctaaagaactcctgcagcgactgatcaagatagtgcgcggtaacgaagtagttgtcgacagttgatgatccagtattcgtcgtcgtgaaattggagtctttatcctcatcgtcaagatcaaatgggaagtggttggtaaccgttaagtacttgacatagaacggctgctgcaggtgctgcagatacttgatcgaatcagcaaacagcagcttgtcctttaagccatagccggttgccttgtcgccggacgtgtcgaaatagctggcgtcaaagaagtattgatagccgaggttcttgtagacgttgttgcggttccagaagctggcgacgttgccatggaaaacagctgaggtatagccagcccgctgcttcaaaatagcgggagcagcctggaaggtattgtcattgcccagcgttgcaaacagtgaaccctgcgaaagtccatacgtgctggtttccaacatgttttccgcgtctgaggtcttgccttggccaacctgattaaagaaattagagaaggcataggtgtcttgaccgtgatacagcgaatttaaaaatggcgtaacttcttgaccattgatttttttatcgatcaagaactgttggaagctttccaggtgaataacgattacgttgcggcccttggcaatcccaaacagctttttgttcggcgcggcataatgctccttggtaaacttctcaacggtcttgagctgtgatttggtggcactcttacgcatttgactgacgtgctctgatttaatcaggtcgtaaccggtaaaggcatccagccccaggtacttaacgatgtagacgcggtcaaacgtccgccctaaaagctgtggccgatccatttctgccaccatcagattcaagccgcagacgaccaatgaaactgaggtgaaggcaaatgccagccggtgcgaaaaagcgcggggatcaaacttaatctttctaaaaagcatcaagagcaggatgacgacaatatcgagccaataaaaaacgtcatgcagattggtcaatgccaaagaactgccgctaagcccctggttgactttagaatagccggtcatggtggcaatcgtcataaagtccgtaaactcacggtagtagataacgtttaaatataatagcagcgtattggcaatgtcgattcccattaaaacgggatagaaaaagcgcgatcgcttaaagtaaaatgccagaccaaacaatagcagggtggttcccagtggattgatcaggacgattagatattgaaccaagccttgagcgcctaatttaaagtcagtgaagtaggcaatcaaggttttgatccaaaaaaggaacaccaagagtgcaaaaaagccaatcctggtgttcacgagtttgcttaatcgtttcatgtcgaaaaatatcctcgcagttatatgattcttaacgtactcataaaagagcttaacgtcaatcattctagcacaaattcagcctgtgtaagtgtattgtggcaaaacgttgaggaaacttaatcagatttatgctttgactggagctggatcgagcagccaatcataatggaacagtcttttgagctggcggttgacagggatccagatttgcgcgtgccagatgtcttttaatgatgccaaaaagatctggtcatgctgatgcttagcggttaatggcagccgcagaatctggccggtttcggttttgacggtaacggtcttgccattcatcccaacgatctgggcagcgacgacatcttgttcagaatgtggattacgtagtttcaagcaacatcccttctttcgatgcttttaatattaaagggaatgtttgaagaatctatgatgggcgccttatgttatccttaagttcaagaaagcattacaatcgttttagattcaaagggggtaacgagattgaaaaaattgaatgtctatctggtacggcatggtcagacgtactacaacatctataacaagctgcagggctggagcaattcgccgttgacgcaaaaagggatgcaggatgcgcgcaatgccggagaaaagctggctaagattcattttgatgcagctttttgcagcgacaccacccgcgccgaagcaacgatccagacgatcctagatatgaatcaggctgactcggtcaagcagccaataacggcaccattctttagagaagagttctatggctattttgaaggtgccaatatggatgaggcctggtatctggcaggagcgccgcatggtctgccaacttttaaggcaatcgtcgaaaaatatagcatcggtcaggccaaagactggctaaaggatgccgatccattccatcatgccgaaaacaatgctgaatactgggcccgcgttgatcagggaattgacctgatttggcactcagaggtaccagatgacgccaatattctctgggtcagtcatggcaatacgctgcttagcctgatggagcgctttggccagggcaagtacgatctaacggtgcgtccggaaaatggcagtctgactaagctgattttaactgatgatgacgttgaggttgaatactataaccgcaaataactgcagatataatgaaaaaatcgcgtgtagtcagctttgcagctgacggcacgcgattttttgcttcaatgactctttatttttatagattatcgccaagctcaaactgatacttggagtcaagcagcgattgtttgatcagactgctgagcagcgcgtgggttcgcttggtaacttcggcggccgtttgcaggttggctttggtaaggaagttgttcagctcatcatcttcttcaagttcagccgcctgctggtcaatctggtcaattcgctgcaggccaaagctctgacagccatcgcgatattcgttgacctcattgataaatttgtgatagcgcggttcaactacaacggccagcgttttgtacatccaataggcactgttggtatcaacctcggcgccagctttttggtagttggctggcgtgtcggaaatgttggtataaaacggtacgtatggactgtagcagtagaaaccgaaattgatccattgaatggcagcaaattcttttggtacgtgattgcgaatctgtagaatgcaggagctttgattgcgatcaagtgagattgagcggaatttgcgctgctcttccttggttcccgaggcaaaagttcccatcggatcatatggcgtgccattgtaatgagaagaaagaaaggcttccacgtcttcaatcgcgatcttcttttctggccgccgcaggaatggcatgttttgactggttggatcctgttcaatggatggattgaacagcttttgtccataccaggttcgaggcgtgttatagtagctgtcagcctcgctttgcgtcccgaagatgttgcgatagttaaaggtcgttgggtcaggattcagatgatttttttcaacgaatgactttaaagatgatgcaaacatgaaattgtcgggatcgttaaagtcgatttcctcaatcaccatgatgttgggacagatggcataacagtcatctggaatgcgttgagcggcccattgatgaccagcaccggtttcaaagtaccagacctcatcttgatcggcaaaggcaataccattgcactcgccggttccatattgttcgatcagcttaccaagccgggccacgccttctctggcagttttgataaatggcagtaccagatacagcatggaatcctcgtcgatgccgtttttagccaacggatcgtggcctaggcagcgagcgttggtaccttcagtttcggtagcactcattgccacgttgtattcattgatgccctgttcgtcccagcgccctttgatctcattttcctgagcgtttggtgtagcagtaaagcgacagccatgaccatggagtgggattctaacgcctgagtattcagaaatgaactcctcatcatagtcgcgagccggaaagactttgaaagttttttggttaatgccgctttcgccgtcttcatcgcgggcaattatggttgagccgtcaatcattgcctttttgccaactagcattgccgtgcatgaagaatgaaatgaaccaaaatgttccatatgaaacaaaacccctttcaagttagatctggctttattttacaactaaaaaggcaccagtgaagcgatcatcgatgccttaattttaattttcattcataattggatcagcagttcttgggttgttcttaattttgctttgaaccggctttttgaaatcttgccagttaaagatcagatttaagattacggctgccagactgcaaacgaccaccccattgcccagaatgatctgtgcttcggttgccaggtgctggaaaatctgtggataaacagttacgccaagccccagtccaattgacatcgaggcaaccagtagattgctgttcttgttcagatccgctttttgcagaatctgaattccctgcacgccgaccatgccaaacattacgatcatggccccaccgagaaccggcgtaggaattacggttgccagcgcgccggctttaggcagcagtcccagtgccaaaagcaggaaggcagcatagtagaccggtttgcgggtcttaacgccggacatacgtgaaacgccgacattttgcgagaacgttgagtaggggaaggtattgaagatcccgcctaaaatggcagcaatcccttcagcacgatagccgcgtttcatgtcgtcttcagtaatcttctgaccagtaacgtcgcttagggcaaagtagaccccagtcgattcgatcatcgtcgttaaagagaccagcatcatggtaacgatcgcgctgccgttatacttaggaaccccaaagtagaagatctgcggcagatggaaccaggaagcttgggcaaccggtgttaatgagaccataccaaatgcgccggcaataaaggaagcaatcaaaatccccagtagaattgcgattgacttaacaaaacccttggcaaatgcattgattgccaaaatgatgacaatcgttaaaaagccgattgctaagttggctggcgcaccgaatgacttgacagctgctgagccaccgccgagattttgaaaaccgactggaaccagcgtaaaaccgataatggtaatcaaggatccagttacgactggtggaaacagtcatcttagcaaacaggccggcaatcaaaaagacaaagattccggcacagatgatggcaccatacatgtaggcaatgcccagtttaccgccaatcgattccaaaggggcaactgattgtaccacacaacccagaacgaccggcagaccgatcccagtcagcggcgtcttgcgcagctgcagcagtgtggcgatcccgcacatgaagatgtcgattgaaaccagataggtcatctgtgctgcattgaaatgcagaaagtttccaatcaaaagcgggaccaagacgtcgcctgagtacatggccagcagatgttgaaagccgagcaccagatttttccaaagtcgtttaattttccctgtgatgcactattcaagatctttcctcctgagtcagcccatacagacaagcaaaaagtcgccatggcaggcaaccatgacgactttttggctgcttatagtcctgaatttacggttcagggtagagactatcgcccgtattgcgagaatatataggcttaactttaatttaacgggattcatcttaacataatccgaaccttttggaaatcaaaaggttaatcaatcataaaattacgaacttatttcaatgccaccagtgtcgattgaataaaaaccagattgagagcagaatcataattaaagtaatcgcgatcgtgatctgccaggcccattcgctttgggcaaacggcagcgacctgacgttttcgccataaaagccggaaacgattggcggaattgccaagacgattgaatagatggtcagaaatttcatggtctggttcagattactgtccaggaccttgctataggcgtcagaaacgcgagccgagacgtcagatgtcatctgggccatttctaaaccttgctgggcttcgataataatatcgtccagatcattaagctggcgatgcgacatccggctgccaaagcgtcgtttgaattcttcaagcagggaaacgttgccttttagcgaagtcagaatatagaccagccccgtttcgatttccataaattcggtaattgccttgcgttccgtatggttctgcaggttgcgctgaatctgctggcgctgttgatcggcacgccgaattggtccaaaatagctggttgagagtttgtaaagcgttggcagaatgaaatcaaagcgatcattaaccggaccgcgttttttcatggttttaagctgcttggccaggattccgttaacaaaattggtctgagcattggtaaaggttaaaacgttgttggccgtcagcataatgccgattggcgcggtttggggtgccgagacctcatgcgtgggtacatagacgtcaaagatcagcaaagtgacaccggcatcccgatcaacctcaacccgtgctttttcataagggtcgatggcgtaatccaaaagctctttggtaacctcgtacttgttgatcaaatcttcgcgttcatgaggcaggggctcaaacacgctgatccaatagctttgttcattgattagttcggcactcaacatgattttatcctccgcgaaaattggtctttaagtataattcaactatttaatgcgctaaaattcaacccaggtaaccataagaactgaaaaaaagtatcaaataatcatcaattaaggggattatgatggaaaaaaactggaaaatcatcgagacgctgtcaaaagatcagccgtcccaaacgctgcgtgatctgctgcaaaagcaatggctgctgccgcggcgctttgtatattatcttagaacgcgtcataacgtcttggtcaatggtcaatattatcccgttaatcatcaagtgcagccggcagatataattgagctgaattttaatggcgatgagtttcggacgccgcaaacgcactatcaaccaaccccacatcccaggctgaacgtactgtttgaaaatcgcgacgtcttggtagtcaacaaaccagcaggccaaaaaatgcatcccaatcagccgcttgaaactgggacgctgctcaacgatgcggccggttatttaaagacttcatcagctgatgcctttatggttcatcgcctggatcaagcaaccagcggcgctgtggcaatcgctaagaatccaattgtcgtgccgattttggatcgccgcatcagtcaagggcagatgcatcgccaatatcttgcgctggtggccgggaccatcacgccggatgccggaaaatttgattggccaattggcagagatctgcttgatcagcgcaagcgacgagtcaacggctttgccagtcagccagcactgacctactaccaggttgcctggcgcggtaaaaacgccacgctggtcagactacaattggcaaccggtcggactcaccagttaagagttcacctggcttacagcggccatccaatcatcggagatccgctgtatggtacgattgatgcttcgcgaatgatgctgcatggcattaagcagcagctggttttaccatttactgaaaaaattcaaacaattccggcaccaatagatgacgaattcaaacaaattttgttaaaatacaaataaagagacaacaaatagataaggaggagttcattgtcacttttaactaagctttacggaccgttcttcgacttgcacaactgggaagctgtgataacttcaagtcaggattggctgatcatcctttcactggtattgatcgaatgtctgttatccgtggacaacgcggtggtcttagcagctcagacccgggttttgccgacgcttaaagaacaagaggaatctctgttttacgggatttggggatcttatatcttccgcttcttgattattgggcttggcgtctacctgatccatttctgggaaattaaggtcatcggagctgcctacctggtatatctggtttaccgcttcttccgttataagtttcagggcaacccgaaacggcgcagcaagcaggctagtcctaaggctaaccgtaaaggcctgaccggtcggaagcggttctggtgggtcgttgctcaaatcgagttcatggacatcatattttccgttgattctgtgttggcttcacttgcaatttcaagcaacccagtgatcgttttgatcggtggcttgattggtatcatctgtatgcggggaattgccgaagtgattatgcgcttgatgaacaagattccagaattggagccaatggcgtatatcttgattctgtttgttgccattaagctgttcttatcgattcctgcaattgatattgagattccatcaagtgcttttgggatctttgttttagccgtttttgtcatcacgattatcgtgcacttggtacggcgtaaaaaacatgggcaggcaactgataaaaaggagtagtctgatggcacaagaagcaaccattgaaaactttgacgaaatgattcaaggcccgctgacggtagtcgatttctgggcgccatggtgtggaccatgcaaaatgatggaaccgatcatggcagagttggaaaaggaatttgccgggcagatcaaattcgttaagtttaacgttgatcatcaacaagcaatcgcggaacgctataaagtgatgagtgttcctagcctggtgctttttcgcgatggcgtggccaaggaaaaagtaacgggtatctatccaaaagatcggctggcacattatttcgcgcgtaaaacagctgaataagaccagcgattataaaaaagatctgattcgtttgagcgagtcggatcttttttttactaaaaaattaatttaggaaatcgtttgctatggcgctattttcatcgcttacattagtaaaacttttgaattaaatttttaaagaggggttgcaaacgatttcaaatcatgttaaattaacaacgttgaaattttcgtaaaacgatttacaaaaacgttttacagtagagaccataggaggaagcaaatggctaagaaaattgcggttttaggtagcatcaacgttgatacgacctaccacgtacagcgtttcccaatgcctggtgagacgatctcggcaggttccaagagttccgctcctggcggtaagggtgccaaccaagcagttgccgctgctcggtctggtgccaagacctggtttatcgggatggttggggctgacaacgagggtaagttcatgcgtgaagctcttcaagaagaccatatcgataccaagctgattggaattgatgagctgcatggtacgggaacggccttgattacgcttgatgccgagggtcaaaacgacatcatggtttatggtggtgccaaccaagcaatgacgactgaggttttgaaaaatgccgatgccgtctttgaagagatcgactttttgatcagtcagtttgaaacgccacaggcagtcactgctgaagctttcaaacaagctaaggaacatggcgtaacgacgatcttgaacccagcaccggctcatgaaatcttgccagagctgctgcaatacacggacatcgtgatccctaacgacagcgaaagctttgttttgacgggaatcaagattactgatgaagattccatgcttaagtccgcggaatggtttaagcagcagggcgccaaaaacctgctgatcacgttgggctcaaaaggggtcttctactgcacgccacacggtcacggaatggtgccagcattcaaagtcaaggccgttgatacgacggctgccggtgatacgttcatcggcgcgctggcctcgcagctggacaacgacttgagcaatgttgccgatgctctggtctacgcgcagcgtgcttccagtctgaccgttcaaaagatgggcgccatgccatcgattccaacgggtgaagaagtcaaagccgcacttgccgaataatcgcggctgaacgttcgcaacaataaaaataggaattaggagattttgatcatgaaaaaaactggaattatcaactctgaagtgtccgccgtcgttgccaacatgggccacatggactggctgtcgattggcgatgccggcatgccggtaccaatgggaaccaagaagatcgatctggcgctcgacaagcagctgccaagctttatggatgttttgaacaacgtcttaaaggaaatgaaggttgaaaagatcttccttgccgatgaaatcaaggaccaaaatccagaacagctggaaaacatcaaaaaggctttgcctgatgttgagatcgaattcatgcctcacagtgatttaaagaagaatctggccaagacgcatgccttcatccgcacgggtgagatgacgccttactccaacattattcttgaatccggcgttacgttctagtgaggtatgagccatgcaaaacagtaagaattctgacaagggccaaagctggctgcagctgccggacggctaccttgacaagacgccaatgtttcagttcctgctggtctgcctgatcttcccgctctggggggcggcagccagtctgaacgacattctgatcacgcagttcaagacggtctttacgctgaacgacacggccacggccttcgttcagtcagccttctacggcggctacttcctgatggccatccccgcctcgcggatcgttaagaaggccagctacaaggtggccattctggtcggcctgatgttctacatcatcggctgctcgctgttcttcccggcatcccgaattgctacctacagcgtgttcttggtagccatctttgccattgccgttgggctgagctttttggaaacgtcctgtgacacctacgcctcaatgatgggtccccgcaacacggccaaccagcgtctgaactttgcgcaaacgctgacgccgctgggtgacatcttggggatcgtcttaggcaagtacctgatctttggtgaaggcggcaatctggctgacaaggtcgctcacatgagcaaggctgaagcccacgcctacaacctgcacatgcttcaactgacgctgcgtccatacaaattcatccttgcaattttaatcgttatcttcatcgtcctgctgctgaccaagatgccacgtgccaaggccacggcaggaacgggcgcagaaggcaaggaagcacagccatctttgggcgagacgattcactacctgacgcacaacaagcgctttatgatgggtgtcggtgcacagttcgtctacgccggcatgcagacgacggtttggtcatttaccatccggctggcactgaaggttatgcacggcatttccgactctgaagcctcaacgtttatgatctacagctacgttgcctggttcgtcggcaagctggttgccaactggttcatgaaccgctactcgattaccaaggtgctgacctggttctccgctcttggaatggtctgcctggtaattgcctttacggttccaaacgcgacggccgtttacgcagccattgcgacgagcttcttcttcggtcctgaatggccaacgatctacgctcacacgctggaccagattcatgaaaagaagtacacggaaactggtggtgccttcatcgttatgtccctgatcggtggtgccatcgtgccagccattcaaggacgggtatccgacctttccggctccatgcagttctccttcatcgtgccagccatctgctttgcgatcatcacgatctacttctggaatgaacatcgctacgaaaaggcacaccctgaagaagttcaagaacactagcattgaattttcagttaacgcataacgtaaaaggacaatctcgccaacgcgggattgccctttttatatttatattatcgagtgcagcagatttaattattcagataagtggttagagctgaggattcgccaatgagccgatcagttcatggtgttcgctgatgtctaagccacgtccttcttcgcgagcagaaactcgaatcgtcataaagcgacccaagaccttaacgatagcccagaccatagcagcagtagcgataatcgtaaccagggttgccagtgtttgaatgccaaactgcgtgaagccaccacccatcagcaaaccatcgtgagtaacggcagggttgaccgtgtgagtagcaaaaaggccagttgcgatgcttccccagataccgctgactccgtgacagccaaaggcatccagcgtgtcatcgacttttagccgtggcttgatcttggtgatgaaccaaccgctgatcaagctcgaaccgattccgataatcaaggctccggtcaaggtaacgtagccacaggctggtgtaatgccaacgagcccgcacaatacgccggtacaggtaccaaccaaagtcgtgtgtccttcagtatagatttccagtaattgccaagtaaccatggccgcggcggcagcaactgtcgtcgttaagaaagcctgcatggcaatactgttgacggccagcgcagaacccgcgttgaagccatcccagccaatccaaagcagggtcgtacccaatagaacccaggaccgatcagcaggaccatccgaatctttggtgtgcagacgcggcccaatcatagcagaaagtaccagggccgtgacgccagcattgatatgaacgacagtcccgccagcaaagtcaagcgtgcccagcttggacagcagaccgccgccccagaccaggtgtaccaatgggtagtagatcagaatcgaccagcagatgataaagaaggttaaaaacttaaagcgcacccggccaacgatcgcgcccacaaacaaagctggtgtgatcaatgcaaacatcatttcaaagattgagaagatgccgaccggaatcttgccagtcgtcagctgctttaggttggtgccgtgcatcatcaattggtgcaggttgccgacaatggcgccgttaccgctgaatgaaagtgaccagccaactgctacccaaagcagaacggatagaccacagacgaaaaagaccgacataaacgtgttgacgatgttgcgccgacttaccaagccgccatagaaaaacgccagtcctggtgtcattaagaacaccagaatactggcaatcattacgaataaagtgtttgctgtactcattattgccatctccaattctcaaaactctaatcattttcttaatggcaactaatttagaccaattctttttcaaaaacaatagcctgagtttgattccgaaaaattaaacaaatttattagactagacaaaattgaaaaatgatgaaaacgtttcattcttgtgatttaaaactaaaatatggaatagaccaataattgaatgattgttgatcaagaggtgatcgtctaaaataatcaagattgtttaattaatgaagggagtagaaaaatggatcagcttttcgagcgttcttccattaaaaaggcttattttacgctggcaatgccagtggttttaagctcagccgttattattatctataacctggtagatacgttctttgtttctaagacccaaaatcctgatctggtagcgggcgtatcgcaaggcgcaccagttttcagtctgctgattgcaattggcgatatctttggcttggggggcagctcattgatttcgcggctgtttggtgaaaagcgcgatcatgaggcacgcctggcttcaggttattgtttttacgtatcgattattgtaggaatcttgatgacgatcatcatggtggcctttcagacgccgattcttcatctattgggggcgaccacggcaacttggcagtacgtgcgtgaatactacctggtgattgcgtttggcgcgccgtttattgtttttggcctgacaccaaccaatattttaagaactgagggattagccgttcagtcaatgacggccagcatggtgggaacgatttttaacatcattttgaacccaatctttatcttcccttgtggattaggggctgcgggttcggcgttggccactgtcgtcagcaatatcattggcgatgccttgatgatttattatttgaatgttaagagcaaaaaactgacgacctcgattcatgaaaccaggttaagtctggcactgcaaaaagaaatctattcaattgggattccggcctcgattaccaatatcatggttatgttctccatggcactgacgaatcgctatctgattgcgtatggctcaaccagtgtggcggcgatgggaattgccaacaagatcaataccattatctttatggtgatggtcggctttgcgtttggtgcgcagccgctgattggctatacttacggtgccaaaaatcaaaagcggtttaatgaagccgtacgttttgatattttggtcgtcgttgtttttggggtcgtggcaacgcttttgatgatgctggcagctcctctgatcattcgtttgtttatgcaggatcagaccgtgatcagtgaaggtacgaccatgattcgctggctggccagttcgacgacgctgggcggctgtattttggtatttacgacgatgtttcagtcaatgggtaaggcagtcccggcattttggctgtcagtatcacggcaaggcttgatttttttagtctgcatcgtagttctgcatcgtctgtttggttattggggaatcgtttcagctcaggccgcgtctgatgttttgacgttgctgctggctgttttgatgtggcaaaagaatcgaccgcatttcaaaaaacagtaagaattaataccttattagtgtgaaacagccgctgctcgatattgaggcagcggctgttagactaatctgaataaatttaaatattcaattttaaatcttgtaggcgtttttcaccccattggcacatggcatcgataattggcatcaggctttcgccagtattcgtgagctggtagaagacggctttgcgatggctgatcagctgttcatgacgtgagatcaacccatccttgatcatctcttttagctgttgcgtcatcatcttgtgcgtagcgtgttcagaaagccgctgcagctcattaaaacgcattgcgccattatgataaagactgcagatgatcaacagcttgtatttgccggaaaacatggccaaagtgtattctttggcgcagtcaaaatccttttggcgcaatttttcgagggtgtattgtctaattgtatcagtcatttgaggtctcctgtctaaggtcacaaaaaggtgcgttattgtgtactgtatagttataattttataatatacttacaaattgttagatgccaaaagaaagaaggatcataatggacaatcatttcacaagcgttacttcgatgcggcgcttaaacaatggcgttgaaatcccatgtgtcggttatggtacgtttagaacgccggaatcagtagccaaacagtcagttatggatgcaattgaattgggctatcggcacattgatacggccgcggtctatgaaaatgaagttggcgtaggtcaaggaattgctgcttcaggcgttgcgcgtgaagagcttttcgttaccagcaagctttggaatactgagcgtggctatgaaaaaacgaaagccgcctttcaagccaccctggatcggttaaaacttgattatctggatctttatttgattcattggccagccaacgaaaaacagtttggtcaggatgccgaaaagctgaatgctgaaacctggcgggcgatggaagatctttacaatgaaggcagaattcgggcaattggtgtttcgaattttttgccacatcacattaaggctttgatgaaaacagctaaaatcaagccaatggtcgaccagattgaggttcatcccggctggccgcagacagaagcagttcagtggctgcaggaacaggatattctggttgaaggctggggtccattaggcggtcagggagctaaagtcttagttaacgatacgatgaaagaaattgccaaagctcatggcaagtcaacggctcaggttgcgttgcgctgggaattgcagcaaggcgttttgccactaccaaagtcggttcatcgtgaacgctcggcacaaaatatggaaatctttgactttgcgctttcagagtctgaaatgcagatgattcaggcgttgccaaatcttggtgggcaatgtgccaaacctgatgaggtggatttttaatgatgctgactaaaaagacattccgtagtggtacggaatgtctttttgaatgttgttgttttacatctcaaagtaggcatacagatcgtcaaccgttaattgagctttttcagctgcgttataatcggctttgatctggccatcttttaaaacgatcagccggttgccgtatttgagcgcatcttccatatgatgagtaatcatcaatgccgtcagatgatcctcagtgatgcgctgattggtagcgtgcagcaggttgcgtgccgtgtgtggatccaaggcggcggtatgctcatcaagcagcagaatgtctggtcgcttgagtgtagccatcaaaaagctcagagcctgcctttgcccgccggaaagtgctccggttggcgtagtcatacgattttccaggccattgttcatttgcgcggccagtttggtaaattctgccattcgttgcttcaagcggcgcggcatcaggtgacgtttttcaccacgcttggaagccagcagcatattttcagcaaccgtcatccggggggccgttcccagcttaggatcttgaaaaacgcgggctaaaaaagtagtgcgctgttcttcggttgttttggtaatttcagcgccggtatgaaaaatctgcccagcgtcggctttaagattaccgccgataacattgaaaagagtcgatttaccagcaccgttcgtcccaacgatggtaatgaagtcgccgtcgttgatggttagattgatgccctttaaaatcgtggtttcgttggcagttcctggattgacgattgttttgacgttttttagctcaagcattggttcagtcattggtttggacccccttaaagaacggcttacgaatgtggaatagcttgtccagctgcggcagcatcatgcacaatgccaagacgattgaagagatcaggttgaggtcgttggcactgaatcccagctgcaggactgccagcagaatcaagcggtagatgatgcttcccaaggttacggcaaccagtcgctgcgacagtgtcagctcaccaaaggcaacttcgccgatgatgattgaagccaaggcgattacgatggttccaatccccatgttgacatcggcatagccattgttttgagcaaccagcgcgccgcaaagtccaaccagtccattagaaatcataagaccaacgttgatcgtggcatcggtatgaatccccagtgatttagccattacaggattgtcgccggttgcgataaatgactggccatagtcggtgtccaagaaaaagatcagcaggagcgtgataatgacgattacgatcatgcctaagacgacgctgtcaaaatactgcggcagcgaggtcataaacgatccagaaaaaagcgtcttttggcccagcagtgagatgtttgacttacccataatgcgcaggttaacagaataggtggccgtcatcgtcagaatcccagccagcaggaatggaatcttgcctttagtgtacagcagcccggttaccagcccagccaacataccggcgccaaatgccaaaagggttgcggccaatggtgaaaaaccatgcgtgattgcggtaacggctacggcagcccctaatggaaacgtgccttcaaccgtcatatcggcgagattcaagatgcggaaggtcaggtaaaggcccaaccccagcagtgcccataacagaccctggccaattgcggatacgatcagattcatttgattacctccccatatttttcggcttcacgctggaaactggctggaacgtgcaagcccaacttgcgtgcctgctttaggttcaggaccggctcgccatgacggatgtacttaatggcagtcgtggatggcttcttcttgccctttagaatatcggccgtcagcttaccgccttcaacgcccagcttgtattgattgatgctgtaggtagcgaccccgccttgcttaaccatcgtgtcgacagctgggaaaacgggcttgttgacggcattggcatttttgaccagtgtctgcatcgcgccggcaatcgtgttgtcagttggtacgattacagcgtcaacttcgctcagcatttgttgtgagacttgatttaagtcattgctgttggaaattgagtaagccttcagatttaaatgcatctgcttggcatatttcatgaattccttatattcagtgacggcagaactgtcgctggaagtgtagatgatccctaacgtcttggcgtgcggcataaatttgtggaccagctgcagttgttccttgaccggcgcctgatcggaaatcccggtgacgttgccgccaggacgcttgttgttcttaacgagaccggctccttggggattggttacggcacctaagacgattggaatctttttggttgaattggccagtgcttgggaagccggcgtggtaatcccaaaaaggacggttgagttttcattgaccagtttgttggccatggtttttaagttgctttgatcaccattggcattttgatagtcgatcgtaatgtttttgccattgtggtagccttcttcggccagaccatggacaaaacctttgtaaatctgatccaatgcgggatgatgcatcaaggttaagaccccaactttgggcttggcctgtttgacgatgccgccattttccttgaagtaggcgaccccaagaaaggcaagtaaaatggcgattacggtatacattcttttcatggctttttgccacctttccgaaaccttctgaataattgctgcttgataaaataaaaagaggaagccagtctgcaggcctcctcttgggaaattaaaaagcccgcatgtggttccatgcaggcttgcattatgaaataagccggcacagaatggatctgacttcccagaccgcattccgtgcgatctgagctaccggctttgccaacgaatattaagttggatgcggttgtaactcatttgcttatctcctttcgcgtgtttgattgttttaaagtataatcagtgtcacgatcttttgtcaactaaaagttagatttttatgagttttttcttagaagaaggcgagccaagtggatattgaaagtattaaacaagattttcccattcttaagcagcgagttaacgatgagccattgacctatctggacagcgcggcgacggctcagatgccgacaccggttttaaaggtgattgagcactactaccagcatgatcatgccaacgttcatcggggcacgcatacgctggcgcagcgggcaactgcagcctatgagacggctcggcaaaaaaccgccgcctttatcaatgccaagcaagctgaagaaatcgtctttacgcgttcaacaacggaaagtattaattggatcgcgcagggactgagtgagctgattaagccaaatgacgcgatcgtagtgacgataatggagcatcacagcaatctggttccctggcagcagctggctaggcgaactggggctgagctaaggctgatcggcttaaatgatcgccaggagctggatcttaacgatgccgcgcgcaaaatcgattcacgggctaaaatagtagccgtagcccatgtttcaaacgttttaggcgtggtaaatcccattttaaaaatcagtgccatggcgcatcaagttggtgcctgcctggtcgttgacggagcccaggccgcgccgcatctgccagttgacgttcaagcactggacgcggatttttatgttttttccggtcataagctgatggcgccaaccggaatcggcgtcctatatggaaaaatggcctggctgaatcggctctgccccagtcagtttggcggcgagatgattgatcaggttactcagcagacggccacttttaaaccggttccctggcgcttggaagccggtacgcccaacatcagcggtgcgattgccttaggcgccgcgattgattatttaagtcagtttggtatgcaagcgattgcggaacatgaacaagaactggctgcttacgcgattcctaaactgttggcaattgatggcttgacgctttatggcccacaagatcggcatactggcgtcttggcgtttaatctggctggcattcaccctcatgacgcggcgacggctcttgatctggaaggggtagccattcgtgccggtcatcactgtgcgcagcctttgatggattatctgggggtcaatgcgactctgcgggccagtttttacctgtataatgatcaaaaagacgttgaccgcttgattgatgcgattaaggctacaaaggagttttttgaaaatgggtttgagcaagcttaattatttatatcgcacgttggttttagcacatgccagccacccgcatcaccaaggaaaactaccggacgcaaccgcacagaccacgctgcataatccaacctgcggcgataccatcaatctgacagtcagaatcgatgacgacaagatcagcgaccttaagtttaccggcagcgggtgtacgatttcgcaagcctcagccagtatgatgggcgatgttttgattggcaaatcggtgtcagacgcccaacagctgattcaggctttttcgaatctgattatcggtcaaaaaatcagtgctcaggcgcaagagcagctccaggatgccgcgattttgggcagcgtggcgcagtttccggctcgaatcaaatgtgcggccctggcctggcacgcggcccaagcaattctagaagaaaactaaaagacgcccgttcgcggatgatgcgatcgagcgccttttgcttaagagcctgtcttaagcgttaagttgataagaatgttgataagttttaaagctactgcataacgatgtagtagttaggacggtaatattgaatattgccttcttgcacgttttgaccaggagttggcgcttgaatgtagttgccgtttccttctgcgattgcaacgtggtatggtgctgaatcggttccccagaagtagagggctcccgcgggtgcgttttcaacatcatagtagtgagttcccagcgttgcctgttgggtcgtcgtgcgatagctgctggacagaccataggagtactgaaccagtccggaacagtcaaaaccgcttggcgtattgccgccccagacgtaaggaacgccaatcattgactgcgcggttgccagtccctgaccagctgccacgtggctggttgatgccgttgaagtggtgcttgcgctggcactggcggcatccgttaagccataggtaatcgtgtagttggccattgcggcattggcagcggctgagttggactcataggtggctgaagatgccgtgctggctgctgattcggttgttgcggctgccggcgttgcagtagttgttgcggaagtcgttgcttcagttgagccggtcgcggcagcagtattctcattagctgacgaagccgattgaacggattctgaatcagcagactgagctgatactgtgctggtcgtttgggtgtcagttgcagcatcactcgaagccgttgttgaggcagcggcttgactggcagtatctaaagcactggaagtaattgccgctgaacttgagctggtgcttgaatcagcaaaaacgctggcgctgacggaaccagccgtggaactggccgtcgtagtcttagtcgtctgacgctgactgttcttttgtcgattgatggtcgtttctggaatcgtaatccgctgaccagggaagatcagatccggattggaaagtgagtttgccgaaacgattgaagaaaccgtggtcttgtattgctgtgcataggcccagaccgtgtcgcctgaagctacggtaaccgtagtatcagcatgggcagtcgtctgcgcggcggtcatggctccggcagcacccacggcagcaattaaggccttagctgcttttttcttgatagtaatcactccatgtttttgttttttgctcagttgtgcgaaattccgcacggtttttaatttaacaagacaaaatgatggggcagtgaagactatttgaaaaaaatatgaagtcattttgaacctggcagagacaaaagaccgttatcaattgacttaacggctggaatgactgacagaactgctgcaggcctacttgcgatttagttaagacttttgcccagctcgtaggccaggtcgggataaaatcttagatgatgtggtgtggtttccttgccagctaagacctgtccagcaaacttccagcccaggtgatcaaaaatcgccttgaattcagactttagcgggtcaaaatcattatgcggagcgctggcaaccaaaatggcctgtttgtcatcatgcagctgctcatcacgttcgcccatatgatcaatgacggccttcatctgtgaggacatgccataataaaacattggcgtggcgaaaacgatcagatcagcggctaccatttgatcaagcagtcgttcagttacggcatcacctggcaataagtgattgtcggcatccattttaacgggagccaaagggtgatggccggcgtcaaaaatcgtaacgtggttggctgctgcctgggctcctttgatcaattgatgtgctaagatcgttgaaacggcaggatcgtggggactgcctaagattgttaaaatttccatgaaatgccttctttttagattctgcaacaatacaacaactctatcttagcactgataaatactttcaatgtctcagaagcctaccgctgccaattgaagggcaagcaaggtctgtgctaacatgaaaagcacgttgtttatttttgaaattagatgaggagcgagaaaatggcggttttggatgttagaaacctgacgatgagctttgccgataagaagctttatgaagatgccagctttcaattggaaaaacatgagcatatggggatcgttggtcaaaacggggccggcaagtcaactttgattaaaatcctgattggcaaggagctgccggtcgcgggcgatatcaagtggcagaaaaacaccaagatcggctatttggatcaatatgtcgatattccgcaggggatgacgctgattcagtttctgcacacggctttccaggaactttatgatgtcaatgagcagatgaatgagctttatgcaagatatgccacggaaatggatgatcgccttttggaacgagctggccggctgcaggaacgtttggacgcggctgacttttacgaggttgagactaaaattgagcgcgttatgaatggactggggctaaatgatattggcaaggaccatgtcgtttccgaaatgagtggcggccagcgctcaaaaattattttggccaaaatgctgctggaaaatccagacgtgatcctgcttgacgaaccaaccaactatctggacaccgcgcacattgaatggctgattgaatatctgaatgattttgacggcgcggccatgattatttcacatgactacgattttttggaacgcgtgaccaacacgatctgtgacgtggcatttggcaagatcaccaagtaccgcggcagctttaagcaggcaatgcggcaaaaggccgagcgcaaggagacccaggagcgcgaatacgaaaagcagcaggaagtcattgaaaaggcagagcggtttattcgcaaaaacaaggcgggttccaaatcaaccatggccaaatcccgtgaaaagatgctagcccggatgaagcggattgatccgccaactgataatctaaaggcgacgtttcactttccttatgaaaataccggttctgccaatgccttaaaggtcaatcagctgtcagtcggttatggtcatccgctgctcgcacccgtgacgttttcgatgacgatgggtgaaaagctgctgtttaccgggtttaacggtgtcggcaagtcaactttgatcaagtcgattctgggtaagatcccagcactgcaagggacggctgctttttcgccttcagcacggattaactactttgatcaggatctggtgtgggatgaaccgaatctgacgccactggaaacgattcaaaatctttttccaaccatgcagccaaaaacgattcgacaaaagctggccaaagcagggatcaatgccgctaatacgcaaaagccgctgtcgttgttgtctggtggtgagcagactaaggttaagctggccattttggaactgacgccatcaaactttttaatcatggacgagccaaccaatcatttggatgatgaaaccaaggaaggactcaaaaaagccctgcaagaatatcccgggaacctgatcctggtcagccacgagcaaagtttttatcaaggctggctggataaggtcttaaacgtcgagaaactgagcttgcgcaaatcatagtcaaataagcagtcagctataattaagccggctgcttatttttattaaataaattaattgaaatccggctgtctaaaaggattaatcttattttaatttagtttttttaaaatgagttgactttgaatctaaaaatgttaaattcttagtcataaattaaaaagattaaaaaaagattagaaaggtcgtgcgtaattatgacgcgaaaagttggtgttattggttcaggaaatgttggttcaacgctggctaacaatatgctggtagcagggacggcggatacgctggtattgattgataccaacgaactaaagctgaattcggatgcaaccgattttgaagacgcggcggccaatctgccaactcataccacagtggtgcgcaacgactatgaagccctggccgatgcggatgtcgtcgtgatcgcggtcggcagtatcggcgtgcagaatgacgatgccaagcatgatcgatttgttgaattgaaggttaccagcaaggccgctaaagaagtcggtactaaactaaaagaagtcgggttccatggcgtgctggtctcaatcagtaatccttgtgacgtgattgccgcgctgttccaaaagtacactggtctgccaaagactcaggtaatcgggacggggacgctgcttgatacttcacgcatgaaaaaagtcgttggtcaaaagtttgacgttgatccgcgctcggtatctggctacaacctgggtgaacacggcaactcgcaattctctgcttggtcacaggtacgggtcatgggtcatcccgtaaccgaattggctaaggatcgtgacgatgttgatctggatcaattggctgaagacgtgcgggcaggcggctatgtcgtcttccatggcaaaaagcacaccaactttgggattgcggcagcggctctgcgtctggttacggccgttttgaatgacgcgcacgctgaattgccagtctccaacttccgcgaagaatacggcacctatgtcggctaccctgccattattggtcaccaaggactggttcggcagctgcagcttgatctgactgatgaagaaaaagacaagctggctgcttcggctaaatatatcaaggatcgttttgatgacgtatctgccaagctggacaacgaataaaaactacagaaaatgaaaaaggatgcgtcaagagctggcgcatcctttttggttttaaaaataagcagctgctgattaatcggcgctgacgtattttgccatgtcctgaccgctgctttcgtaggcattgttgccattgagagcccggaaaatggcgcgttcgacagcggtattgctggtcgtgacggcaatcgcaaatggccggtcgttacgcttggcatggtgcgtggtcagctgactgatgcggtgatgaatgcgatcgatgcagacgacaatcagatcggcatccttaacggcccgtttgatcttgctgctggagacgttttcttccattgaggcatccagactgtagaagacgccgtggtgcttggcaacgacggctttaagatcctgcacgcggtcacgagctccagttaccactaagacgcgtttttgatttaagtcgtaattaagcttgtcgctgtattcgtggcgcgtatttttaaccttttttggctgttgcagcttgcgtggcgctttggtcgtatcaaactcgtgctcgctgtggatccagcgaatctcaccagccttagcgtcacgcattccatttccgtgatcatagtaggcaaagtcgatgatcatgccaggcttgaggttgcggctggcatatttgtaaggatcgatcacgatggtattggcatgcgactcatccagaatcgaattgcccttgagcgtctttttgatctgcaggacatctgagccggcaactggttccaaagtggcatattcaataactttggttggcgtcgtgctgattgccagatggtcattggtaacacgattgatgacgggcagtttgccatggatcaagcgctgacggtccagctgcacgacatcgccatcattgattggaaatggcagcttgtgcagaatgctttctgaatagaaacgatgattgatttccgcaccgcttaacagacggtggacgggatagcagttgtcgcgtgccagcagttcgacttccgaaagctcaggtgcagctgccggttcagtcggcgcttcgtttttagcagtgacggggatgtctcttaaataagcctggttggcagctgctttagccgttgaccgttcaggctgcttattgctttgcggttttgatggcgtttcatgcggcttgggcgttggtgccgcggtctgattgatcagctggcctagcgagatctttggggcagtgacgttacgccgaatctgatagcctggcttggcagactgtttttcagtagacgtcggctctttaaccggctgcagctgattaagcaggtcgacgatgatcgtaagactgcgctgggtctgcagcagactttccgggtcgctggcagtatggttcaaaagttcgattagttcatgacgataatcatagaccatcacaagtacctcttttctaaaagttgactgattccatcttagcaaagccaagcggacatgtcagttgtcaagtatgagattatggatgttaagtcagctcaagggatgctgaaatcaaaaagcaggtcggttttgctggcgaaacgcttatttagctgttgaatcggttataataaagtcaaaatcacaaaggaagttagttatggctaagcgcaatattaaaattttttcgcataacgatctggatggctttggggccccagtattggtcaagacagtccaagacgttatgtttcccgatgctgagtttgacttgaccagtatcggtgccggtagaatcgacagtgagctggactactggttcaaaagtcccgaagcagccacggcaacggatgtctggattatggatatgacgccagacagcgagcatacgatgcaggagctcaatcagcagtttgccaatcactggctggtttttgaccaccatgagactgaagcggcattgcggcaaaagtttacggccaatacggttaagcctgctgatgcaaaaatcagttccagcgcgaccagtctggtatgggattggcttaagacgctgcctggctttgttaagctgaatcaagatcggcagcagcagttggcggaactggtggagctgattcgtgcctatgatacgtgggattggcaaaatgatcccgatatgagcgaaaaagagcgtcaggcagctgatgactttaatcagttgttctggttttatccgcttgatcattccgaagcctttgtgcaaagcgtttttgacaaaggctggacggcgtatcgtcaagacaatgacctgctgattcaaaccttgaacgaacggcgggccaagtacttaaagtcgcacttaaaagacgtggttgaggcaacggcagatgggcaccgctttggaatcgtctatgccagcgactataaatcagagatcgcgcatgagctgttggtacagcagccggatctggatgctgcgctggtaatcagtcccaagagcgtttctttacgcagcaatggcaaagtcgacgtggcaaagtttgcggaaacctattatcaaggcggcggtcatgccgatgcagccggcggacgattggatattaacccaattcgcttaggtgagcaggcggttgctgatgagcttgaacagatgacaagcgtcaaaaaagaagaaaaagcagagactgaaagcacgctggcagataatcttgatccagacatggcagccaaattagcagccttgtttggcaaaaaagaagactaaaaaaatcgggttcgtcaattggcgaatccgattttattttggctgttctgctacgctgccacgctcaaccagcttgaacggtaccagttcggaaggtgcgttgccgagcaggtctaagacgctgttaacgccgatttgataaaagtcctgggtaacgctggtcaattgtggatctgtaacctcgcaaagaaaggtaccatcaatgctgacgatggaaagatcttgcggcaccttgattcccatctgcgcggcctgacgcatgatgcccattgcaaccagatcactggcagcaacgaccgcgctcagtttgaggtcagcccagtactgcatgatggtttggccagcctcatagctgtaatcgccatattgaatccaatcctgttcaattggcaggtggtgttcatacatggccttttgatagccggcgcggcgctggagaccggtatgtgaatgatcaatgccaaaaagaccaatgcggcggtggccttttttaattaagtattcaacgctttgagcagccaattcagtattatcagaactgataaactgtagcggcaattcataagagtagttggaaaccagcctaaccggcagctgtgaatcctgcagcattttaagactttgcggatcaatctggctgccaatcagcagaataccggcgcgcggaccggccgtggcatctttaatcgcttggtggagcagctggggactgtgattgccggcataaaggataataatatgatgattatgggccagggctgtctgctgcatgccatccaagatcccagttgaaaaattggttggtggattgctgacgattacggcaatcttgtcactggagcgcgttgccagttctgcggccgcgctgtttttctgatagcccagtttggcagctgcatcccagacgcgttgggcagtctgaggagtataggtattggctttttttgccatcactcgtgaaaccgtcgcaattgaaaccccggcttgacgagcaacgtctttgatggtgggtttattggcgaccattttaatcagccttctttcatagcgcgatttatatatacattatatcatgcaagtgttttctgtaaacgcttactttggcggtcgattcgaactgatttaatgtcaatacgtaattttgatgcaaaacgattccattagcttatgttaaaaaattagtgaagttgaaaattgtactatgtaaaaaatcttcagttgcggaaagtggctgaagattttttactctaaattaagtattatcaatgattttaagtaactaaattttattatgactgttttgaaaacatagttgaatctaaggggtaattagtttgccttgaactagaagattttgcagctcacgttcagtctgtacgtggcgaagcttgcttaaccaactatcatcttgaacgctgcgtaataaattagctagcagttctaaatgcttttcttgatctataggtgctaaaccaacgacgaaattgatgtccttttttgaatcgtcaatgcgaaagggtgtcttgaagtacgtaaagttaacacccagtcgattaacacctgcattataggaggcatgggctaaaaggatacctttaccgattgccatatagtcaccatgttctttggttagtttaacgatttgatcaatgtaacgtggttgaactgtactgtcatctactaagggctgcattgagactcttactgcgctttcccagtccattggttcgcgaatcagtttaacgtgcttttccaacaatggatcttgcagtcctgctttgctttcagcagatggctttttgaagtagctacgcagagcctgctctaagctttggggatcaacgatacgggcatagtttgcgataatatccataatggaggagactttaatttgagaaaaatcacttgagagattgaatgttgtaaatcctgcattttgtaactgatagtcgatatgttcccaatctgagttattggggatgactgggacggttaatactggacattctttttgaggtagactggtcgtactgagaacgagtttgatgttttttagggaacaattttcgtattgaaaaatattgtatggtcctacaaatccaacattgggatagcgctgtctaagctgtgtgagtagtaactgcgaggtgccaattccactggaacatacaaccaatacttcactaatgggggttggtggtaggacagtttgacttgaactgcgcattgctccactgaagtaggcggtgataagtgctatttcgtcttcagaaagggttgaatttacaaatttattgaagggagccactgctattttagtaagttcaaacgtttcacgatagttggttttcattcgctccaatagcggattgtggtatcgaatgttaaattttacgcgacagtaggttgatgccaagtgagctgttagattctcatttagacttccgacctcagcaggcaacttaacgccagctttttgattgaatctttgaatgacttttgtggtaatcggttgaatctttttgattaatgggctgcttagatttatgtgctgaaatgcttgagtattgacgatttttgagatgtatcgtgactccatttgattctcaacaccatagtcttttaaaagttgtgttgcccagtcatagctaaatgattggtctgcttcagcattgtctgcagtaaggcggtagctttgattttcaattctagatagtagccattgtaggtatgaatttaaaatgctgtttgaatcatctgtaaggatattaccggtagctttttcgaagagctgcagatgttcggatatacgagaatcacttgatggctgaaagaaaggggatattaatttcagtagactctgaagatgttcgaatacccaactgcgctgtacggtttcatcccctacgatacttttgccagatttaaaattttttataaacaactcatttggcagagtaactgcaatttcgttgagatctttgatgattgtatttttactagtattaaagatgttcgttagctgattgagtgaagttgtatcacgtgagataaggaaaaatatttcagtaagttgacgttgattctttgccaatttactaaactgcggaaaactatcaaaaaaactggcgaaatctgttacggtttcgtcttttttgtattttccagccagttgttggcgagtctcatcgggaagaagatatccgataccacgaatattctcgatttcgtatagtccctctgtctctagctctttgttgacatggttgatgacataaaaaatacttcgacgcgaaagatgtagtttgttttcaagagcttttaaagaaaccaccgatggcgaatttacaagctcgagcaacatttcgtttccatgtttaacatgactaaattctatcaacaccattcccccaaacgtaatttatttatctagtttactttttgcacaattttaaggtacattattgcacttgtgagaatattgtcaattcaatattatgaaaccgtaaacaaaaggaaatgaggtgatcaagtggcgttggatctattaaataaacagaccgttcaagttgtagatgggagagatttaacctggcaagatgcaatttgcaaagcatcgcaaccattaatcgataatgggacggttggtaatgactatgttgattcaatgattgatgtcgttgaagaaaaaggcccatatatcaacattggacccaatatcgcactagcacatgcgcgaccaagttcaagttgtaaaaaaataggtttagccttaatgaaaacaaatcatgtagttaacctaactgatgaaaagcatccagttacattatggttcgttttggcagctactgacagcaacagtcacttaggagttattcaaaaactttctgaggttttgatgaatggcgaaaatgtgcagcgattgttgagagcaacgacggttgatgaaatattaagagttttcaaatagccgaagggggaaaatatcatgaagtttgaagcattatgccaaagtggcttgggtagcagttttatggttcagatgaacattcaaaacctgctaaagcaggaaaacgttaaggaagacattcaagtagatcactctgatattggtagtgcaactccggatcaagcggattactttttcttggatcctactcttgaaacttctgcaggtaaccttcccaaagaccgactgattatattgaatagtttggttgatccaaacgaattgaaagaaaaagtcaacgctattttggacaaggaaggtatcgagcatagctaaagaaaggtttagtggctcacagatttagtttttaaaaatatgtagttaagcaattattcaataaatgagccgctttgaagatggaacggaggaaatgactatgaatggaatattgaatctatttgtcagtatcgttcaaagtcctgccatgttggttggtttacttgcggtattgggactgattttacagaagaaaaaggctactgaagttattcaaggcgggattaagacttttgttggcttcttagtacttacaggcggtgcaggaattttaagtaacgctttaacaccttttgccaaaatgtttaagtttgctttacatgtacaaggggttgtaccaagtaacgaagcagtggttgccattgctttagttaagtatggttctgttactgctctaattatgttggttggtatgattgtcaacattttattggctcgttttacaaaatttaagtatatcttcttgactggtcaagcaatgctttacgtttcatgtcttgctgctgttatcttggttagtgcaggtatgggatcgggttggcaaacgattctgcttggaggtttgtttgaaggtactttgttgactgttacgccagcattatgtcagccatttatgcggaagattaccggtggcgacacagttgctatgggacataccggcaatattggctatgcaattgctggttggtgtggcaagctcttcggcaattcaaagcacagtactgaagatatcgaatttccaaaagctttaggatttttgcgtgattctactgtttctatcactttactgatggggattgtatatattgttcttgcaattgttgcagggccacattttgttgagactaaattgagtgctggtactaattacattatttatgcctttattcaagctggtacttttgcagctggctttgctgttgttttgcaaggtgttcgtctgattttggctgaaattgttccagccttccaaggtattgctatgaagttagttccaaattcaaaacctgctttggacgttccaatcattttcccatatgctccaaatgctgttctgcttggtttctttgtaagtttccttgtaggtactatttcaatgttcattatggttggtatgcacactacggttattatcccaggtgttgttggtcacttcttctgcggtgctgcagctgctatttatggtaatgcatttggtggtcgtcgtggtgcggttatcggttctgctgtaaacggattactgattagttggttaccactttacatcctgccggttcttggtgatcttaagatggctgcttcaacttttgctgatacagattacctaattccagggatcttgcttggtaaattaggatcatttggttctgttgctctgacttgtgggattatcggctttactgttgtcgttatcttagtcagtgtattaatgaagtcaccaaagcaagctgaaaacaagtagtgattaggcttttaataccaattttgatagctgcttggctccagcattggtgctgggtagctatttttttacccaaaaatggaggataaccatggaaaaacaagaaatgagagcagttgatgcactgcggttcttaagtgttgatatgattcagaaagccaacagtggacaccccggtgtagctatcgatgctgcaccaatggcgtatgcattgtgggaaaaagttatgaattttaatccgaatgatgagaagtggttgaaccgagaccgctttgttctgtcagcgggacacggatcctctttattatatagtttgctttacttcaatggatttgggttaacaattgatgatataaagcagttccgtcaattaggctctaaaacgcctggacatcctgaatatggatggacagctggggtggatgcaactactggtccgttgtctcaaggacttgcaatgtcggtcggaatggctttggctgaaaagcacatggcggctatctataataaaccaggctataacgtaatcgatcactatacgtttagcttaattggtgatggtgatttgatggaggggttaagtgaagaagcgcttaatattgctggtgataaaggcctaaacaagctgattgtgctttatgattcaaatgatgtttctctggatggtcctcttagtttgagtacgaaagaaaatgtcaaggcacgagtagaagcagctggttgggattatagtcgagttgagaacggcaatactgatgttgatgcgataattaatgccatcaataccgctaagaagactgatatgccatctttgattgaaataaaaaccacgattggctatggagctcctggtgccggcactcataatgtacatggggctcctcttggtgaagagggcatcaagaaaatgcgtgatttctatgactggaaccttgcaccttttgagtttactgatgaaattcaaaaatgttttgatgaagcagtaaaagcaaagaagccaagctatgacgcatggcaaaaaatgtttgctgagtaccaaaaagagtatccggaaaacgcaactcggcttaagacaagcaaacttaatatggataacattacaaccagttacaaaccaggtgatgaggtagctacgcgagtcgccagttctgagattttacaagaagtggctgagcataatccgcagttctggggcggtgctgctgacctagcctcatctaataaaacctatcttgcagatgatggcgactttaccaaggaaaatccaactgggagaaatgtgttctttggtgttcgagaattcggcatggctgcggcggttaatggtatgaatctgcatggcgggaatcgagcttatggaagcacgttctttgtatttacggattatctccgagcagcggttcgtttggcagctattatgcattgcccatctatttttattggatcacatgactcgattgcggttggtgaggatgggccaactcatgaaccaattgaacagctttccagttttcgtgcaatgccaggtttaaatttggttcgcccagctgatgcaaatgaaaccttggctgcctggaaattaattgctaagacgaataatcgcccaacgatgcttgttacatcacggcaaaaacttcctgttctgggtgaaactattgatgccccggttgaaaaaggtgcatatattgtatctaaagaagaaggagaacagccggatggtatcttgattgcagctggttctgaagtttcattggtattgcaagcgcaaaaacttcttaaagaaaaaggcaaggacgttcgagtggtatcaatgccgtgcatgaacctatttaaagagcaggatgatcaatacaaagaattcattttgccaagtcaaattgaaaagcgaatggctgttgaaatgggcgcatgtcaaagctggtatgagtttactggcctgcatggcaaagtcatgggtatcgaccggtttggcgccagtggtaagggctctaaggtaattgagaagtatgggttcacaccagaacatgtagccgaagagtttatgagaatgtagataaggcggtgatgtgttggcagactaaacaatgaaacttaaaatttgaaccctaaatctagacatccctctattgctataaatttaatccatttgaagagactgggatcccagcctctttttgtttagttgagtgctatcacaatcgtctttaaggaatgagaggagaagactatgtcgcaaattattaaaggaattgctgccagtgacggaattggaattgctaaagcatatacccttacggaacctgatttaagttttgaaaaaaagcagattgacgatccggttgcagagtatcaacggattgaggatgcttttaaccagtcgatctcagaactggcggccatcaaacaaaatgccaaaagccgcttgagcgatgaggagttggaagtctttgacgcgcacatcgccattctatccgacccagaaatgaagaaccagatcaaagacgaaatcgaaaaccagcacatttccgccgaagaagccatgacggacgtaacgaccaattttgccaatgttctggccgccatgaccgacaacaagtacatgcaggagcgggccgctgacgttaaagacggtaattgcatgagcgggcgctgacgttaaagacgttgccaagcgggcgctgagccatctgctgggcaagcactgccagacatcgcctcctcagtgagccgtcgtaatcattgctaaggagatcacgccatccgatacctcgcagatggatgccagttcgtcaaggggctggcaaccatctgggcggccggaccagccacgcggcaatcatggcgcggacattgcggatcccagccgtagtcggtgccgagacgttacgagcacgatcaagaacggcgatatggtcattgtagatgggctgcacggtgacatcatcgttgatccaagccaggctcaatcgatagtatcaagccaaggcggactcatttgaaaaagagcgagctgaatgggccaaactggtggacgcgccatctgtttccaaggacggccagccacttggagattgcggccaatatggcacgcccgatgacgaagctgatgccctcaagcaggggctgatggcgtcggcctgtttaggtctgaattcctgtacatgagcagcgatcacctgccaaccaagacgagcagtttgaagcctacaaaaaagcagtcgtgggcatgcagggcaagccggtcgtcgtgcggacgctggacattggtgcgacaagccgctgaactacctgccacgcccgaagagatgaacccgttcttgggctaccgggcattcgaatctgcctgcaccggcctgacatcttcaagacgcagctgcgcgccttgattcgggcctctgaatttggtcctttgagatcatgttcccaatgatcgcaactctggctgaactccgtcaggctaaggcaatctaccaggaatcaaggagagacgcgcaaaaggatcacccggtctaggcgacaacgtaagatcggaatgataatcgaagtgccattggcggcattgtatgccgatcaattggctaaggagtcgacttcttcagtatcgggaccaatgacctgattcagtactgctttgcggcgccaccggggcaatgacgcggtttcctacctgtatcagccgctcaacccagcctttttgcggttgatcaagcagtattgacgccgctcatgccaacaacaccaaggcggccatgtgtggcgaaatggctggtgatcagctggctaatgccattattgctgggcatgggactggacgagtattccatgagtgccagctcgattctgcggacgcggagcatgatgaaggatctggataccaaggaatgcgccaagtgggccaatgatgccatcaacctgtgctacacggctgatgaagtggaaaagatggttaagacacggctcggaatgaactgatcatcgttaaattaaattgaaaatatatcgctaaaatcaataggcagccagtctttgtaagttgatgcaggaactggctgcctattttggtataaaaaagcactgttttggcatgtaccgaaaacagtgcggttatcttgattaaatgttcaacaaatcagtaggctggtgaagcaaaaagtcaccatccatgatcttttcaggggtagcggcgccatatagtgctgcggcaaatttaaccccagcggcgtgtgcggccttttcatcatttatcgtatcaccaacatagacggcagtttcaggtgcggcatgcatttgatctaatgctgccaaaaccggctctgggtcaggtttatggcgatcggtatcattggaggtgatgacaatgtcaaatagcttggcaaaggcaaatagattggcaaaatgatgatcgtactcatcacgcagtttggaagtggcaattgcgatttgaatgtcgggactttgcgacaattttagcaaagtttctggaatgccatcaaaaacctggatacgatcctctcgttgataagccagcttaaaccattcctgttgcatttggcgacgcaatttgtcatcggctacgccagcaatttttaaggcatccatcccggtaataccaaacagatcatgctttttttgctcaacatcggccggatcagtatggtagccgtgcttctccaagatttcgatcattgccggcatgtacatgtcaatcgtattgatcaaggtgccatcaatgtcgaaaatatagttcttaatcataaaatcctcctgtgtacggatcataccctcaacgtttcaattgtaccgcaaaacattttatgacaaaatacgttagttgctagtttgtaacattcccatgacttctaaattatgggtcagcataattgcctcaatgttcatttgcagaccacccagactacgagtaagtgtatgttcaatgtcctgtcgcgttagatcagcaaagcagctctcaattcggcgccgaatttttttgagttgccggctgttgtgttgtttggcgaaccgcatattggaacggtatggcgtccatagctgatagcccatttgcgaaaaaatatgctggagctttttaccaacataacccacatcggcaatgacaaaaggacatggacaattctcgataacttctggagcagccttagcgtcatgaattgaggctggagtaagttcatagttaagaatcagtccttgcgtatccgtaaccacgtgtaccttgaagccgtaataatacttttgtttggtagcgttgtatccaatatccgcaaagcattggaacaaaatcgcccgaaacttgcggtgatcttgacacagcggcaatgggaagctgtcaataatggcgatatcaccatagctggacatctcgattaggccagagcgaattgactggaaaataggaatcagatttttacagcgacgcataaaccgagaatactccaacattggcagagaaggcattacgtcactgaccaactggcagaatttccgccaagttgcgacctggtactgaaccttcaagcacattaatgccagcaaagcagcatcagacagcttggagttttcaatatttcgacgctccaggtattttctggatgcatagcgcttaagcaaatgactcatcattaagcgacagcgactgaatttgatttgaaaatcatgacgataaagcttaaactgaaagtggttcaacatagctaagactcctttttgttttttgtcacttatgagtctaactatgttgggctttttttgttaaatattacgaactagcaattcgcatgacaaaatattgaaaaacgcgctacctgactttgccgagataacgcgcggaaccgttataagagatttttatttattggcaccaacaacgccgaaaccgccgtcccagccaatctgttcgctggcagccagggtcatctgcagaaaaccggttgcttccatttcacgggcccgcttgagcttactggcatttaatacccgcagcgcgctggatgccaataccgatttaaaagctgccttggcatcttcatcatcgccggcaaccaggaccgttgttggcagctcgccaattttgccgctctgcaaagtagccgcgaaattattgttaaaagcctttaaaaccttgctttcaggcagcagcttctggagttgctgggcagctgagctatcagcggggacgactaattcatcccaggtttcaaaattcaatggattggtgatatcaacaacgattttaccagccagttcagcttggtactgtttggcaagggacgccagtgctggatatggtacggccataaccacgatttcgctgctgaacagtcaatggaagattctgatcatgcgcgaactgctgttgcattcaagtgaaagatacagtgagctgcagcatagcgttaccggcatcagccaaaagatgcttacccaaagcctgcatgagatgacagctgatggaatcgtacaacgtcaagcttttccataagtaccgccacatgttgagtatcgtctgaccgagctgggccaaagtacggatccaatcctaaaagccatgcataactggggcaatcagtatctggccagtcatcccgaaaaacgcaggacgaataaacagccggaaactaattttgcgcaaaaacgaccatagtcaaaagaggctgggaaaaaaccatgcctcaaattgaaaacccggatgattcgcaagataattgcggatcatccgggttttatgtatacaggaaccaaactcctgttatgatagaaataaccacaaatcaaccaaaaggagtcgattcccatgtatcaaaattgtaccacatcatattgtgaatttgattaatgatttcgtcaattccattcctaatgaggtattacttgatgccggtgaccataataaatcaactggtcgtccagcagttcatcctggaattcttttgaaagccattctttacggctattctcgtcggcagttttcagggcgcaagattgaattgatgatgcaagaaaacttgcctatgatgtggctggttcagcaacagaccttctcctaccatacgatcaattccttcattaccaatgaaaagaccgcccaactattgaagagagtctttatacagtttactgggaagcttcatgaattaggcttgattacccaagatgccctgttcattgatgggacaaagattgaagccaatgccaataagtattcgttcgtctggaaacgttccaccgagaattatcaagccaaactggaagagcacgttggtgagctctatgatgaactagttgaaaatgatgtcaaaccggcgattgaaaaagaagaaatgaagaccgttcacggcgttgaaaccattactgaccagctggaaaaagaagtagaacaacttaatcaagctatcgaagctgaaccaaagattatcaagggtggttttgaaaacaaacgaaaacgccgcaaagtcaagaagtacattcgtaagctaaaagaagactatcttccaaggttaaagaagtatcatcaacaaatggcaacgtttggaaaacgtaacagctattcaaagactgatcacgacgccacctttatgcgaatgaaggaagatccgatgctcaacggacagcttaagccgggatacaatcttcaaattgcgacgaacaaccagttcacgattgactatgatatttacagcaacccaactgacacgcggactttagtaccatttttaaagcaaatggagtgccgcgaaatgtttgaaacaatcgtcgccgatgccggttatggcagtgaatacaattatacagtaatcattgatgagttaaatcaacaggtattgattccctacagcactatggatcgtgaactaaagaaacgttataagtccaatccaaaatatccagacaattggatctacaacgccgaagacgacgactacattgatccacagggagttcgtttcgattttaaacggtacagcaaacgacacgacaagtatggctttgaacgaaactttaaggtatatgaggccaatgcctttcaactgaataaaacagccagtgaagcttccagaacaaagaaggctcagcgattgcgccaaatttacgtgaatggcacgtggaattatttccgaaacctggtcaagaccgcgattcaaagcgatgagggtcatgccatctatcggcgacgcaaatttgacgttgagcctgttttcgcacgtctaaaacaaaatatgggttatcgcagaaccaaacatcgaggaaaacagggggttaaaaatgccttggggttagcgttgatgacactcaatctggaaagattagcagattgggcacgtcaaaaggcaacccagggataaaaatataaatataaacgagaaaataccggacaaaatcagtcgttaaacgaccgcttttgtccggtatttcatttaagttaagaggaaaaaactatattttcagatgaattttagagaatagtaatattaaaaatcgctagaaatcaacgttttcagcaacgtggttcctagcgattctttaattttgagacttttttcccagcctcttgattatttgttaaaagtgtcagattcgacttcacggataaagtcagccaagtgcttgtagtagacgtcagggttgtcgatcatatggtgatgacccccatttggcgtggtaaccaatttagcgtttggaatttctttttccatagtcttggcagtgtccaaaggcatggtttcgtggtccccaaacgtcagcagggttggcaccttgatgttctttaattggtcgcggaagtgccagtctttgagcttgccagtaatcacgaactcgttatcaccctggaagacgttgtagacagctgtaccgccaagatccttgacgtggtaaagcttggatggctgcttacggtcgacgaagttttcgttaagaacctggacgtcggcttggtagcgatcgttgtcgtagtcgttgttcttttcgcattccttcataaaggcaacttcttcagctggcaggacgtcttcgcgaaccttgttgacatgagaaacgtattcatcgatttcatcaaccattgaggagatgatggcgcctttcaagtgctgaccgtatttaacggcgtattcttgaaccagcagtccgccccagctttggccaatcaagtagaaattatcgatccccagcttttgacgtacttcttcgacctcatccaagaagtactcgtaagttaggtacttgtcggcaatcttaggatcagaatagtctggctgatcagagtacaaagagcctaattggtcatacatatgaacttgaacgttaagtccctgtttttttaattgatcggcagcatcttcccagtattcatgattgccgccagggccaccatgcagtgcaagcagatgaatgtcaccttcaccttgtgtgttggtccataaatgataaccgttatcaagggttaaaatcgttgtaccttgtttcaaaatcgtcaactcccattctctcagatataaacgctaaataaatggtttaaaaactattttacgttttttattagatgacgtaaaccaaaaacactgccgctttggcaaatctgacagaaaaactacggtaatttttcaaaatcaggcaaaaacaaggctgaattttcggtcatgatctgataattgatcttttcattgccgcgcagagtcatttcatagtcggtaccacagattaccagccgcaattgatggccctttaacagtcgatggaaaacaggctgcagcggtaaggtgagatccacgaactcatttggatagagcggctccgtgatggccggatcatgggggttctgcagattgatatgaccataggagatcactttgtaaggcgtaggctcattttgcagcttgaactcgcgcagatcatcatatttccaatgatagcccagcgaaagaccgttacggctcaataaaacaggatcctcggttaggcgcttagccgatccctggtcgatcagaaatacggaaagcaggccatgatcatgatcactagcagctcgcagttttacggttggcgtgccgcgcagcagatagtcgtcagttagcggtgcggtctgatagctgagactaaagcgattctgctcgcctaacagggcctttttccaatgagcgggatgagcacaccaatcctggtagatctcggtctgccattgatagtcggtaaaatcgcgagttggcgttaccaatggctctttttcactcagtttttggtgagcgttgagatagaaattggcactgtgatcctcatgccagttttggtaggcagtccagatttcaggcgtggcattgtcttgaaccagtacggccggcagcagggcatcggcatggttatcgatttcccaaagtttattagaaagccagagattcaccatatcggtaaagtctagcgagcgaaaagcattaatgtagatatgcttgccttgatgcaggatcagcttgctgttggctgcatttttcttcaaaccgtcataaagagctttgacgttgcttggcttaacgttgtcgtcattgagcccatggaccatcataacgctggctttgatttgatcgatctgtttccgataattacgtcgttcccaaaaatcattgtagttgccggtttgacgatccattgccagattcatctgggccagatagcgattattgatctgctcaactcgccgatagtcgccaggccgcttggtacggctaaagcattcagctgccagcgtatcggcatcctcgccttgaaaaccaccggctgctctgaccagaccattttcacgataatagtcataccaactggaaatggcggcctcactgatgatggctttaagtccctttacgccagtcgtggcaacggctgtcgaaagcgttcctagataagagcgtcccgtcattgccacgttgccattgcaccaatcggctttgacagccaggccgctggtacgatcggaaaaagccgttcggtcgccgtgcagccactcaactacagcctgcatcgattcaacctgttctggcgagccgcatgtctgcaggccatcagaatctctggcaccaattccggcacagtagacagaggcgaaaccgcggggagccagatagtcgtttagcgtataggttggtgtctgactaagggtttcagtggcttttgatgatcccttaatcatctgatgacgtggatgggcattaaacgttggctcagcaggcgcaatttgacctggttctttgcgactcaatgcttgattgacattatgggttgcttttacgccccattcatcgttggttccttggttgtatggactggcggtaaagacggcagggacttttaacccttgattggattcagcgggccgcatgatctcgacttttaccaaatcggcttgatcgtcaaaatcggtatcgacgtcggtttcaacataaacgacctcatagatgaaatcgtgcggatcaaaaacggcgagcgacttgccattaaaaaagattggcttttggtcagcaggcagttcgtgagcccatttcagcaagccttgagccgtcagcgcatccagcagggtttgaccatttttggtatgagtgttcaaaaggtcatagaacgccgcaatcacgtctgcggtcgtccattgttcaaaatgatggtgcaaaagctgcatctgatccatcgccgccaatggatcagtaattgaaaagtcaattgccggttcaaattctaacagctgcaggtcgacaagatagaaaacctggtcattaagcggctgattgcttgccagccagtcagctaggctcagctcaggcgttgccaagacgtcttggcgccaacgcttcaatgccggttcagaagtgcagctgcagttgattctttccaacagcgtctgccacatttgattaggcgtaagcgtgctgctctcgtttgcttttagaagatgaatggtctggagttcatggcattgctgctcaaaaggcagactcatcatggcaaattgattgtttttcattgacaaaacctccccaaatcacgctaagcacttatgcttattaattagtgaatattttataacattctcacgttttctggggtattggacagcataattgccttaatctttattaaaagactggtcataaacgattctaaaaggaactgatcagccattattgacaaaaagagacggttttgcgatcaaatcgcagaatcgtctctttgtcttagttagacgtcaagcttcaagctacccactgctttgacgcgaacttgagcagaaccgcctggtagataggcaagcgggataatttcgatattaatgatttcaacgctggttggatccgcgccagcactgattgcattgctgactgcctcgtttttggctttttttagtacttcttctttatctttgccttcaaagctgtagattcggttaacgtcgccactgacttgtcccaaagctgcacccactgcattggctgcatcatagtggtctggacggtacactttgctgatgcccttgatctggtcgtcaaccaaaaaactaccgccaccggtgagaatcaaagggatatcaccgcttttaagcttcatttgatcaagtgagtcggcaacggtctggttgatcgcggctaatacgctgtcagcccattcctcagaaatgtcagcaacctgttctgattgatcatgaaatgcacgattgagtctggcagcattgtcagaggcggtctcaacatctccgccaaagactttcgacttagtgacgatttcatatccgacactgtctggtccaaccgtgaaaccatcatcatttctatggatcacggtaccaccgccaataccaattgaaagaatgtctggcatacggaagttggtttctacgccgccaacctgtgctgaaagggaagattggcgtggaaagctgtttaccaaaacaccgatatcgctggtagtgccaccaacgtcaagtaccagtgcatttttaatgcctgagagatggtaggcaccacgaatgctattggtaggcccgcagccaatggtaaagatcggatatttctgagtaaactcaccagtcatcaaggttccatcattttgactgaaaaaagtttgtgctttgatgccaagttctgctaaggcactttcaaagccatttacgatttgctcgccgattgtcatcaaagcagcatttaagattgacgcgttttctcgttcaagcatgccgatgccgccaatctgatgcgacaaagtaatcttaacgtcattgcctaggtcctctttgatccattgcgcgacttgcagttcttgagcgggatttactggtgaaaaagtccccgcgatggcaatgcttgtttttttatcttttaagttagcacagaatgcatcaacctcatcacgattcagttcggcaattttacggccatcatattcatacccgccggaaatgatagcagctttttcattaacggctgctttcagatcggcaggccattccatataagggggaatgccaactgatgccggcttgccgattcggagataagcgaccttgtccagatccttgcgctcaacgatagcattggtggatttcgtggttccaagcatggcaaaaccaatcttactcttatctacatgactttcagccagtactttagagattgcattgaagataccaccttgtacgtctttggtagtgtgtgccttaaccgtgtagataacgttcagctggtcgtccagaattgcagcatcggtattcgtaccgccaacatcaacgcctaaacgatatgccataagctatttctcctttccctgcagttcttctactggaatatagtcgacatcatagccaaagtagcgtggtcctgccgtttcgatgccaataggagtacgccattgcggatcacaagggaatgacacaaccttaacgcgtgatccgtattgcagacgctctgacgtaatcggaaaggcgctctcaatatccaaggcaacgattagatcaggaaccgaggctaagatctcatcaccctccttggcaaccagtgtttcgttttggaattcgagactgaacgttttccctcgatagttgttgagcccctcgatttgtgcggtaccaaagttaaagccctgcttggtttcgcgcgttacagcagtcactttgccgtcgtatagctcaaaaccgttgagtcgatccaatagcgctttgaagacgtcatcataatcttcttgatgcatcagaatctcgccaatctcacgagccaatgaaagagtaccgtttacgacagatcccttgacgtccttgccagctaaaaagtagtcagagacagatgctgaaccgcccatttgaacggttagggcgcgagacatgtattctgaccaataggcgttgattggcttaagcagggcaacgttgcctttttcatcgccaacggctacttgttcaggatccaggccatggaggtggaaagtttccatctgtgcttcaggaaaggctcggccaattgcatcggcatccagaattggcaagtgcagtttggccgccgcaccgactggataaagtgagttgatgccaccgacttcaattggaatgataacatcagcttttttaccaaatgcgcgttcaagttcttgcagaggggtcgtcagctcaatctcagaaggcagtttctccaatgatacggttggcgctcccattccagatacgggaacgacgtattgatcgtcctgcaactcatcgattgagatcaaatttacgggaccatacttctgaatcatgctcttggcaagcaaacggccaaccttgggatcaccaccaccgccggatcctagtacagaagctccgactgagatgtagtcaatgtcttgttcggttagttctctcatggtttctcaacctccaatgtctcatctttcttattctttgtaaggtagctcagcagcagctgcatgaagaaaccaaccagaattccgtccagtggtggtatctgcgtcagcttaatgatacccaatccagttggcgcgtcagtcgttaaataagtgactacgatgccaactacccatgaagccattgaacgccacacgatcgatttaggctcttcacggttactgatgcgattgaactcttttttgatgaagtagaattcagcaatgtagataccagggaccggtgcgatgaagatacccaaaatattaagaaatggcacgaactggttgtagataccgaataccccgagcaacgtaccgattgtacccagaatcaaaaccagtgtacgaaatttgactttagtaaagatcacattgaatcctagagaagcagagtagaggttactggtgttggtaacccattgtgttaaggagaggacgatgatgcctgggatgcccatgccaatcatgatcagcattttcatcatgtccgtgctgctgagtgatttactcatgaagattgataccaaaatcataaaggagttaccaatgaacatcccgaagaaggttccgataatggagtctttttggctcttagcccaacgtgagatgtctggttgggtagccgcaccgacgataaatgaagagataaccaacgcgattgcagaaccaaatggtaaagtcgcagatgtctgagtttttggcagtccatgtgtccgcagtgcgataaacagcgcaatcagcatcagtatcaagaggaacggtaccgagatttcgcttagtttggaaaaagcccgatatccataaagcgtcgtaccgaccataaaaatacccgcaataattgaaaatacccaagttggccagttgatgccaaacgcgctgataaaagctgttcttgcgttgtctgcaaagaacccgacttgcacgccaaaccagcctaacagtgaaagaccaatcattgctgaatatgcaagcgtgcctttcttgccaaagacatagcgagtaatcattgacgttgacaagttggtagccgcgccgacagaagccgtaatcgtacaaatcgttgccaaaataagcgacccgataattacagcccagattgctttatcaagaggcagtccttttgccagctgcacacctaaaataacggcagccagatcgacgccaattgcgacccaaatggaaaacagtgatatccaggacttttgttgtgactttggaacctgcttcaaagagtagtctgaagcaaagctcttttctttttgcgccataataattccccatcccctccgaatgttaatggatagttaaaatttaattaaaaattatataatcagtttaataaaatcgacagatattaaatgaatatttttacttgattagataatatatatactattagttgcttggaataagaaattttaaacgttttttgaatatttaaatcttttaatttaaaattgattcattttataaagccctagatgatgggaaaaatctctgttatttattaataaataagggaggggagacggctctatgacttgagcaacaggcaactagaaaaaagcaaaacagccccatcacggaagatttccgcaatgaggccataaatcatataggggtacaggaccttgcagttattttggggattgtcattcatacttatggaagcatagaagggatggtttaaatctcaattcttagtatctatcattataatcatcatcataatcgtcatgatgatggtgtgataattgatctgcagtataaatgtcccatagcgtatcagatacatcatcatgatcgtccatctcctcatcttgataaggggctggcggcaatccttcttctttacgtttcttattcatctcatcaacgttatggctgtcaagatctgcgccggtgatccattcaaagaaccaaaaaataagaataattaccagaaacataaaaaagatggcaaagacaatcgaccataactccatagcagtgataaagatgacagcgatgaacgccgtaattgcccagcgccgatgcaaaatttttttcttttcatcattgctaatcaccagcactgcctccttacttataaaatttgaatttaaccaaattatatctcatttcattaggaggagttggcagaattatgtgcaaatgttcattaatgatatccgtgaacgtcccatttgtcgttttgcaagttgaaaaatcaaggaaatacacggcatctataaaggttactgtttgtgattttttatacaaattaatcgatcaagcgctttctttagtgataagataaaattgttacatatttggtttgtaaatttggaggtaatgatatgactgaagaaaaacgcgttgctgtcgttactggtggagaccgtgggattggccgcggtattacggatcagctgcttaaggacggttattatgtcgtaatcgccaaccgtaatgaagaagccggcaagaaagccgttgaagaactgaacgctcaagggtacgaaggcaaggtcgtatctgtagccggcgatgcatccaagaaggaaagtcacgaacacttcgttaaggctgccgttgacaacttcggccgtttggacacatacgtaaacaatgccggaattgctcagatcaaactgctcaaggatgaaaccgaagctgacatggatgagattttccacgtcaatgtttactcagtactgttcgggatgcaggccgctgctgctcaattccgcaagcaggacgatggcgacaagattcgcaagattatcaacgcttccagtatcgccggtcacattgcctttgacatgctgggtgcctactctgcatccaagtttgccattcgtggcttgacgcaggctgctgctaaggaacttggtcgtgagcacatcacggtcaacgcctactgcccaggtatcgttggcactgacatgtgggactacatcgatgaaaagatggttgaagcatggggtggcaacaagggcgattaccttaagaagtactctggcgccatcacgctggggcgggttgaaacgcctgctgacgtggccaactatgtatcctggctggcatcaaccaagtccgactacatgactggtcaagccgttcaaatcgatggcgggattcaattcatctaattgctgccatttcaaactgaatatctagagtaaaggtcgcgatcctcactgggtcacggctttttgcgtactcaaaaagcgcgtcatgtaagctgacgcgctgattaaagactattgattctgattcagatagtcggtttcacttcttaactggctaacatagccgttaacctcatctttttgactttgggtgacatagtagtctttttccagattggcgagggaaacggtcttggtttcaaaatgaccatccgctacactgtcagagtcgcttgatacccacatcttgtaggtaacggtatcgccatcaaccttgtagtaaagaaaactggttggattgccgtttgcggtaaggtagctgtagtcggcaaccgcgtcactgattggattcttgccggctggactgtagcagaagaaatcattgccaatatattctttaaaccagtcaggctcaaccaagagtgccagcatgacaccggtcgttttatcatctactttggctgttttggcagtactggaaactgtggtggaactgtctgagctactactcgctttttgaatctggctgtcagactgactgaactttttggatgatgatgacttggcggtgctgctttgggctgccgtactgcttgattctttactggatgacgattgactgccgcacgcggtcagcaggaagcatgacactaaggcggaggtgataacaatggattttttcaattctcttctctccctaaaataaaattcttaccgaaaaattattcatttataatcagcttttataggataactcatcttgaatgaaaagttataaaaataataaaaacttttaaaaacataaatcaacactaaaataatcagtcagcggatgatttgccaaaccagcatgttccacgtgaaacctaatctaattaatttgctctgaaaggcgacagataagtatctttcggcgtataattgagtttgctgtaatcgtgaaaaattcgcggaaataaaagatgaaaaggagaacatcgtgaccaatcaagtaattgaatttcggcatgtcagtaagcagtatgatgataaccttgtgctgcgcgacatcaactttacgattgaggccggtaagttctacacgctgctaggcccttcaggatcaggaaagactacgatcctgcgaattattgctggttttgacgatgctaccagtggcgacgttatttttgacggccagcgaatcaatgatattcctgctaatcaacgacaagtaaacacggtctttcaagactatgcgctttttccacatatgaacgttgctgaaaacgtagcgtttggcttaaaaatcaagcgaatccccaaagaagagattgccaagcgggtacaggatgctttgcatatggtgcagctggacggctatggcgagcgtgaaatcacagaaatgtctggtggtcagcggcagcgggttgcaattgctcgcgcgatcgtcaatcgtcctaaagtgctgctgttggatgaggcgctctctgcccttgaccataagctacgagtggagatgcaggctgaactgcgggctttgcagcgccgcttgggaatcacctttatctttgtcacgcatgaccaaggtgaagcactggcaatgagcgaccagatctttattatcaatgatggtatgattcagcagagcggtacgccggttgatatctacgatgagccgttgaatcattttgtggctgattttattggcgagagcaacattgtccctgggattatgaaaaaagactttttggtcaatatcaatggtcatgatttcgaatgcgttgatgccggcatgaagccaaatgaaaaggtcgaagccgtcttgcgccccgaggatctggatattacgaccgttgatcagggaaagctggttgcaacggtcgatacgcagctattccggggtgttgactatcagatcatggttcatgacgaggaaggacacgaatggaagatcaattcgattcataaaacgaaagtgggtgaaaaagtcggcatcacgtttgatcccgaagacatccacatcatgcgctatcatgaaaccgaagcggcctttgatgcacggttggacagttacgaaggtgatgatgaggaggatgaacgttgaaacagcaaaaaatctggtttgtcgttccctatgcattgtggattgtactgtttgtcgtggcgccgttggtcttgattctttatcaatccttttttaacatcaacggccagttcacgtttggcaactatcagagctacttgacctctaatgtttatttaaggatgacgttcaattcggtctggtacgcgtttttgatcacgctgatcacgcttttgatcagctatccggcagcgtatgtgatcaaccggctaccgaatcgtcagttttggctgctgctggtcattttgccaacttggatcaacctgcttttgaagacctatgcctttatcggactgtttagtcaaaacggttcgatcaatcagtttttgcggtttgtcggtctgggtagccaccagattctgtttactgatgccagctttatttttgtcgcagcctacattgagatcccgtttatgattctgccaatctttaactcactggccgagatcgattcttcgttgatcaatgccagtcgtgacctgggcgccagctcttggcagacgtttatgcacgttgagctgccattgacgatgcctggggttaaggccggggtacaggcagtctttattccatcgctttccttgttcatgattacgcgtctgattggcggcaatcgtgtaattactctagggacggcaattgaagagcatttcttgacaacgcagaactggggcatgggttcaacgatcggtgtggtattgatcattgccatgttcatcgtgatgtttgcaactggtgatcggcaaaagaaaaaggggggtcgtgctaaatgaagcataaaatcaactggggcgcgatctatttagtaatcgtttttattattttatatttgccgattctttatctggttggcttttcattcagttctggcaaaacgatggaaaagtatcaaggcttttcatggacgcactatcagacgctgttgcaagatacgcgaatgattaccattgtgatcaatacgctgatcgttgccttgctgtcagcgcttttggcgacgattatcggaacgatgggggcgctggcgattaagcgaaccaagaatgtcatgcggaacaccctgctttcgtttaataatgttttgatggtttcaccagacgttattattggggccagtttcttgattctgtttacggtgattggcatgaagcttggtttttggtccgttttgctcagccatattgctttttcgattccgattgtggttttgatggttctgcccaaaatcgatgaactttcgcccactctgctggatgcagccgcggatctaggggccagtccatggcagtcattgacgcgagtaatgctgccggcgattgctccagggatcatgtcgggatactttatggcctttacctactcactggacgactttgcggtaactttttttgtaactggcaatggtttttcgacgctgtcagttgaaatctattccagggcgcgacaaggcattgacttggagatcaacgcgctttcgactttgatgttcttggtatcattggcgctggtaatcggctactactttatcagcaagcatggcagcagccgcaaaaatcagatcgtaacggttaaagaaggtgatgtccaatgaaaaaactgctgagctttgccattggcatcctgctgctgtgcggtgtgctgtttgggtgcaataagctgctaaaccaaaaagcaaacgatggcggcaataaaaccttgacgatctataactggggcgactacattgatccccagctgattaccaagttcgagcatgagaccggctatcatgtcgattatgagacttttgacagcaatgaggcgatgctgaccaagattcgccagggcggtacgcattatgatattgccgttccaagtgaatacaccattcagcgaatgaaaaaagagcatctgttagagccgattgatcatcgcaagctgccgaacctcaaatatatcgatccgcagtttttaaatctgtcgttcgatcggcataatcgctattcaattccatatttctgggggacgttggggatagtctataatgatcaaaaggtgagtcgtaaagatgtctcgcattggcgccagctttggttacctaagctcaaaaacaatatcatgatgatcgacagtgcccgtgatgcgatggcagtggcactgatcactcagcatcattccgtcaacacgaccaacgccaaggaattacgtgaagccgctgataagcttgatcagctgacgcccaacatcaaggccgtaattgccgatgaaatgaagatgtacatggaacaaaacgaagcggcagtcggcattacctattctggggaagccagtgaaatgatcagtgtcaattcacatctccactacctcgtaccaagcgagggcagcaacatctggtttgacaacatggtgattcccaaaacggctaaaaacaaaaaagcagcctatgcattcttgaatttcatgctggatcccaagaatgccgcgcaaaatgctgaatatatcggctatgcaacgccaaataaggctgccaaaaagtatctgccaaagagcgttaccagcaaccaggctttctatccgccaaaacaaacaatgaagcatctgcaggtttatcatgacttgccattaaaagacattggcacctataatgacctgttcttggaatttaagatgtttaaaaagtaactaaaaagctgaccgaaaaatttcgatcagcttttttgattgacgtttattattcagtggccagcttgctatgacgatagccgtagccaaagtaaagtgccaaaccaattaagaaccagatgccggccccaatccaagtatcaagggaaagaaacgacatcatgaacaggcaggcacagccagaaatgattggcaaaacggggaaccaaggaacgcggaagccgccttggttgccgatgtccttgcgcttacgcaatggaatgatcccaaatgaaaccagcgtaaatgccagcaatgtaccgatattaaccagatcagtcagccgatccagggaaaccagcccccccatgacggcgataatcgctgcgacgatccaaagtgagatcttcggcgtgctggtcttagcatccagcttgttcaaaaatgatggcaagagaccgtcacgactgatagagtagatcaaacgggatgaagagtagatcatggtaaacatcatggttgccatcccaatcagtgccccaattgaaagcagggcagccagccagtcttggtgaacggcctgcagcgcaaaggcaaccggattggcaacgtcaagcttggtatacttaaccatacccgtcaagacgattgaaacgcccatgtaaagcacggcagcgaccaaaagtgtcccgataattccgattggcatgttcttttgcggattcttgacttcggcagctgagcttgagatacagtcaaagcccaaaaaggcaaagaagactgtcgttgcccccttgaagaccccatgcataccatatggaaggaatggctggtagttggctttcttgatgaagaaggccccaacaacgatgaaggcaacgatgattgcaatcttgatcgcgatggcaatgttgttgacccgaaccgatgaagtcattccaaatgaaagcatccaggtaatcagtaaaacgatgatgattgctacaatgttgacataggtgccatgtgcaggatcaaaaggaccagacagtactttggggatgttgattccacagctggccagcagtgaattgaagtaggctgcccagccagttgaaactgaggcgactgccagcatgtattccaataccagcgcccagcccatgatccaaccgataaattcaccgtagaccacgttaccataagaataggcgctaccggcaaccggcatggcagaagaaaactcagcatagcacattcccgctaaagcacagacaaccgctgccgccagaaacgacagtgagacgccaggccctgcatcgttggctgccacggtcccaggtaaaataaagatccctgtcccaatgaccgcaccgatccccatggccatcaaatcgccagccgacagcgacttgacgaatttgttatcggctttgagatagcgtgagaggctttctttacgaaaaagatttaaactcatccgaccttaaccacctttgttataatatccaatagcttaataaatttaagtgatagcttatcataggcaaagataatgagcaataattgcgaaataatcattggatttaccgaacaaaataagccataatgacagtaataatcataatgtcataatcattaaaagtcaattagaaaagcattaaggaggagcttggaaatggcgattgaaaagactgcaggtgccgtagtttatcgaaataacgatcaagaaattgaatacctgctgctgcaaagcacaaacgaaggtaatttttggggcttccccaaaggtcacgttgagggcgatgaaacgctcctagaaacggcgcagcgtgagattaaagaagaaaccagtctggtcctgccaattgataccagcttttctgtctacactgaatacgacctgcccaacggcaaccggaagcaaatgacgctttacacggctgcactgcctaaggatgaggatctgcatctgcaggctgaagaaattaagaatgccggttggttcaactatcaagatgctcgccaacgcttaacctatgacaacttaaaagaattgctggatcaggttaatgctcatttaacacaggcatgatggatcagcagcataaggtttttgtaattactggcgcggcgggaaccggtaaaacgacggtggccaactatctaagaaaaaaatacgatatggccaaggtaattacgcatacgacacgcttgccgcgagccaatgaaaaagatggcgtcgactattattttgagacgcgttcctcaatgcaaaagcggcatttattagaacaggttgaatatgatcatcatctatatggctcttcaattgaggggctggaaaacggctggcggcatcatcaatttgacgtgatcgttttggataccaaaggagcgctgacgtaccgagccaagttgggtgatcaggccgtcgtaatctttttgacggtcagtcatccgcagcagctttttgagcgtctgcatatcagaggcgatcacccagatgcaattgagtcgcggatcaacagctgcgaatatcaacgtgatctgtcgctgccgcaagaattgaaaggtcaggcaattgagcttgtcaatgatgattgggcaatgacgcagcaaaaactggatcaattgctcagccgatacatttgaagataaatgtgctaaaatcataatttcaaaaaggacggatgaaaaaatgacggatcctaaagcacaagccatggcagtcttgcagaaaaatcatctgcgcgtcaccaagcagcgaaaaatgctgattgatttattggttgccaatccagatcgctatgtcagtgttactgaggttgacaagcatatgcgccaggcatttcctggtgccagccataacacggtctatcgcaatctggaagagtttcaagagatcggtctggttgaattgagttcgcagtctggcggcatggtggttaagtatcgctgtgacgaatcgcatcaccatcactttatctgtcagcgctgcggtcgggtgcaggagattcagctgccaacgattgattgggactttttgactcagcagctgcctggcgccgagattacgggacatagctttgagctgtatggattatgtgctcagtgtcgtcagctggcttcgcattaaattcatcaattcttatttttttcgcaaactctcactggcaatttttgcgctaagatagagagcagacgacaaaaggagagaaaaaagcaatgaaaacaccaccgtttgtgacgccatttgcgctggtttcattggttttggcgttaggtgctaccaacgtggtggtcaacaaagccaccaataccagtgaaggggctaaaatcgtcagcacttcatcgactagtcagagcaccagtcaaaaagatgatcaagacagcagtcatagcagtgatcgcaaaaagccaagcagtgaaagcgatccggatgtgcaaagcagtcatcagaccagcagtgttgatgaggagtcaacgactaagacctcatcagctaaaacgaccgacaatactacggataatggtacgactgctggtaccggcactaccagctcatcggccaataccaccagtcagactaccggcacaacgactgataactcgactggtaccaactcgacgactggcacgacgacaaccacgactgacaccaatcaataagggggatcgcgacagtgcttagttttctagacatgatcaatcattggctaggatattttaatatcaatgccaagctgaaaaatcgaatctacattatcattgcctttttgggtgatctgtacctgatctacgttaccacgcgccttttgatcaaccatgcatgggtgcgggggctgctatactgcctcgccgtgattctgatcacctattgtctgtacatcaacgcggtctactactatctagaccgcaactcacggtttgactttttgtcgccttggctttcaaagattaccggggtcgttcccactgctgaggatgccaagccaaaacgcaatgctcgcgtcatcaacaatgcgtcaaatggctactttactcatcagaatatcattccagcccaagtggaggttgatgagcacgagcagcataatctgcagcgcgtcgttcaagaactgctggatgacgggatctttactgcggattatgatggcttaagcgacagtcagatcgtagcagaaactgcaacgggtgagccggtctatgcgcttgactcgcaacagacgccgccttattttgagctctaccatgacaagcatctgcggcgaattgagatatacatgggcttgaatcaaatggaaaaactggcggtcggtcatattgccaaggtcggtttgacggacattcatactgcccacgagcaatacgagctctatttagccaatctgttcgtgacgggtggaccgcataagattgccggtcgcaatggctcaacgatcttaatggatggtcagtatggcctggttgccaacgttgcctatcgcgatcgagaaaaacgctaaaagcaaaagctgttgattagtttatgctaaccaacagctttttgatgcattgatgattttgggctattcgttgatccagtccaaaatcttaaacatggtcgcggtattttctttaggcacgggatgagcaatgatttcagccggggtctgattaagaattgatcctgctgtatagtcaccatcattgactacgatctcgcggacgttatcggccagtggctcaaagtgaaactgcagcccaacaacgcgatggccataaacaaagccctgttcttttaagccggctgatgagtagagcagctgagcgccattgggaatggtaaacatctgctgatgccagtgcagaacggtagatgccttaggcaggtcaggaattacatcgctctttaagaagacgggagcccagccaacttctttaacgggcgcgtctttaaccgtggcgcccaaagtcattgccagctgctgtccgccaaagcaggcgccaaacattggcttgtcctgggccagcagttctttgatcaattgccgctcttttgcaatccagggcagatcatcgttaggactcatcggaccgcctaagatgaccagcatgtcggtttcatcagccgtgggcagcttgttgaactgggccggatgatagacgtagatctcgtggccgcgctggtgagcccattcactgattacgccagggccttcgttgggggtgtgctgcaaaacgttgattctcattaatcgatcaactccttgttttagaacttattctatagcaaaaccgacagcctgtcttgctggctgccggtttttgatatcagatttgattaaaattcaattgtgtaaacgatgcggtggtgagctggcttgccaggacgcagggtgatatcgccgaattctggatggtgaggcgtgtcagaaagcgtttgggcttccattgccagcgcacaccatgaggcacttggccggttgaattggagcgacttatccattccattggcagtgtacattaccaggccgttgcgatctgagtacagcttcatcttgcggccgctggcagggtcagacagcgtggcaactggttcgtggttgacgttcgtgcttggttcaacctgccagatgtcatcaaaaccgccttctttagtactcttcatttcattgagcgcatcgcccaaacgacgaggagtctggaaatcaaatggcgtgccggcgtttacgagctttttgccagttggaatcttttcatcgtcaacgtctaagtggaacttggagttaacctgtaatacttgatcttcaacggttgccacgtcagaatcgccaaggttgaagtaggtgtgaacggttgggttgaacagcgtgttggcatccgtttcgccatccagatcgattacgacacggttgtcattgctcagtgagtaggtaaccgtaactttctcattgcctgggaaagagtcgatttcaggcgtcatggtcttggttaagacaactttaacggtatttggcgtcgtaacggtttcggcttcaaagaactggttgcctaaaccattcggaccaccatgaagcgtattaccgttttcattagtgtcgacgtgatactcctgaccatcgatcgtaaactcgcccttagccagccgtccggcaacacggccaatcactcggttgttgcacatgccgttgtcagtaaagtgctcaatgtcggctgcgcttaaaaccaggttgacgcgcttgccgtctttgcctggaaccgagatttcctgtaacagaccggcatagtttaaaacgctgacctgcatgtcctgatcgttgataagcgtgtattttttgacttcttgtccttcaaaagtaccgaaactgctttctttaatttccataattaaatccacctcttaaaaagcaaacgttttcataaaaagattgtaccatattacgctagtttgtgattaaaaataccaaaaataagacaaatcaagaaaacatattaattgaactgtcttttaaaagaactataatactaagaaagatgttttgtatcataaagcaacgttttataatctaagtataatctcaaaatagaaaggccgattttaatgaaaatgaatcgaacagttcgagatttccaaaatgctctggaaagcttattaaagactcaccagtttggacatttgacaatcgatcaaatttgtaatgaggcactgttgcatcgaagcagcttttatcgttactttcatgataagtatgatctgctggaacagacgatcagtacgcgcttgaacatcttgattgatcagtcagatcgcaatgaggatgaatttgttgaaatcttgatcaagtatgtcagcgacaatcgtgacatcttccgcaatctagctgatagcagctcgcaaagctctttgtacggcgagattatgaagatcgtcagtgagattctgctgcggcagcgtcatgatcctgaaaatcaggacacgatcgttacggctttgcgaaactcaaagaacccagaaatgctggcttatattttgagtggttcgattctgagggccttttattggtggcggcaaaataactatgaggttccacagcaagacgtcattgattttgttaagcagtcaatgcacaatctttcggatcgattggaacacgatggtttaaactaaatgtttcaagaaaaaaatctgacatcgatgcagtcgatgccagatttttttaatttttaatgacgtagcgttcaaagcgggcaaaatcttgcggtgacatctcgactttgagccgcgtaccgttgttgagatattcagtctctaagatattgcagttttcattgatgtaggaaaccgttcgtccatcggcaaatggaatcagcagctcggtctgtacgtagtctttgaaaagatgacaacgcaaggcctggaccaagagctgaatggattcatcatccttggctgagataataatccggttatcgccttccatgactggatattcaaactcggtctggtcagctttattaaagacatacagcattggaatgttttcaatgccaatctgtttgagcgtcttttcggtcgtgcgcatcatagcttcatagttagggtcagaatagtcgattacctgaattaaaagatcagcactggcagcttctgccaaggttgatttaaaggcttcgatcagatgagtaggcaatttgctgacaaaaccaaccgtatcactgagcaaaaagcgtttttgatcgggcagcgttaattggcgcacgctggtatccagagtggcaaaaagcatgttcttttcaaaaacctgcttttcttcagaaaccccgaaacgactgaccagctgattcataatggtcgatttgccggcattggtatagccaaccaaggcagctgttggcgtatcgcttttttctcgcttagcccgtttaacgtcctcagatttggcgatttctttgagttcagcccgcaaatgactgattttatggttgatggtccgccgattcatttccagcttggtttcaccggcaccacggttggtaaagccagatccgccaccagtctgctggtcaagccgctgattggcagccgtctgcagacgcggcaattggtactgaagctgggcaatctcgacttgaatcttggcttcacgactttgcgcgcgcttggcaaagatttccagaatcaaggcagtccggtccaaaatccggacaccggtttgatcagctaggttctgcagttgacttggcgtcagctcgtcattggcgattaccgtagcgacttcttcagcctcggccaggtgacgcagctcttctactttaccggagccaaagtaggtcgctggattaggccgatccaaggcttggtctaaacgatcaatgacttccatttggttggcttcggccagggctgccaattcttccatggaatactcataatcttcctggtccatgttaaggccaatgataattactggttccgcactttgtatattagtgtccattaacagaaagttcccccttttagcaaggttttattcaggcaagctcagttgattgtaaaagacgatctcggtttgatctggggtcaaggaaagttttgtgatactgccattgacgggggcatcgttggccagggtcttgtctttggcatagcggctgacgattgagcgaatggctgcaccatgagaaacaacgacggcggtactgccatcgggaagattgcgcagccggtccaaacctttgtccatgcgctgccagaattcagcatcgttttcagccagatggaatgggtcagcagctttggtgatatcgcgcgccttttcaacagaatacttgctgaccagctcgtcataggaacggcaaagaccaatgttcatggaagccgcagccgtgtcctcgccttcaaaaaagccgaaaaagacttcccgaaaggctggatctggctctggatgaacgatcttggtaggatggctggctgccagcagttctgcggttttaactgtccgtcgcatatcgctgcagaaaagatagtcaaagtcgatcttggccaaagccttgcccacgcgcttgccgtcttcaatacctttttcggtcagcggtgcatctgaccagccttgatatttgtggaacaggttcaagtaggtctgaccgtgtcgaacgaaataaacatttactgccaagggaaaaaacctccattattctgtacgttgtttagtattcagtttaccattattccacggtaaattgtacgaaattgcgttagaggttgcgttcaataatatgccggcggatccgtttaatgagattgaaaaagacggctggcaaagatccgcagatgaccagacccagcagcagcgttgaaaaatgggcctgtacaaatggaatgctgccaagataatatcccgccagcgcgccggagactacccagatggccacgcccaagacattgccaagcataaagcggccaaagcggtatttggcgatgccggaaatcagcgggacaaaggtgcggatcagcgggacgaaacgcccaaagatgatcgcacgcaaaccatatctgctgaaaaacagctgggctttcgccatagtcggaccagccagccgccgcttgagccagggccatttgatcaagcgggtaccgatcagatagttaagcgtgtcgcccagcacggccgcgataaaaaagccgggtactaaaatgctcatcttgacctcggcaccgtgcaaagcagcaaacgaagacgtgacaaaaatcagcgactgtcccggcagccaaggaaaaacaaccagaccagtctccataaagatcaggctaaataatatgacgtaggtccagctgcccagtgaattgaacaaagggaggaccacttgaggaatatgcgtcaaagcatacaagagcttagccattgcttccaccttcaaatcagcttttgagatcattctagtattttgtgaccatctaaaccagactgatggcgataagttaagcaaaccttatgcagacaagtcttaataacggaatcgcggcgcaaaaaatgttataattctacgattagattttcaagacaggaaggatgttcgagtttgacagaatcaatccaacaatacgaacagcatcatttggagcaggtcgttaaagaagttcgcaaggctgaggaaaaagccagcggcacgattgaaaacgccaaacgggatgtgaagggcctgagcaagcagttcaatgatatccacatgaataccacgacttattcggggatgatggatacggccatgtcggttcacgcccagcagcagatgcttgatgaacgagaaaacagctggcagcatgccgccgatcgtttgagtacgctgaaacgcttggaagccaaaccgtattttgcccgtatcgattttttggaaaaaggtgcgcaaaaacctgaaaccatttatattggcctggcctcgttctctgatcgtccggaccactttctggtatatgactggcgggcaccgatctcttcaatctattatgatggcaagctgggaccggtcacttatgaaacccccgttggcaagcaggaggtcgatgtcagactcaagcgccagttccagatcgaggatggcacgatcgtcacgctttatgataccgatgaggccgtaaccgatcagatgctgctgagtgccttgggaacccattccagcaccaagatgaagagtatcgtaacgacgattcaaaaaacgcaaaacgaaatcattcgggatgtcaaagatgaattgctgtttgttcaaggagcggctggttctggtaagacggctgccgttttacagcgcgtggcttggttgctgtatcgttatcgcggcaatctaacggccagccaggtggttttgttcagccccaaccaactgttcaacgactatattgatcaggtgctgccagaactgggcgagcacaatatggttcaaatgacctacttccaatacgttaatcggcgggtgccaagactgcacgttcagacgctccagcagcgctttgaaagcagtcaggcaacagtcgatcaaaacatcaatcgcttattgacgagcttaagcagctttaaagcagttggtgcctatgccagggcgcttggtcagcggggcctgcgctttcggaatctgatgtttcatggcaagccgttttttaccaaggaacaaatcaagacgatctattactcattcaatcgcaactataacctgggcaatcgtctggatgcgaccaaagatgcgctggatcatcggctgagaagccgagttggcggggccatgcgctcaaaatgggcagaagcagccgtccaaagcctcagcaaagagcagatggacgcgatgatgaacaatcggccgcgcgagtttgaatcagacaagcaggaatacaacttctatgccaagcagatcgttttaaaggagttcgcgccgattcatcgagcaattcgtcataacatgtggatcaacatcaatgcacagtatctgctgtttttaaaggccttgccaaagatggttgatctgcagaagtttgatttgaccgagcagcagtgggtggcatttatcgaaaaaaccacgcaggatctgaaagagcggcagatcagtgctgccggcatctcaatctatctctacctgtacgatctgctgacgggtaagtgcggcgaacgtgatattcgctatgtctttgtcgatgaggttcaagactatgacgccttccaactggcctatcttaagttcagtttccccaatgcccgctttacgctgctgggagaccttaaccaggcaatctttacgggcgccaacagtcggcaattgctgcggcagttgggtacgatgtttgatcccgaaaagacgaaagtagtacagctgaccaagtcatatcgctcaactaaacagattaccgattttaccaagcatattctcaaagatggcgaaaaaatcgaggcctttgagcgtcaaggcaagcggccaagcatctaccagctgacaaatctaaacgatgccgtcgcacaggtcgtcgcggttctaaaagactatcaagaacagcatgatgcagttgccattatcggcaagaccttggctgacagtgagcagatctatcagctgctggctgagcagggcgttaaggcaaccttgatccgcactgaaaatcagcggctggttgatggtgtgctggtcgtaccttcatacctggcaaaagggcttgagtttgacgcggtaatcgtctgggatgccaacgaccgaaagtatcatggcgacagtgagcggcagctgctttacacgatctgttcacgggcgatgcatgatttgacgatcgtcagcgtggggcaggccagtcagctgtttgccgatgtgccgagtcatgagtatgaactgacggatcgtttatcataaaatcttcaaatttaatgatgatcaggcaggcttgtaaacaccaatcagttaagtcggctgcagtcaatcaagctgagatgcaaaaaaattccaaacatttgttaaaaaacgttgaataatcgtaacgactagggatcttttattgtatgatacctaatgttgatattttttgatggaggaaagattatgaaaacagcgttgcagaaggtaaggcgtggcttgaacaccaagctgggcttctttcttctcacggtgctcttgtttgcgattaagagttactgggcttataaaaccaagttcaacttggggatttccgacagtatgcagcagtttttgctggcgtttaacaccttgcctggggctctggtctttttaggcatcgcgctttatttccgcggtcggctttcatactggctaacgatcctgattaattttctgctttcgacctggctgtttgccaatattctctattaccgagaattttccgactttattacctttaacatcatcaaaggttctggagcggcatcaaacaacctgggcaagagtctgatgggtatcatcaagccaactgactttttagtttacattgatgttgttatcttaataatcttgttggcaacgcactttatacggattgatatgcgctacttcaaggtccgctatgcaatgacgattactgcgattggctttgtgctgtttggcgctaacctggccatggcagaaaaggatcgtccgcagctgttgacgcggacgtttgacaacaactacatcgttaaatacttgggactgcaggcttatacgatctatgatggcgtcaagaccacccataacagtgcggttaaagctaaggccgacagcaacgacatcaagccggtcctaaagttcttaaagaaaaactatgcttcgccaaatattgaatattatggtcaggcaaaaggcaaaaacatcatcatcatccacttggaaagcttccaacagtttatgatcgattacaagtggaaaggcgaagaagttacgccaaacttaaacaagctttaccatgccagcgatacgatttcgtttgacaacttcttcaatcaggttggccaaggaaagacggccgatgcggaattgatgctggaaaattcgctgtatggtctgccagaaggttcggccatggttaccgacgggacgaccaacacgttccagtcagcaccggctctgttagaacaaaagcttggctataccacggcctcattccatggtgacgtacctagtttttggaaccgtgacaatgcctacaagagctttggctaccagtacttctttagtaaggactacctgccaaaagttaaggatgagaatatgggctatggtatcaaggataagctgttcttaaaagaatctgcctattatcttgaacagctgccacagccattctatgctaagctgattacggtgacgaaccactatccttacatcattgacaagaaaaatacatcgatcaagtcatggaatactggtgacagtacggttgatcattatgttcagactgcgcgctacctggatgaatcagttggcgaactgctcaactacttggattcaaccggcctgcgcaagaatacgatgttggtattgtatggtgaccattatgggatctccaacaaccacaagcctgccattgctcagattctgggcaagaagtcagttgacaactatgatctggcaatgttccaaaaagtaccgtttatgatcaacatggaaggcttaaagggtggcgtcaaccatacctatggcggtgaaatcgacgttctgccaaccattgaggatcttttgggcatcagttccaataagtacgttcagtttggtcaggacctgctttctaagaaccgcaaccagatcgtgccattcagaaatggtgactgggtaaccaataagtacaccaagtacaatggggattactactacaccagcagcggcaaagcaatcaagtcgccaaccaaggcccagaaagccgagtttgccaagattcaaaagtatgtcacgactgatcttggtctgtcggataaagtcgtcaatggcgatctgctgcgtttctacaaactgaaaggcttcaagacaaccgataagaagagctactcgtacacgctgaagaatggcttgaaacagcttaaacaggcgcaaaagaagagcaagaccagcttgaagagtcaaaacaacgaccaatcaacgctggatcaatatacgaccgatgcacctgaattaaagggtgtcacgctgaagttcccaactaaataaccaaaagctcagccgtttaagcgactgagcatttttcagcatggctgatatgctggtaaagcgatggttgcagcagaacagatcattgttataagtacgatgctccatcaaacggctgctgttggaaccagggtcgcactgtaatattagctataccgtgccagacgcgaaaagattacgatttattttgcatttgcgaacgttttcacacgtggcaagcgattgtgataaaattagaaaagaaaattgacaaaaaggatttaaagaacatggatgaatggttgaattatgatcgctttgatcgtgaaacctggcatagttttttcccccatggcaaaactttcttaacccaggaaaatcttgaggatattaagtcgcttaatgaccagatctcgctggcggatgtacgtgaggtctacttgcctttgattaagctgatccagctgcagtatcaaaattacttgcagatgcagctgcagaagatgacttttttgcgtaagccaatgcgccgaattccttacattatcggcattgccggatcagttgcggtgggcaagagcacttccgcgcgcctgctgcagattctgctaaagcgtctgatgccggataagcgagttgagctgatcacgactgatggttttatctatcccaatcgtgagctggaaaaacgaggcatcatggcccgcaaaggatttccggaaagctatgatatggaaaagctgctgacgtttttaaatgacgtcaacgccggtgaagactgcgttaaagcaccggtttattcacatagcgtctacgatatcattcctgatgagtatcagacgattgaaaaaccggacgtgctgattgtcgaagggatcaatgtcttgcagctgcccactacgcagcggatctacgtcagcgacttttttgacttctcaatctacattgatgctgagcctgagctgattgaacagtggtatctggaacgatttggcatgcttttggacacggcctttcaagatccaagcaactactactatccttataccaagggcagccgcagtcaggcttttgcggatgcacgcaaggtttggaatacggtcaatctgcctaatctccgcgattatattctgccgacgcgcaatcgggccgatgtgattctgcataaggccgaaaatcaccatattgatcggatttatctacgagaagactaagaacgttatccaggtcatgatggcaagtgtcagcagtattgcttagtgatattgctgacaaagctttctggcggggactagcaatggctttttgcaagcttggcaatgtgagatggctaaggtaagctgcgccagtcttatctcaagctggtaatcttacaattgatcaggcagtaaaactactgatcactattgattaaataggtacaatacggcaattgacccggaccaagggcggaagtgcaatcgacaatggcttttatagcattggtcagccggtcttgtgaagaaaatagtcccctaagctgttatggggcttgaaattacctactatttcttggtttttcgcgaaaagtaggtagctgcatacgcgattcacttgactttacctacttatgacgtcttttgtcaaaatagtaggtaaagatgcatatttaaggtgagattgggccagaccgaatttgtgaattacctactgttgagcgatttttatcaaatagtaggtaatgttaggacgccctaactcgatatacattgatttttacctactatacagcggtttttcaaaaaaagtaggtaatgatatttttgtcatatatattatgcagaatcttttgcataattgggtccaatcaatgcttagcaacgacttttatgctcatcgtcagctgaatctacaagaaaaagcgctccaacaagcctgcttgctggggcgctttattttggtcgggtattttgcgttgccgtgactggttatcaagatcgtggctgtagtagtctattgtgttttggtcaatgcttttgcgatgtcgcgactggattgcttaagacctttaaagctggcagtaaagtaaatgttgccgtctttccaatcaacgcttaggctgcctttgaagtttttgaccaggttttgggcgattgaaagaccaatcccaaacccagatcttttttcattgttatgcgaggtgtcattacggtagaatcgctcaaagaacttattgtagtcaacgtttttgccctctgcataactgttgccgactttgagcaacacgtttttaccatgtttgtcggcactgacgtcaacgaagatcgtaccattagggtcacagtatttattggcattatccaatagaatgctgatcagctcgtagtagtaattgggatcagctttaagcttgaggccaggctgcagttgatatttaagctgatgattggactgagcgataacggccttgaagttgtcgatggctttttgcacttcagtcgctggatcaatttcctgcaactgaagttcggggcgctcatccagcttggctaatgagatcatcagattgatcaggtgcgtcagtcgctgaacctgctgcttgttgctttgagtccattcgctttcgccgttcatcatttcttccagttcggtgttggcggaaatgatggaaagcggggtttttagctcgtggccagcattagtgataaattctttttgccgctgctcggcttcgataactggtttgatggctcgcttggatgacatgatcagcacgaactcaaagagaatcagactgatgatgcctaaaatgattccagaaagcatcaagtcatgcgtattcttgaaaatcatcgactggtccaaaaagacgatgccaatctgaccatttttctttttgaccatcttataggcatagctggtcccttgatagcggataataccgcgcgttcgctcacgctgctgaacggtttttgtcagatcggcaattgcatctggcgagaccgttaagatatgagagttgtcaatcttgatgctcttgccgtccttgctgatattggcgctaaaataacggtattgaaacagctcttcacgattaaaacgagagcccagtcgctttttagccgcttcattggcatttttagtggaaagctggccgttatgctgagaaagcagggtcaaaatgtcattggcttcacgatgggcatgaatgctggagaccgaaaccatgctgccaataatcgtaatcaaaacgattaccaaggccgccgtagaaatagcaatgaatttgttgcggagtctttgaatcattgacatccccccctttaagctggctggcttaactgataaggacctcctttttgaccattgataatggtacttgatcctactgcctgcagtttttgtcgaagatatgagatgtagatccacacgtcttcagcatcggcgttttcatcatgatcccatgcctggttcaacagctgctgcgtggagagctctttgtcggcattcaaaatgaaatagctgagcagacgcgtttccttgcctgaaagactcattgagttgtgacttgccaagcgctgttcagcctgatcaactttaagatcgccaaatgccaagacatcgctgtcatattcttcggtccggcgttccaatgagcgcagccgagccaacagttccttaagtgagaacggtttggtcagatagtcatcggctccggcgtcaagaccggttaccttatcatcaatttcggccatggcggtcagcataatgacgtaggtacggttgccagttgcgcggatctctttaagggcctccaaaccggttttaacgggcatcataatatcaaaaatcatgacgtcataggcattggcctgggcatgctcaattgcttcttgaccattgaaaactggatcgacatcgtagccgacactcttcatcgccatgaccaatacgcgggaaagctgtttttcgtcttcagcaagcagaattttcatggaaaaatcctcctaatcattttcgtggataagttgacgaatcgtctgcatctggacatcgcaggcagccagctgatcggcgcagcggcgcagttctttgccgatacgttctggattgtcaatgttatgcttatatttcatttcgtgttccaggctggcccaggaatccattgcgatcgtgcgcagctgaatttcgacaaaataatgaccaggcgtatgaccatcaatatcctggtatggagtcacgacgtctaaaatcagatgatagctacggtagccgtttggtttagcattggcaatatagtctttttccttgacgatggtgcaccagtcggcatcacgcaaaagatcgatgcagcggtagacgtcgtcgatgaagttgcagaccacgcgaatgccaaccgcgtcgcgacatttgcgcagggctgactccggtgttgctgggtagcctttgcgctggcatttttcagtcatgctgtcgttggccttaactcgaccaatcaagtgctcatacagcttgggatgaccgttggcaacctgggtgctgcttaactgtttgatccgatcgagcacgtcgtttaaaatcagtggcagattgtcggcgcacggaccgtagatttccatttccatcattcctcaattctataaaacgtattgctgataataattaatgttaacgcaaaataagacttaacttaagaaataagactgaagaattactaaaataaagcttaagaaattattcacttagcctcagtcagtttgcatcgactgcagcttgattaacgattgccagttcggatattaagcgtttgctgacttaacagccggctgattttaaattaatcgtccgtaaatatggtatgagaattctaatttaacgaaatatgttaggcaaaccagagtataaaatcatcttgaggattgaccttgttcggttttacccgtaaaatagcctttagatttaaaaacaatgatcttttacaaaaggagtggaaactaagtggctaacgtcaatcttgatgcattcgacaagatcctcgtgctcgacttcggtagtcagtacaaccagctgattacgcgccggattcgtgattttggcatctattccgaattgctctcccacaagctgagcgctgaagaaatcaaagaaatgcatcccaaaggcatcattttctctgggggccccaacagtgtctacgcaaaggacgcctttaagatcgatccagaaatctacaagctgggtattccaattttggggatctgctacggcatgcagctgatgtcttatgatctgggcggcaaagttgagccagccgacgattctgaatatggccgagctgatattgaagttatcgatgacgacgcggtaatgttcaagggcctgccaaagaagcagtatgtctggatgagccatggcgatcgcgtcgttgaggcaccagaaggctttaaggtcgttgctaccagcaagaactgcccaatctcagccatcgccaacgacgaaaagaagctttatggcattcagtttcatgccgaggtccgcaacagtcaatatggtctggatattctgaagaagtttgcctttgacgtttgtggggcaaaagcaaactggtcaatggacgactttatcgacatgcaggttgaaagcatccgtaaagaagtcggcgacaaaaaggttatcctgggcctttccggcggggttgactccagtgttacggctgttttgatccacaaggcaattggcgatcaattaacctgcatctttgttgatcacggcctgctgcgcaagaacgaggctgatgaggtaatgaacgccttgagccgcgacctgggtgttaaaatcgtcaaggttgatgccgctgatcgtttcttgggcaagctgaagggcgtttctgatccagaacaaaagcggaagatcattggcaaggaattcgtggaagtctttaacgaagaagccaagaagatgaaggatgccgaatacctggcccaaggtacgctctacaccgacgttatcgaatccgggaccgacacggcgcaaaccatcaagtcgcatcataatgtcggcggcctgccaaagaagctcggctttaagctgatcgagccattgcgcagcctgtttaaggatgagactcgtgaactgggcgaaaagcttggtattccgcatgatctggtttggcgtcagccattcccaggtcctggtctggggattcgggtcttgggcgagatcacgcctgaaaagctggaaatcgtgcgggaaagtgacgcgatcctgcgtgaagagatcaagaaggctggtctggatgaagaaatctggcaatactttacggtgctgcctggcattcgttccgtcggcgtaatgggtgacggtcggacctatgactacgcggttggtatccgcgccgtaaccagtatcgatgggatgacggctgactttgccaagattccatgggatgtcttgcaaaagatttcggtgcgcatcgtaaatgaggttgatcacgttaaccggattctttacgatgtcacgagtaagccgccttcgacaattgaatgggaatagggattgattaaagaaaaaagccgatataacggtatttctggtaatcaatcctaaccaaaatcaaaagccccgtgattcactaaaacgtggatcatggggctttttctgttgatgttttatgttgactttttagtagggaagcagatagaacgattctaaaactatggataagatcttatagccagctcgtcttttgaaacgaaatgatcattggtttggggatggcgatgattaaaaaacatctcaagcgcccaagccagccagctcagcagtgaaatcacgattaagaaattgagccataatggagcagcctagcttaaataggtagtgttttgccccggctgctgaatgattgtcggtgagccaaccaaagaacgcttaaaacgggtcagctttttgccgttgatgatcagccgcgattgacggtaggtaacgattggcagctgaattctgccgcttttatcagcctgccaagtcagctttaagcgcccatgactgacagcttggatcttgatacttgatttttggtcgacgactgaagcgccatagctgtaagcggcctgcatagcgtcaacgttggctttggcagtggccagatagtcgggaacgcgtttttgcagctgttttaaaaatgtttggtagttgctggtatgcatggcttttaagacgttttgccgggccttttgatgatggttgactctgcaattatagctggaaattttgaaacaaatgcgaacgttgtcgggcttttcgattaactttgacgtaatctgcctaactaaaggtgttggctggttatgctaaaatggttttagatctttaaggacaggtagataaaaatgcataacttaatttttctggatgacctgaatggcgcggatttggatccatatgtacggttgaatgaagcccagctgtttcacgcattggagcctgacccgggactttttatcgcagaaagtcccaaggtaatcgaacgggccctgcgcgctggctatcaaccggcttcgcttttagtggaagaaaaggccttgacgcgtgatttagcagatctggatcatgaaatggcggctaatcagaccagcggcttaggacagacgccaatttacgttgccaatagcaaactgcttcgtcagctgccgggctataatcttttgcggggcgcactggcagcgatgcatcgcgtcaagcgtctggagctggctgattttttagcgaccatgccggctgagcatccccgtattgccgtgctcgagagcgtggtcaatccagccaatattggtgcgattttccggtcagcggcggcgttgggcattgatggcgtcatcgtgaccagcgactcggcggatcctttttatcgccggtcttcgcgcgtggcgatgggtaccgtttttcaagtaccttggacctatgttgatgccaaaacctggcagcatggcggcattgatctgcttcaccaggctggatatcagacggcagccatggcattgcggcataataccgtcagcattgacgatcctaagctgactgaagtggaccgtctggcgattatcatgggttcagaaggtccgggactaaaagagacaacgattgagcaaagtgattttacgatcaagattccaatggctcccggagtcgattccttaaacgttgcggccgcctcagccctggcattttgggaactgggcaatcgggttgtcgaatagcggcagcattcaaaaaacgtccattcatgttttgagaatgggcgttttaagttttacagatcaataatttgatattcgaatccttgagctttgatgaatttcatcagatcggccgctgaaagaaagatcgtatgcgtattgatattgggatggaacgttaatggaatgttctcatccagcatgtcttgatcaaagtagatctgaacgttgtgaaccgcgttgttcataatgccaaatggcgaaacgatgccggcctcaagccccagctgatcttcaatgtcactgtcatgggccattgagatgcgcttagtgccagtgagctcttgaaattccttaaagtccatgcgcttggcatcatccatgatcaccaggtagaagtttttctttttatcctttagaaacattgatttggtgcggacgccgattttaccagcaatataggcatcggcttcttcggtggtcttagcggcgggatggttaaccatttcgtatttgatgtccagtttttgcagctcgtcaagcagttcttgataggcgcttgcagaacctttagtcatttgattcacctctggaatgtttattaccatcataatcaaatcaagaaagcgtttcaataaaaaacagtcacggttgaggaccatgactgtttttcagtttagatgatgtcgatgaatctcggcagctagtcagccagcttaccgactactttcagcttgcccaagacgctttcgccatgaggagcatgagcaatagccgcggtggcatcagtgccggccgtaacgccatggtgcttgccgccttgccatgctgacacttcagttacgtcatagaccgtgcccttaacggcaacataggccggctgaccgttttgaccattgaactgctttaattcggctaaggtaaatgttttttccatttgctgattcctccttaatgagaaaacgattgtatcttgataactgaattgtacaagagctgatggaaaaaagccaaagaactgcccctaaataaacattaaattttggcaaagcgactgattggctgccaggcggcttttaagatcacccaggctaacaggccgccaacgatggcactgactgcaaaactggggacgaataagaaaagcgatcccttggcactcatcaacaaagcagcgattggataggaaaccagcgcgccaatcaaacctgtaccgatcaattcgcccaaagccgccagccatatcttgccaaaccgcttaaacagccagccgctcagccaggcgccaaagatgctgccgggataggccaaaagcgtccccgtgcctaaaagattgcgcacggttgaggtcaaaagcgcctgcacgactgcccattccggccccaagaccacgccagcaacaatattgatcagactttgcgttggcgcgcatttggccacgccgataggaaatgagaacatgctgccgccacaaacggccagtgccgacaagacagcggtcagcaccagctgataggtccgttttttcataagattcctcctaaaaaagttttaaaatcgcctcaaaccaataaaaaaactctttcccagtgccgagaaagagtgcttaatcattaatcaaaagaacgtgacgatgcggccacgccaaattaagctgtctccctccgctagtcctaactagatcaggttatgtgggtatctctcagccaaatcaatggcaccccagacagagtcattttatttcaactaccatttaaccactacattgccgggattgacaagcgatgatgatactaaattcattagtcgctagataaagtatttaagtaatttttaaaataatgattgccttttaagaaaaatttggtattatctagttaatcacttaagtaactaactaaaacatctgttgcttttagtacatttgtcgcattcaaacggatttttgagaagtagaaactggggaagattatgcaaaaaataaagcattgggtaaaaaatcaccgcaagacaacgatcggcacggcaatcgttttggttttggtgattgggatggggatcatcaataaaatcaagcagaacaaggccgcgcagtcttcacgctatgtcgttgccaaggttgccaaaacgacgcctttgacgctgaccgggaccgttgccgcccaacagcagcaggttttgagtctgccatccggtaaggtgcagtcgatcggggttgccaacggacaaaaggtcagtgagggtgatcctttggtaacgacctacagcgagagtgccaatgaagaactggccgatgccaaacaggaactgatcaaggcacagcgcaacgtaacggcacagcaaaacaatgtcagtgctgcgcaaaaggatgcggcggcgcaaagcgaggatggcacggtttctggatcggccagcagcgttgcccaggcccaagccagtctggccgatgcgcaaagtgacgttacggtagctcaaaacaaggtcaacacgctgagtcaaaaggtcacccagactttaacggcaccatttgacggtacggtcacggtagacgacaccaagcaggacgcaccggtaatcacgatctattccaacgatctgaagcttaagaccaaagtatcggaatataactacagcaagcttaaaactggtcaggcgattcacgtgcgggcactggcgacgggtaaacaggccgatacgacaatcagctacctggccacggtgccgaccacgaactcgcaaagcaacgataccagctacgaggtcgatgccgatctaagcagcaaagactttatggatgggcagacggtcaaggcttcagttgcgcaaaaccagctgcggattccaaagtccagcgttaaaaatgggcaggtctacgtcgttaaaaacggtaaggccaaagcagttgccgttagcggtaagcgggtcaatgaatactttgaagtcaaaagcggcgtcaaggctggtcagcagatcgttaccaacccagacagcaagctgcataacgggaccaaggtgagcgctgatggcaatgattagactggaacacgttaacaagtactatggtcagggtgcgactcgatttcacgtgctgcatgatatcaatctgcaggttgcggccggtgaactgatggcgattatcggggaatcagggtctggcaagtcgaccttgatcaatatcatcggttttttggatgatgattttgaaggaaactatttttacaatgaccaggcgatccatgactatacgcgggcagattttgccaagctgcgcaaccagcacgtggggtttgtctttcaaaactttaagctgattcgcgacatcagtattgccgaaaacgtcattttgcccctgctgtatgcgggagtgggtcggcggcaggccaaaaagacagcggcccgagttttgagtcgcgttggtctaggaggctatgatgataagctgcccactgagctttcgggtggccagcagcagcgggtctcaatcgcgcgggccatcattgccaatcccgatttcttgattgccgatgagccaacgggggctttggacacgaaaaccagtcaggaaatcatggatctgtttaagcagctcaaccagactcagcatacgaccatcatcatggtgacgcatgatccacgggttgccgagcagtgcgagcgcgtcgtcaagatcattgatggccgaattgtcgacgatcgaaaggtgggaggaaattgagaaatgccgaactcttgcgcagtgctctgcaatcgctaagagccaaccccaagcgcagttttctgacgacgattgggattacgattgggatcgcggcggtaattacgattctggcactgggaaatggggtcaaaaaaaggctcagcgatgagtttaatacgactcaaaacggcgagcagtatacctatctttactttacgcccaacgattcgcagtcggcagcttccggatttaccgaaacagacttaaacgcgattgaggaacgatttggcgctaaggtgaaaaaagccgcaatctcgcatgaaaccaacaatgcttccgtctcgccgctggttggcaatgagcgggtcaacaacgccacgatttcgctgtttaagcggccaaccagcaagatttccattatagcgggccgcaatcttacgaccaatgagcttttgactgaagaaccggttattctgatgaaagagtcgctggctaaaaagcagtatcagacggttcaaaatacagtcggcacttctgtttcaattggggatcacgactatcgcgtggtcggggtgtatcgctcacaggccaacacctataatgacaacaagtacggcgccgatctgattggcggcaccaagctgttttattcggggactacggcgacaaccggctatggcattaagctgaccttttatcaaggcgccaatgccggcaaggttaccaaaaagattaagaaatacatggaaaagaagggaaccagcgctcacgatggtacctacatggcagtcgatgccggcgcggaactgaccaaagtcaacaacatgattaccggtttgacggcctttatcagtgccattgcggggatctcgctgtttatcgctgggattggggtcatgaacatgatgtacatctcggtttcggagcgaacgcaggaaatcgggattcggctggccgttggggccgcgccgcaaaacgtgatggcccagttcttgttagaagccatcgtcttaacggtcggcggcgggttgctgggctttgtcatcggctggctgctggcgggcataatcagtaatttcatgccttaccacattcatgccgtcataaccttgaattcgttcctgctggcatttggggtctcagcttcagtcgggatcatctttgggatcttgccggctaaacaggctgccaacaaaaacctgatcgagattctgcgttagtcaatcttcattaaaaagcggcagtttaaagaaaatatttaaggcacgttgtcaagcttgaacttgaacagcgtgcctttttggtttgagttgatggaattaattttcttgacgatggtaattgccaagcagccgcagtgaggtcgtatagtttttcagttcggccaaagtttcggtaatccgcgggtcagccagattcccatctaggtcaacatagaaatagtattcccaggggttgcccagcaaaggccgcgattcgatccgcaccatgttgatagcatgctctttaatgacgcgcatgacttcatagagcgtgccaacctcatttttcaaggtaaagatcaatgaaatccgatcagcatccggcaagacttctggtgcgcggccaaaaatgataaaacgcgtgtgattagacttatcgttttcgatgctgggtgccaaaacgtctagatcatataatttggctgcttcagtcgaggcaatcgcgccaactgccggatcctgcctttcagcggccattttagccgccagtgccgtattgaggcattcttttccttggatctgatgcgcggctaaaaactggctggtctgcaaaagaccctggggatgcgaatagacttccttgatgtcattgagtttggctcctttaacgcccaataggttttgagcaatgtagatggactgctcgccaacgataaagaaatggtacttgttgatcagatcgtagttgtcattgatggcaccggttgaggaattttccattgggacgacgccatagtcgattgcgccgttttgcagtgccaaaaaaacgtcttcaaacttaggatagttgcgactttcaacctggccaaaccattgatgcatggcctgagaagagaatgatcccgggacgccttgatagccaacggtaaccccggttcgctgcggttgtgcaatcatagataattcctccgtaatctaaaaaatttcttctaatcttagctgattgtctaaattatgacaaccattaccggattagttagtggtgcttgtttgggaacatgctaaaatagacgggtcgataaaaggagatttttatgaagattatcattgctccggctcggaatatgaaagctgatccggattcattgccgattcaaggcttaccgcagtttttgccgcaaacggaaacgattttagattatctgcgcagtttaagctacgaccagcttcatcatctttggtgggactgcagcgaaaaaattgccattcccaactatcaatgggtgcagcagatggatctttatcatcagctgaccccggcattgctggcatttaccggcctgcagtaccagcggatggctccgggagtttttgatgagaaagcacttggctatgttcaggaccacttgcgcatcttatcgggcttttatggcttattgaggccgtttgacggaatcgtttcctatcgcttgggcatgggtgatcgagctaaagttgccgggaccaggaatctatatgagttttggggcagcagactggccgatgagctttatgcacaagacgagctggttttgaatctggcatcaaaagaatatgccaaagcagtcattccttacgtcaaaggcaagcgtcaactggtcagctgcacgtttgtcaaagcagagcatggccgcttcaagactcaagccacacgggccaagatcgcacggggcaatctggtacgctatctggctgagcagcaggctgatgatctggcggtcgtaaagcagtttaatcttggctatcattatgatgagcaggcatcgacaaatgataacttggtttttgtagcggattaggatgggaagagagaattgagaatagagaagtcaagtgacagtcgcgcgctggcaattgcaacgattgtcatgggaattattgccggggccagttccggtttgttaagcattgtcttggacgcaacggaaagagtattttttcattttaccgaaaccaacgcgattccggtcgcattttcagccacgccattaaaccggctgctggcgccaattattggggctctgatcgtatcagtcgtctggtactttatgcagctgcactatcgaccggttaaattgggcaaggccgttgatggcgaaaaaatgccaatgggggccacgatcatgcatgtcacggcccaagtattctatgtcgggactgggggatccatcggtcgggaactggccccaagagaagctggcgcaatgtgggctcagtcgtggatccgattgggtgatcggattggctggcttaagctggctccagaagactgtcgcctgctgattgccgcagcagctggggccggttttgccggcgtctacattgcaccgattacaggagcgatgttttgcctggagatcctctataaaaagattgataaaaaagccgtgatcgtcagtctgaccatggctgcgattgcaacgatggtcggtgcgatcgtcaaaggctggcagccgtattatctggtggcgtcacgtcagttttcgctgcgcttgattccctttgtagtgatcgtggcaccgctgatgggctttttgggtacttggtacaaacggttgattggccgcgccagtgcactgcgcgttaaggatcggcggatttttattacgatgccactggctggggcgctgacgggtgccgttgcctgttttttcccagaaatcatggggaatggccgaggtgtggcccagatggcaatcaatgtgaccagtgtttctcattcggcagttgctttactgctgttcggcttttttgccaaagggctggttactttagcaacgattagtggtggcggctatggtgggacactgacgccatcaattgccatgggttcgtctttaggcgtactgttagggatgatttttattcaggcaatgcctggcgaacagttaatgcagtttgccgtcttaggcgcggcctttttcctggcagctactcagcaggcaccattaatggcaatgtttatgctgtttgaagtctgtcatttgaatttttcagcccttttgccattaggattaggcgtggcactaagcatggcgatctccagctggatgcaggctaaaaaagcataagatagaagaaaggacggtgctgatgaagtctaagcgagtagatgcgccgctggtacctttggcaattgcgctggcagcgatgttatcgattggggcggccgttgtctggcatcaatggctgttttggctagtgacggttttgttattgatctgtttagggctgtatttaaatgcatcatggcgcggcaaagagcagataattgatgaaacaatcacgtatctgcatctgtcttctgacgcgcaggtgcttgatctcggcactgatcaagggaatgtgctggtaaagctggccaagcgcttaacgatcccaggacatgcaacaggggtcgaagtcgggcgcaaatctgcacagtcgcataattcgcttgcccgcgccaaggacagtcttcaggctgcggcaatggcagatcgcgcttcagtgcaggcagcgggcatattgaatctgccatttaaagatcaccagtttgatgggattttgatttggatgacgctgcatcaggtcaagccaacgatcaatcgtgcgcgtgcagttcaagaagcagctcggaccttaaaaagcgatggtacgctggcaattattgattttaggcattttgatgagtaccaaaagattttggcaaggctgggctttcatgacattacggttcatcagtgcggtgtcaacggctggtggggtgttccatggttaagtaccaaaatcttattggccaagcgtttctagccgcaagcaggctggcagttgcgctgatgattaaaaacgattgaaaataaagcgttcagcggttttgagaggcgattgccgactgctgagcgttttttatgagctttttttaaatgctggttgttctttggtaatgaaaagcttatccttattcagtatgcattcgacagggaggaaagattttgaacaagagaacgaaaggcattctgctggccgttacgggagcttctttttggggaacttcaggcgttgccgtgcaatatctgtttggcgaaacgacggtcagtgaggtttggctggtcgggctgcggcttttaggagctggaatgctgctgctgatcttggccaagctgactggaagatcgtcaaccaaggcattgtttagcaatcgccatgatgtcctgcagctggttttatttgccttttttgggatgggcatgtcgcagctgacttattttgcggccgttaagtacagcaatgccccgacagccacggtgattcaatacttggcgccagttatcattattggttatacggcagctgcccagaaaatgatgccgcgccgaatcgatgtggtatcgatcatcgtagccttggttggaacgtttttattggtgaccaacggcaatctcaatcatctggcgttgtcgccgcaagcatgcttttgggcgcttttggctgcgctggccaatgcagtcagcacgatggcacccgggcgactgtttgcccgctatggcacgcttaatgttacggcctggtcgatgctgatctgtggcatttgttttatcccgctgtactttattatgccaatgccggccctgcgaccgttagacgtggccttgattggctggattgttattggcggtacgcttttggcctatacgctctacctggccagcgtacaatatatcgatcctagtacgacagggatgctgggagcttttgagcctttggtggcaacgattctggcggtggcgcttttgcacactcaatttggtccggtcaatatcttggccagctgcctgattattttggcaactttcttgcagatgatgccgctgcagatcttttcgcatcgtcgatcattaaactaaccaggttgtgtcaatatgaaaagccaagcgtggtggggatccaccagcttggctttttgattatttgacagcttgttttttgccatttaagccgttacggcaaagatagacgatcgcggccagaactaagatgcccgcgccaacgattactgagatgcgcgtatcagggttgataaacatgaagacaacgatcatgatcagcattgcaaacgcaaagtagtttgaaaatggataaagcggcagtttaaacggatgatcctgcatcagttcaggattatgctgccggaatcgtagttcagccagcaatatcacaaaccaaggaatcatccctggcaaaacggatgaactgaagacaacgacaaagagatcggcagttgacttgctgaagtattcggcgaagatgtctaagacaaagccgatcagaatcccgccagaaattcccagaattgctgcatcgggaaccacgtgcttggaaagtctgccaaacaggcgtggagcattgccttcatgcgccaagcggaaaagcatccggctagaactgtagatccctgagttggcaccagataaagcagctgtcaaaaccacaaagttgataatcgaagccgctgcagtaatgccgactttggcaaacgtttcaacaaatggcgagccgacgctatccaattgattccacgggtagatcgtaacaatgacgaaaatcgcgccgacataaaagatcagaattctaaacaaaacggatttaaccgatttgaccacggctttttgcggattggcaacctcaccggccgagattcccaatagctcgattccttcatatgacccaacgatgatcgacattgagaacataaagcccttaaagccgccggtgaaaaagccgccatgagcccaaagattgctaaagccaatgggatgaccgccattaccaaatcccagcagaatcactaaaaagcccagaataatcattaaaacaatcgttacgaccttgatcatggcaaaccagaattccaaggtaccgtaagctttggcactggccaggttggcgatggctaaaaagaagatgatgatcagacctgcagcccaggtttgagtatgcggccaccagtacttgagatattcagttgaggcaataacttctgacatcccgaccacgatatattcaaaaacgttggcccattctgccatgtagccagccattgggtgcacgtaatgggtggcatagtcagcaaacgaccccgtactgggattgacgtagatcatctcgcccaaagcccgcattacgatatacagaatcaaaccgacaaaggcataggccaaaagtacggaaggcccggtccatttgatggttgattttgatcccataaacagtccaacgccaatcgcgccgcccaaagagatcatttccatttgtcccgccgtcattgtgcgttttaactttggcgcgacgtggtttttctcactcatgctgtgtcctccaaaaataaaagaacgattcaaattatgaaccgctcatcattaccgttaagcttaatcagatgttgcagcagccgaccataatcagatggatatttgattggttatggaaaaactgcataaaaactccttaaaaataactagctaccattataccgattctagaaaagaataccatttaaaagtcaaccaccatcggctaaagtcgatggcttgtgggcaaacaccccagtattgagtatccgaaccacaatttgcatagatacggacgatttactcgaacagccgcagttgcttgagcagtgatcatctaattaccaatgccttttacattcccaggttgccataggaatgagcctagctttttgactaggctttttgttgtttctggagtcctttttctaaaatatttagtgctgcattgtaatcacggatatgatgaacatggcactttggacatatccattcacgatctgccagtgtcagcttttcggtctcgtcacttcccattacaaaaccgcagtcatgacaggtttgggtcgtgtttttagggctgaccgtgataaattgacggtcatagaggtcggctttgtatgacaacatacccaagaaagaccgccagccaacatcactgatgctcattgccaaggcatgattttttaacagattcttactcctcaattcttcagctacaacgagatcttggttcttgatcagtgctgtagatgtgcgttggagaaaatcatggcggcggtcaaatactcgtgcatggatcttagcgactaacaaacgttgcttctggtaatttttgctttcccgcaaagaacgctgctcttttttagcccggcgctggcggcgtgaaagggtacgctgtgctttagctaactttcccttgattgttcgatagtagcgtgggttagcgatggttcgaccatcactggcagtcagaaagttttctgtgtttaggtcaatgccaatttgccgattagtgcggctaagcttaggaacaaacggtgtatcggaacctaattgcaacgacaaaaagaaccgattggctgcatctttggaaatggtcaccgtaccgatgcgtgtttcgccttgacgatccaatagtcgccgctgagcgcctttgatccgcaaacgtcctagtttaggcaccacaatatgtttgcggtcttcaaagcagacggtaccgttgtctagccgggccgtcttttgttttggatattgacagttggtctggtatcgccaggcatagcttttacgatgaaattttggcacaccggcttcatgaaccttgcgaaaagcgttccaagccttgtgatagttttgaattgcattagccttagcaagactgtcaatacgcttatcttctaaaaactggaaatgatttgacatctgcttagcgttttgacgaagctttagctgttggatccgatcttgaaccgtatcaattgacagtttgattcggtttaattgccagagttctttaccgatcgcaaccatctcattatagacgaaacgactggcatcgctgttaaccttgattatttgtttctggtaatcactcggatagatgcgaaccttcaatccataatgatattctaactgtgccattgacttcattttttcacctcctttaattggattatatcatcagctaacgactataacgattgaggtgttcttaatgacttaagaaaaaattcaagacgcagtttatactcgtcgatatatctataattttcattatcacttaatctgggtaaccaagtatcggtcccagacctttgccactaaaaaaactagccgatgaaatgaaagacatactgcgaatggtcgcaaaagataacgatattgtgatggaaaagctggaagtcatcctggatcatgttcatgtgctgatcagttttccacctagcaaggcgctcaaaggacgaagtgcattcatttttctcaaacgacacccagaaattcgacaatcacaatattggggtggtcatttatggtctcccagctactatatgagtacgcttggcaacatgagcaaagacgtcgtagaaaactacatcaataatcaaaaatacaatgcgcttcaaaaagaacgtcttaagaaagcctatccatcccatgactaaagtcacgggatggataggctagacataattaaaaaattataagaattgaaggctgatgaggtagtctgtttcaatctttttagcaattggcgttataatgtttaataaatttaacgaaatgaggaaagaaaatggcagactcaacgcgtttttatgaaaaatttcaaccagtccactacgacatctacctggatatcgaccgcgccgccaagcattttaaaggcattacgacgatcaaaggcaatgctgtggacactaagattgcactgcatcaaaagtttctaaacgttgccagcgttcaggctgatggacaggacgtaccattcagcttcagcgaccgtcaagaagccattcagcttgaactgccgcattctggtgacgtggagttaaaagtagtttatgatgccaagctgactgatacgatgatggggatctatccgtcatactacacggttgccggccaaaaaaagcagctgattggtacgcaatttgaaaccacggcggcgcggcaggcttttcctgggattgatgagccagaagccaaggcgacgttttcgttagccatcaagtatgacgaacagccaggcgaaaccatcattgccaatatgccggaagatcatgttgaaaatggcgtgcattacttccaagaaaccgtcaagatgtctacttatctggttgcatttgcgtttggcgagctgcagagcaagtttgccaaaaccaagagcggcgttgagatcggtgtcttttctacgaaggcccatcagccaaaagaacttgatttctcattggatattgccaaacgcgcgattgagttttatgaagacttttaccagacgccatatccactgccacagtcatatcaattagccttgccagacttttcagccggcgcgatggagaactggggcctggttacctatcgtgaggcctacatgcttttggatccggacaatacgatgctcaatcaaaaacggctgattgccacggtcatcacgcatgagctggcacatcaatggtttggtgatctggttacgatgaagtggtgggatgatctttggctgaacgagtcatttgccaacatgatggaatacgtggctgtcgatgctctggagccggaatggaacgtttgggagatgtttcagacttctgaggttccaatggcgctgcagcgggatgctacggatggcgtgcagtcggttcacgttgccgttgatgaccccgcggagatcgatacgctgtttgatggagcgatcgtttatgccaaaggtgcgcggatgctggtaatggtgcgggcattgctgggcgatgaagcgatgcgcaagggcttgaagaactactttgctgctcatcaatatggcaatgctacgggagccgatctttggcaggcattaggcgaggcttcaggaatgaatgttggccagatcatggagtcgtggctggagcatccgggctatccggtagtcgaggtcaaggttgaggatggcaagcttatgctcagtcagcagcagttctttattggtgatggcgaggaaaagggccgtctctggcagattccattaaatgccaattataatcaggcaccagcgatctttagcgaacaaagcctggttttaggcgactatgcccaactgcgaaaacaaaattgtcggccgttccgcattaatgtaggcgataattcccatgtcatcgttaaatatgatgagacgctgctaaatgatattttggatcaccttgatgaactgggagccatcgatcagctgcagctgctgcaggatctgcgtctgttggcagaaggacggcagatttcctatgctcagatcgtcccgctgctgagtcgctttaaagacagtcgctctggaatcgttaatgaaatgctgtaccatgtggctaacagtctcaaaaactttgtccagccggctgccaagacagagcgtcaactgcagcagctgtttgatcagctcagcgtcaagcaggtgcagcggcttggctggctttcacaaaaaggtgagtccaatgatgatcaattaacgcggccaatcgtattgagcgcggccttgtatgcgcaaaaccgtgacacagtcaagcaggcacaggcattgtttgatcagtatcaggaccatctggcggatctgccggctgatgtacggggactggtgctggccaacgaggttaaaaactatggcagccaggaactgtttgatacgctgctggcggactatcaaaagactgctgatgccggttttaagcaggatatctgtgcagctttgaccaagacgcaggatgatcaattgattgcccagctgattgatcggtttaaagatgccgataccatcaagccacaggatctgcgggcttggtttagaggcgttttggctaatgatcatggtcaacaggcagcctgggactggatccagcaagaatggtcatggttggaaaagaccgttggcggcgacatggaatttccaacctatattaccgtaatctcccgtatctttaagacttcgcagcgattggccgaattcaagtgtttctttacgcctaaggaaaacgacccaatgctgaaacgcgaaattcaaatggatgaaaaggtgattgccagtcgcgtagaattgattgaaagcgaacaggccgcggttaatgctgcaattgctaagacggttgctgaataacgaaagataaactaaaaactggtagtggcggatgtcattaccagtttttcagtaaaaatgaaatatttttggttagcagtcggaaagaacgtttacaatatcaaaatcatcgaacagccaatgcttatggtagaatcatgacggctttaacgggactggattggcttaaaactggcagcttttggcggctggccgataatcctgaaagtatgcaggaacccgacttttatgattgcttggctgcatgccttgtgaagaaagtatggcttgggcggcttgaaattacctattatcggcagattttttaccaaaagtaggtactgcatagccgatttattttgctttacctacttttgccattttttctgtgaatcgtaggtaaatctgtatattctaaggctgatagggttagaccgactttgtgaattacctccgattacgtgtttttatcaacatagtaggtaatgttagggatccctgacttgatatacattagttttttcctacttatacattgattttttcgaaaagtagtaatgatggtttcgtcatatgttttatacaaaaatttctgcataagagccgctatttaagctgttaatgacggatctaacctgatctagattgcagcagcgtcataactatggcgaaatcagtcccacagcccctcaaagcgggtattgcctttagaagctgcggtgttggcatcgactggctcgccattgccattaaagaaatgaaacgtcaggccattttgcggatcatagtcgatcagcgtggtcttgcctgaaaagaaccagctgtcttgatcatcgatatgatagttgatctcatcgataataacctgcaaaaccggctgcttgggctgatcttctttttgataggactgcttggggccataattgacgtgtccattgcggccaccagttggagtaaagaagcgcacgccgctaccaggctgcagatccagctgcttgatcagccattgttgagcggtctttgaaatttttagctgcattaaatcacctgcttttgtttgctagaaaataattgttttaagatatttgagcaagatttattcgattcgctggcgtcattaaaatctaagcttaaccgatgaccttagaatatcgatgtttgggccgttatgcaaataatcagcgcttgaagcaagcagtatcgaaacgctgaatttgccaataattaactggtaatcaaaccaatgagtcaaaccagcagctaaaaatcgataagggatttttgatttttgctgataatcagaaagaattttgcgttaagatagaaaagacagtgtaaagaaagaattattaataaggattgatactaaagatgaatagacatagctggaagaaacgcctgcagagtctggttctggtgctgctcagccttaatctcagcctgctgggtctctcctcgattgttttggctgatagcgaggcaactgaagaatcaacggttgtcgcacaggaaagctcatcagacagcaatggccaccaatcgggacaaaacgtaggcacaagccaggatgttgatgccaaggctgcgattgccatggatgctaagactgggcagattctgtaccaaaagaacgcgcaaaaacggtatccggttgcttccaccattaagattctcacgctggccgtcattgaaaaagatattcaggctcataagctaagctgggatcaaaaggtaacgatctcgcatccagtggcggtaatggccaacgattggcgcttttccaacgtgccgctgaatgagggcgagagctatacgattaagtcattggttgattcaatgatgctggtttcagctgacggcagtgccgaagcgctagccttagctgatgccggcagcgtggccaagttcaatgccaagatgcagcaggtggctaaagaagctggcgtgaccgatgccaagatctataacatgatcggactctcaaatggggatctggggactttgcgcttaaagaacgtctccaaaaacgccgaaaatcagatttctgccgttgatctggctaagattgccagctggcttttgaaccattatccagatgtcgtcaatattaccaagacggctcaagaagacttcccagtcagtgattcacagacctaccacatgcaaaacatcaatctgatgattaagggagcggctctggatcgagcagatggtgagatcgatggcctaaagaccgggacgactgattcagccggcaactgttttgtcagcaccggaacgtttaacaatcgccgcctggttacggtagtcttaaatgtttctggcgacttcaacaatcagttccaacagaccaataacctctataatcgcgtattgggtcgctttgcaccacagacgatcaaaaaaggtgcgctgatcaaagtcggtcaaaagaaggcacgagcagctaaaacaacgacgctgtggctgcctaaagataccaagcttgaaaaaaagacgattaagataaagggaacactgaaaggcagcaagctaacgcctaacgacatgccacaagttgccttaaagctaaagtaaaagcaaaagcgctgattcagactgttcaaagtctaaatcagcgcttttatgctgaatcggtaaagtagtgccgatcttaaactgctggacttatttgtttaagatcttgctggttgatttggccagcttttcgatcgtattttcaccattttgcattgaagaattgtcatcagtgtagacggcaatcgtatagctgtcgctagcgccattgttaccggggatgtagccgatactgttgatgatccagccatcgtcttcgtccagccaaccgtttttaaggtaaaagttggtgctgccggctgaaattccccactgttggtcgctttctacattttgcatcagattgcgcacgtatgactgctgactggtgctcaagaggttggatgagtagaaaatggcgttgagcagtttaagctgatcgctaggagtagtagttgaaagtccccattcttcatgggccttggagtcagtcattcccagtttgtcaaaagtctcctgcagaccacttttttcgcccagctcaacaaataaggctgaagcggcggtattgctgctgttttcaatcatggcctgggcattggcctgttcgctgctgtttaatgtgccctgtttcatcaagagaccgaccaaaattgagaccttgactgtgctggccatgcgatatgaatgatttgcagcgttggatgccgtgtaggtttttttggtttgattcgagtagacggcaatggccacgtgtccgtcagcctgctgcagaatcggtttccaggcttcctgaagctgggtgttgctgtcagtcgatgaggaactgttggagactaccttttggacgatttttaatggtgaggatagtttaacgctagcgtttcgggaactgttcagaccaggaatcagcaaaccggccgtacatcctaaggcaacaaatatcaggatgatcgtcagccatttaaacagacggcgccttcgattgggtttaaactgagtttttcgtgctggtcgctggttcattacaatttccttccatgatttttttatttagaatacaaaaacctttgtaaagactaaaatagtttaacacctcaaattgaagaattcatgaattttgaagcagttatgccatgtttgtaggcaaaagctttgtcacagattttgaattaacctaaagtagatatcgtgatcaacattgttagcttaaggagaggtttatgacgtggatggatgatcagctgcgagctgacttacaaaatggctttatcgatggcagtctgccggctggcgcactgggaccagaaatcttaaccaatcgacaaggcaatacgatctttaacgaaatcaaaaatgaactgcgcacctgcacgaattttaagatggcagttgcctttattacaccggccgttttagtgccaatcaagtcgattatgatggacctggcgcaaaaaggagttggcggtgagcttttgacgggaacctatctgcagttcaattctccccaggtctttgccgaattgatgaagattcctaatttgaaggtacgcttgactggagaggtcggctttcaccaaaaaggctactggtttgaccatcaagactatgagacgttgatcatcggcagtgccaacctaacgatggacgcgcttttaaaaaatgccgaatggtgtcttaaagtcagctctaagcatcaaggagccgttattcagcagtttgcagctgagtttggcaatcaatggcaggtagcggttcagttaaacgcggcatggctgacggcatatcaaaaaggctggcaggcaccagtcttaagctcagcatcgcaaacaagccagtctgatctgattacgcccaatgccatgcaaaaagctgcctgcaaacgaattgaggcgctgcgccaggctggtgaaaagcgggccttggtgatttcagcaacggggacagggaaaacgtatttggccgcgtttgccgttcaaagcgccaaacctagccgcgtcctggtggttgcccatcgtgagcagctgcttttaaaggcgcgggccagttttcaaaagattattggcggtcaagatcaagactatggcttttttaccagtcagcagacgcctggaaccgcgcgatacgtgtttgccacggtccagacgctggcaaggcacttggatcagattgggccggctgattttgactatgtgattattgatgaggtccatcatgccggtgcggccagctatcaaaaaatcatcaactggctgcagccgcgctttttattgggactgacggctactccggatcgaaccgatgatttcaacgtctatgccttgttcaactaccagctggcctatgagattcgacttcaagaggcgttaagcgagcggatgctgtgcccatttcagtttgttggcgtcagtgactatgtctggcagggacagaccgttagcgaaaaaacgccgctcaaacatttgattcagcctgaacgggtggactggataatcaaagtggctgactattatggacatgacggggatgtcttgcatggcttgattttttgctcgcgaaccaaagaagctcaagaactggccgcccttttgacgcagaaggggtatccggcgcaggcgctaacgggacaggattcggcagccaaaagagagcaggcagttgccagactgcaagccggtgagttggtctatctgatcacggttgatgtttttaacgaagggatcgatattccctgcgtcaatcaagtgatcatgctgcgcgatacgcaatcggcaatcgtttttctgcagcagctgggacgcggactgcggaaagcaatcggcaagcagtttttgacagtgattgattttatcggtaactatcagcacaactatttgattccccaggcactgactgatgatcattcccaccagcgcagtcgggcgcttcagacgctgcgtgccgagccaaccttgggaatttcaacgatctcatttacgcggctggcctatgaacggatcctggcgtcagttgaaaaggctcagctgaccgggatgagtctgctcaaaagcgagtttagtcagcttaagcagcggctgggaagaacaccattgatggctgattttcaaagagcaggaatccttgatgaaagcatctttgccgaaaagtttaagacctatccgcgcttcctgcaaaaaatgggagcaacggtcaatctcaatcctcaaacggaaccggttttacagtttctgactgaggaattggccaatggcaagcgccagcatgaactgattttattggcaatgctgaccaagcagtcaacgattacagtcgctgattatcaagcgcaactgcatcagaatggctgttgggttgatgacgcgaccttggcatcggttaaacgagtcttgacgctggaatattatctgactaaaggcaagattggcagtcggatccgctatggcaatcagtccttgattatcacgactggtcagcagattcagctgcacccccagattcaaaactatctgagagacgctgaattcaggctgttttggaatgatgccattgaaaccggcagactgcaggctaaaaagtatgatcagaaacagccgctgacgctcaaccagcgctatacccgcatggatgccgtcaagctcttgaacaacgcgcaatacatggtgcctaatggaattggcggctattatttcatgggtgagacggggattttatttgtgacctaccaccactcaaatacgcgggccgcgattgactttgacaatcagtttcgcagccggacgcagctttccttttattccaagaccaaccgcacgctgaacagccgcgatgccgaaaagctgctgaatccaaacgccagcctgcatctattcgttaaaaattcagatgagcaggaccagtcgcagtttgtctaccttggtctttgccaggttatgccgggatctgctcatgagtttttgcaaaagggaaccaataagccgatttttggcgtggagctgttgttaaaacatcctgttgatcaagcactttatctggcctggcaaaatgaaagagcggctcatcagttccatcaagagaattcataaataaaatagaaaacgcgcgactcaggcttcagcggggcttgagtcgcgcgtttaaaagtatttaatggcgtttggcatggcggacagggggcttgatgttgttgagctgccaagtcagttcatcaatcgtcatgatccgcggattatcgtcccactggcggctgtcagcaaagtcggcaacatcccagtaatgattgagcaggttgaggccgtctttgctgatggcaaggtaggcgtcttcatgaaccgtgattgccaggccaaagttgatcaatgcccgcaagcgatgcagagccgccggattgctgagcagctgatgattgatcaaaacgccatcgttattaaaacgcagcggctcattgccagtctggcccagcttttccagcatggccagccagacaaaatgccaatagccaagcttgatgctgccaaattgcggctgctggaaatttttcctaagacttgcaaccagctcacgatgactgccatagcggcgcagatcaaaagaagcatcggcaaagcggcgcgagcgttcattctcatgccaggaaaaacgcagataaaacagccgctgaccatgcaaaacgttggcgtagatgctttcggtcgacttggcctgattaaaggcaatcagttcatagtcgcggttaggcaatgcggcaataatggcatggtgaatctcatgctgccaatcgagggttgcttgcgcggtcatttaaaaactcctcctctaatgatgctgacttaattataagccaggtttttattcattctcaaacctaagcactgctgcaatggtatgttttaggaccgtcttttgcacaattagttaagaatgcctgctgactcgattgattggcggaatagttgccgtccaatgcggtataatagtttttaatgatgttttgaagggagtttttgcaatggataccaagcagtataaatttgttggcaaagactttgatattgaagcggccccaaccaaaatcgatggctataacgatgaagacatggccatgattgaaaacgtgaagggtcagatcgaagccaatctaaaaaaactgaagaaatttcaaaagaagatgtattcaagatcgcgctatggcgtcgtcttggtctttcaagcactggatgctgccggcaaggatagtatgattgcccacatcttttctggaattgatccggttgggtttacggtcaataacttcaagcagcccagcaagactgatctgagtcacgactatttgtggcggatccaccagaaacttcctgaacgcggggcaatcggcgttttgaatcgttcctactatgaagacgttttggtttcccgggtgcatcctgaactgattcttaatgccaacctgccaaacgtcctatcgattgctgatgtcaatgatgccttttgggatggccgctacgaagatattcgccagtttgagaaatacttgacgcgcaacggttatgtcgttttgaagttcttcttgcacgtttcaaaaggcgagcagaagaagcggtttgaacggcgcatcactatgccggaaaagaactggaaattctcggcttcagacatcaaggagcgtcaatactgggatgaataccagctggcctatgaaaaagccatcaacgaaacggctaccaaaaagaatccttggtacgtaattccgagcgacagcaagtggtactcgcggctggtcgtctctgatattttgaccaagcggctgggcaagctggatctttccttccccgaagttactgctgagcaaaaggctgccatggatgatgcgctgcaccgcttggaaaacgaaaaagattaatcagtgaggaaaaatatgggcttggtaaattcatttgatcaatggcagaaaataaccgtgccgcttgacagctatcttagtctcaaacagcttaacgatggtcagtgtcaatgggagctgattgaaaaaaagcatgcggtaccagtaattgcaggctggcagcaccggccggcaaatgagttcagccatttgcagaccaagcgactgtaccagagcctggcgccgttgattcaagatcaaacggcgcgccgctggtttgtaggtgagcatccttggtgggactggtcgtttaatctaaggtttctagaagacctgacgccagacgatccgctgaaccagtggattgaagaaatggccgacaagctggatggctatttggaaaagcagcgctatcagcaggcggctgcaatgatggccggagtgttagttaaaaagctgcagatttcgccagccttgatcgaaccatacgcggtctatctaaaagccagcgcgcatcaatttgccaagcgcggtttgacgagcgatcgccatgtcacggcagctcagttaaaaacagctgctcatcatctcttaaaccggcagtgggatcggctgcagctggatctccagaatatcaatgcctggtgggactgagtcttgtagagcggctggtgaaaggaaatgcttaggtgtgaaattgatgggttattggccagacaagtgatcttgattagaaagctttgctggaggattgaaaaacagcgttggtggcatgctgactatcaatgaattgatgaatttagttgcacttggcagcaaagtttcatacaataaacccgtatactatatacacacctattgcgcgacccctgcctggctgatcagttggacaggggtcgtcttagtctaggggagattgcaatgaagaaacgcagaattgttttgacggttgggggtattttagcgctgattgggctgattttattggtctgggattttcggcgcgaactgatgctggtggttgacccaaccgtggcgcatcggcatcaattgatgaagctgattcgttcgcatggggcagctgatatcgtgctgttaaccattgtgattggccttttgaatgcgattccaggaatgtccaattcgctgctgtgcattctggctggtctatgctatggaccatggatcggttttgcaatgaactgggtcggcaacgtcttgggcagctgtctggtcgttgagctgatcaagcacgttgacgtttcgaaaaaaatcaagaccagtcgtctgctgacggcactgaccgatcagcagcatcctttgattggtttgacgattggctacatgattcccgtaattcccagtattttggttgattatgccggggttaggatgaagcttgatcgcgggcattttctgctgatgattgctggtggaatgctgccaacctcgtttttgtatgcgtttggcggtgatgcactgtttaatgctgattttaagcgttgcagcggggtcttggtcgcgctgctgattctgatcgccatgtatttcttggttcgacgtcggatgaagaaaccgaccagtccagcggtctaactattcatgaagctaaaaacacctcgcttggcagttgccagacgaggtgtttttataatggctattgattcaggtaagctaaaaagcgctggtagtcttgatcgacctgtttggaatattgaactgcccagttggctaagccggcatcaagctgtttttgcttgcgcagatagccggcaatgcgaggagcggtaggactttggaaatgcgccatggctaataaaaaactgcagatctcggcataaacgctcagactttcaaaatccaagcgggtcgcgtcaattgattccttcatgtcccggaattggcgcaggtagtagccgcgaccatcaaaatgcgtactgccgagaaaaggatcagaagccgactgcagaaccttttgtgccgtaacgatccgccgtccagcattcagactgcttttgatggattcagcaaccggcatggccagcagattatagcgcagcggcaaggcttctttcatctgcaggaccaggtgactgccatcaatcccggtcagcagcaataaaaagcagcgcgtaccaaagctgccaacgccgacgctgtagcgaatcacgtccgaaagatggtagctggccagcaaaacgcggatgtcttctctgacgtagttgcgatagctgttataggcagcttgaatctgtctgaaagtgtggtcgctgacgtggcgggcgcggggcggattctcacggaagatcagatgaccacgcgaattgagcgtcgtgaattttttgatgaccgtttctgagttgttcttatggctctttttgagaattcgatcgacgatgcggctcatttcggcacgatcgttatcctccagcgagttcagcgtttgaatcatatcatgaatctcgtatgaaaaataaaagcgctgcagcagagtgagcgtctcggcatgcttgacgccgcgtcgataaaccttgcacatgctgcttaagagcgcttgcagccgatctggctcaaaattattctgcagaccaaccaggtaggtgctgaccaaaaggcgctttaagtcgctttcccaattgccgatccgagattcatcaaaatcattgagatcaaacagcaatttgcgttctggcgaggcatagaagccatagtttcctaaatgggcatcgccattgataatgattgagatgccgctttgatactgctgcttaaggtcttgttccattaattccgcggtgccgcgaaaaaaggcgaagcggctggcggccatgcgttgatgacgcaatggcagcagttcagggatcatcttggcttcggtcagcttgatcaaattgattggatcgcgctgaacgggaacgtattcaccgagcttttcgactgggacgtggcggcgctgcagcttgccatcggtttcaagttcggctttcgtggcgttgacctggattttttttaagtcaaaaacatccagaggctgattgagcatcactgacaaaacttccttcacatgtttttcagctgccataccgttccatgagcattgatccgctcatcaaagcctgcccagacctgacaaggatcattgaagaaacgcagagtcaagacgtgttcgccatcattgacgaaaatctcggctagcgaatgatcgataaaaacgtcaagctttaaaggctgatcggctggcagctttacgcttcttaccgtgccaaagtcgggagcgacaggttggccggcatgactgcgatctacgcttagtttaccagtccgcgtgtcaaaacgcacctgtaaaccggcagaaagatcctgggcggctgctaaaaagagcgtgccagcttggtcggcggcgatgtcaacggtcatctcaaactggcggccggtcttgatgtggctgacgttgccattaaacgattcagcctggccgcgcagttctttcattgccgcaacgggtttttgaagcaggcggccgttttgatagtgcagttctttaacctggctcagacagttggcccagttttccgtgtcggtaggataggaaagatctggcaagcctacccaactgatggcataagccttgccatctggcgcgttgaaggcctgcgtggcatagacgtcaaaaccatcatccaggttgacgggaatctgtgagctgttgatcagtttagccttttcatagtcgaaatcatcaccggtcagatacatgtttgggtagatgttttcatagtcggcgacctttttatccaagccctgcggacaaaaaatcaaaacgggatggccgtcaacgtcgatcagattgggacattcgcacatatagcccattgaatcgtccatacaatcaacatagccgacttcttgccagccagtcgtaagctcatcgctgacccatagatcaatgtggccttcttgagtgtctttttcttgtgcaccaatgatggcgtagtatttaccattatgtttcaacaactgtgggtctctaaaatgctcgctgatgtgatcgggattgacaaacagtggctggtccagcttggttacctggttttgtttgtccagccaggctcccagctgataaggcgttctttgccagtcagcatcacgatgattgccggtatacattaagaacagccgatcatcaattacacgggctgatcctgaataagcgccatgactgtcatattcagtgtccggtgccagggccagaccatgattctgccaatgtaccaggtccggtgacgtcatgtgcatccatgactttagaccatgagcggcaccaaatgggaacgactggtaaaaaacgtgccattcattattgtaataagaaaagccgtttggatcgttcagcaagccagagctcggccgcacgtgataatgcatctgataagacgaattggcggcctgtgcctgcagtttcagcagttccaaggcgctgtgcttttcataaggtaagtagcgttgctcgcgagtccattccataatttcaacccctctgtcaatttgaaagcgctgttttacattttaattttaaggagttgacggcttgatgtcaaacgtttatcaatcaacgcttgcggccagtttcatctgacaatgaggaatattatccagtaggtagatctcggatgtctgcttaaagccaaagctgccataaaacttggttagataggcctgcgcttcaatctcaacgtccagaccaggaaaatgcgttgagatataatccaagacggccttgagcagctgattgcccagcccctgcttgcggaatctttcaacgaccagcacgcggccgaacgtcacgtagtcttttttaggcataatgcgcgcgtaggccatcagctcattggtttgatcgtttagaatccgcacgtgaaaacattggtagtcttcatcatcgacttcttgataataacaggtttgctcaacaacaaacacgcgcgtccgttccttaaaaatcgtaaccagttcttgaggcgtcagttcattggtcggcttaacgtcaatcatgataaaacctcctgtaatgtcagtttgaattagcgttattatttacttgtagtctaagtataggtttttagcaagcgaggtggcaatatggagaaaaaagaatcaattcctgaaatgatgcatgcctgggcggttgtcaagccgggaccaatcgatggcgaacaatcaccgcttcagtttgtcttaaagccagtgccgaagcccaaacgtggtgaggttctggttaaggtgctggcctgtggcgtctgtcatactgatctgcacgtcagcgaaggcgatctgccggttcatcagcccaacgtcacgcctggtcatgagattgttgggcaggttgtgtcattgggcgaagatacacagcgctttaagcttggtgaacgcatcgggattccttggtttcgacatgcatgtggggtttgccgcttttgtcgttcggggcgtgaaaatctttgccctcattcagtttataccggctgggatcatgatggcggctatgctgaatatgtcacggtaccagaaggatttgcctatcgaattcccgagcgttttgatgatctgacggctgccccgttgctctgtgccgggatcatcggctatcgagcctatctgcgtgccaacgttccggcaggcggtcgcttgggtctgtacggattcggtggttcagcgcacatcacggcgcagattgcgattaagcagggaattgaggttcacgtctttacaagagggaaagacgcgcagcagtttgctcggcagctgggatgtgcctccgcgcagggtgcgtatgatcaaacgccggtactgcttgattcggcaatcatgtttgcaccagccggccagatgattccccaggcgctggagaatctggtacctgggggaacgctggctttggcaggtattcatatgagcgacgtgccgcaaatggcctaccaggatcatctctttcatgaaaaagtactgaccagtgttgagagcaatacgcggcgtgacggtgaagagtttttgacgctggctgatcgtctggatattcatcccaaagttgccgaatatccgctggccaaagctgatgaggcattgcggcgggttaagcagggcgatattgacggtgcctgcgtcttaagaatcgggacacgcaaataaattaaaatttttttaaattccaccaggtgggcaaaatgcctttaaaacgggattatatgtcaacccattgtcattttgttggtaaaaataattgttaaacgattgacattttgcgaaaagcaggtatgataaataacagtaaaagcgcttacagatgtttttaacatttattttatttggttagcaatgcaattatttatctggggagagcaattatggatcataaacgagtcgcccaaaccgttgtcaaagcggtgggcaaagataacatcgtggctgctgcgcactgtgccacgcggcttcgtttggtggtcaaggatgattccaagatcaatcaaaaaatgttggatagcgatgccgacatcaaagggacgtttgaaacgaacggtcaataccagatcatcattggccctggtgacgtcaacaatgtctatgatgaaatggttaagattaccggtttaaaggaaatgtcaaccgatgacctgaaacaggttgcggctaagaaccaaaagacgaatccggtgatggcattcatcaagctgctgtctgacatcttcgtaccgttgattccagccttggttgccggcggtcttttgatggctttggacaacgtgctggcttcacctggtctgtttgggccaaagtcagtcattcagatgtacccttcgctcaagggaatcgaatcaatggtcaacgtaatgtcggcagcgccgtttacgttcctgccaattctggttgggatctctggtgccaagcggtttggtgccaacccatttttgggcgcggttgtcggtatgatgatgacctcaccgctgctgcaggcgggtcacttctggaacgtctttggtctgcacgtttcaatgcagccttacacgggtcaggttattccggcactggctgcggtttggctgctgtcgatctttgaaaaatggttccacaagaagctgccaagtgcggttgacttcacgtttacgccgctgctgtcgattctgttgactggttttctgacgtttaccattgtgggtccggttatgcgggatctttccgactggatcacagctgcaattgtttggatctacaacacgcttggctgggtcggaactggtatctttggtgccttctactcaccaatcgttttgacgggtctgcaccaaagcttcccagccatcgaaacgcaattgatctcggcctttaagtcgggaactggctatggcgacttcatctttgtcgttgcttccatggctaacgttgcgcaaggggctgcgacgacggcggtctacttcctgaccaagaacaagaagatgaagggcctttccagctcagccgctgtttcagctctgttggggattactgaaccagcaatcttcggggttaacctgaaattgaagttcccattcttctgtgctttgattggctcatgtgttgccagtgcattggccggtatgttccacgtgattgccgtatcgcttggctcggctggtttcattggcttcctttcgatcaatgccaagtcgattccgctttacgtcctttgtgagctgatcagttttgccattgcattctgtgtcacgttcttctatggcaaggcccaccgcaacctgatcgatccagttaccgaagctgaggctgatgctgaagccaaggcagttgaggttcaggctgaggcaacggttgctgagcctgctggtgccgttaagagtgaagaagtgctgagcccaattgatggcaaggtagaagatctgtccaaggttaaagatgaggtcttctcccaaaagatgatgggtgatggcgcggctgtcgtaccaagcgatggcaccatctactcaccagttgatggtaagattaccgttgcttatgctactaagcatgcatatggtattacgtctgatgatggggccgaaattttgatccacgttggtttggacacggttaatctgaaaggcgaacacttcaccagtgcagttgagcaaggccaaaccgttaagcgcggtgacaagctggggacggttgatctcaaggctgttgaagcggctggctacgatactacggtaatggtcgttgtaaccaatacggccagctacgccaaggttgaacacgttgcagaaggcgagatcaagcacggcgaaaagctgattgaagttgccaaataacgactaaacatctttgcattaatgctaaaaccgctcgatgactgggaatcgggcggtttttgatttgcttggcagctttggcaattagaatcagcatcgcggcggtccagaatgtctgggtcggcataatcctggtcatggctaagaatctgagcaaggcggataattcggagtcgcgtagtcagtcaagcatctgatcatcatcaagaagcgcttgtctgtcagttgtaaaagtcgtcatcaaacgatagtggtggtattatgcaaaaaaatctgcataattttagatgatcaaagacgattacttactatcggtgaaaaagcgatgcatagtaggtaaaaattaatgtatatcaagttaggggagtctaacattacctactattaactaaaaatcccctaatcgtaggtaattcacaaagttggtctgacccaatcaaccctagaatatgcattgttacctacgatttgaagaaaagctgccaaaagtaggtaaagtttggctgaatatacagctgcctactatgggtgaaaaaacaaggtaaagtaggtaaattcagtattatcagcggtcaaagattcagttctttcacaaagttggtcgtctgacagtcgcgatgagccagtaagctgtcgttttgatcctaacgataaaatatcggtggctttaatatgtttggccgatattggttgactgttgctgcgtcattggacttgaatttctagtttgcaaaatggttttgggaagctaaatgctgttgaaattatcattgaggttatggagcttggctgccggagctgttttttcgtttccgatttctgcggagcgtacggtatatcaatagatgccaagccggtcagcagttgtcttaaaatttttcatcgtgataaaaacgttgatcaatatcagatcgtgttaatccaaaataatgatagaattaggtataaattgattttctatattagcaggaggaaaacatgacctatccacaattgaacctggcagatgccaagggacctaaagcaaccatcaagaccaaccatggtgacgtaaccattcagctgttcccagatcaggcgcccaagacggttgagaacttcattacgctggccaagcagggctactatgatggggtaacgttccaccgggtgattcccgaattcatgattcaaggcggtgatccaaccgggactggagctggcgggcaaagcagcttcggcgcaccgtttgaagatgaattcagccgggagctttttaacttcaatggcgcgctgtcaatggccaatgctggtcctaataccaacggcagccaattctttattgtcagtgctacacaggtacctggcaatatgattggtcaaatgaagcagctgggctggccagccgaagtcatcgccaattacgaaaagaatggtggcacgccatggcttgatgggcaccacaccgtctttggccaggtagtcagcggcatggacgtggttgatgagatcagccgggttgctcgtgatgctgctgacaagcccaaagaagacgttgtaatgacgacggttgaaattacagaaggataatatagatacgatactgctaacggcttgcttgagctgattagcagtattttttattgctgctgattaacttttaaatgtaaaatgcctaattgatcaatcaagcgaaaaatttttagtttttttgaaattaattaaagattgtgcaaaagtttcaaaaaattaaaacagcttaggaaaggcattttaatgggggattataaggaattcttataagctctatttgttttgactatatctaattatgcggagtaaagttggaatcgtaaaaaagcaacaacgcttacatcactttatttatatcgcatgttgaattcaattggaggttttaatatgccagaatttcgtactgaagaagatactctaggtccagttcaaatccctgctgatgctttgtggggcccgcaaactgaacggagccgtcacaacttcccaactggccaatacatgccaatcgccatcattcgtgcactgctgaacattaaaaaggcagctgcccaagccaacatggaaaccaacgctatttcagaagaaaaaggcagcctgatcgttaaagccgttgacgaactgctggccttaagcgatgaagatctgcgcaaggacttcccattgaaggtctaccaaaccggttctggtacgcagaccaacatgaacactaatgaagtcgttgctcacaaggctatgcagatcaaccctgaagtagagatcctgcctaacgatgacgtcaacaagggtcaaagctcaaacgacacgttcccaacggcaatgaacgtcgtagccttggaagccttggacaagctgaagccagccgtacagcacctgattgacgaactaaagatcaagcaggacaagtactgggaaacggttaaggttggccggacccacctgcaggatgccgttccattgacttttggccaagaagtctctggctatgtggctgcgcttgaacatgacctgaagtacattgaacagctcgaaccaacgctggaagaactggcaattggtggtacggctgttggtactggcctgaacgccgctgaaggcatgcctgaaaagatcgctgaaaagctcagccaggcatatggtctgaagctgactgccaagagcaacaagttctacggcctgtcgcatcactctggtcttaacgtggttcacggagccttaaagacgctggcagctgacatgttcaagattgcccaagacatccggttcctggcttctggtccacgggctggctatggcgagctgcacattcctgccaacgaaccaggctcttcaatcatgcccggcaaggttaacccaactcaagctgaagccgttacgatggctgctctgcgggtctttggcaatgacgtggtcgtttcaactgcctcctcacaaggcaactttgaaatgaacgtcttcaagccggttatgatcgatgccttcttggaatctgccgacctgctgacgggtacgacgatgggctttgccgacaagatgattcatggcttgacggttaacgaaaagcggatgaaagaactgctggacaactcgctgatgaccgtgacggcactttctccacacatcggctaccatgacagtgccaagattgctcaagccgctgacaaggccggcagtacgctgaaggaagctgccttgaagtctggcaaggttactgaagaacaatatgacgaatggatggatccgctgaagatgaccaacgctgatcgtcatgactacgaagactaatcaaaggagctgcaaaatggcacaatttcaaaccacgccagtcagtcaactggcagacagctatgatgcggtaatcgttggttctggcggtaccggtctggcagctgcaattcaagcccatgaactgggaatgaacgtagccgtactggaaaaagaagaacagcttggcggtaataccaaccgagcatcttctgggatgaacgccgccgagaccaacgttcagctcaagcatggcattattgacaacatcaatgacttctaccgggaaacctacaaagacggtggcaagctcaatgataaggatatgctgggattcttcgtcgttcactcgccactggcaatcgactggctggctgatcatggcatcaagctggaagacgttacgattactggcgggatgtctaaaaagcggacgcaccgcccagcttccatggcgccaattggtggattcctggttaagagcctgctggatgtagcggctcaagagaagattccggtcttcaacaaggtaaaggtcgaaaagctggtcaaaaacgatcaaggcgcagttgccggcgtagttgccagtgttgatggtcaaaccaagcagatcaatgccaaggccgtcttactggcaactggtggctttggggcctccaaggaatacatcaagcgctaccgtccagatctggccgactacaagacgaccaatcaacccggagcaaccggtgatggcttgaagctggctgaagaggttggcgcccagctgacgcagatgaatttcgttcaggttcacccaaccgttcaacaagacaatccacatgtctacttgattggtgaagccgttcgtggtgaaggcgcaattctggttaacttccaaggcaagcgtttcgtcaacgagctgaacacgcgcaagatcgtctcagaaacgattaccgctctgccagaacacagtgcctatctgatctttgaccaaggcgtgcgtgatcatgccaaggctatcgagttctacgacaaggttgggctggtcgttcatggcgacacgattgaggatctggctaagaacctgaagatggatccagctgtcttgaagaacacggttgaaacttggaaccaggctgtcaaagctggcgacgacaaggaatttggccgaacgacggggatggatcgcgatctgtccaagccaggctactttgccattcatatcgcacctgccattcactacacgatgggtggaattcacgtcaataccaagacgcaggtacttgatggcaatggtgacgttattcctggcctgtatgcagctggtgaggtttctggcggcctgcacggcaacaaccgggtcggtggtaactcaatcgctgaaacgatcatctttggtcgtcaggctggtcaacaagtaacggtttatgctcgcgaacattaattttctgctttgagtagcgtacgcgggtctgaataaattaatatgcgacagggttggtaggacgctgctctgtcgtattcttagccattattttgttgaaattatcacaagaagcgtgtacaatactaaaatttgttggaaaattttgaaaatagtgctgtaagtgctttttcagtcgagtagagaggaaaatcagatatgtcaaaagttatgctggttggcgatggtgcagttggttctgcttttgccaacgatttactgcaacacgttagtttagatgaattgatcattgttgatcgtaagacgcaaaaagcggccggcgatgcaatggatctggaagacctggccatgttcgatgggacgacggtggttcgtgctggcaagtatgaagatgcagccgataccgacgttgtagtcatcacggcgggtattccgcgcaagcccggcgagagtcgtttagacctggtcaacaaaaacgttggcattttaaagacgatcatcgacccaatcgttaacagcggctttaagggaatctttgtcgttgcttccaacccagttgatattttgacgacgctgacgcagcggatctctggttttccaaagaaccgggttatcggtacggggacctcgcttgatacggccagactgcgagttgcacttgccaaacgctgccatgtgcctgtacgcgaaatcagcgttgacgttttaggcgagcatggtgatacgtcgtttgccaactttgatgaagcaacgattgccggcaagcctttaaaagagtttgctgatgtcagcgatgaagagcttgcagaaatgcagtccggggtcaagaaaaaaggtggcgcgattattcgttccaaaggtgcgacctattatggcgttgcccgctgcctgtctttgatttgcgaggccatcatcttcaaccgttcaatcgttttgccattatcggctcctttgaatggtcagtatggcatcaagggcctatatctgggaacaccggcttccgttaaccggactggaattcgctatgtcattgaaacgccgctttctgaacgcgaggtagcggcaatgcagcactccgccgccaaaatgaaagaagttttggatggcgttgagctttagattaggattttgagacaacctttttggaggaaatatcacaatgggtttagcaaaagttaagtataagggctttattgccccattaattatcgggctgctgatctggttcacggctccagttcggccagccggcgtttcagttgccgcttggcatatgatggcaatctttattgcaacgattgctgcctgcattacgcagccactgccaattgccgcggtaacgctgattggctttacggtagtagtaatgacgaaactggtgccaatggatgatgctttgatggccttcagcaactcttcttcttggctgattgccatggcctttatgttggcacgtgggatcatcaagactggtctgggtcaccgaattgccttgtatctgatcaaggcctttggtaaaaagacgcttggtctggcctatgccgttggaggaatcgatctgatcacggcgccagctacgccttccaacacggctcgtgccggtgggatcgtgtacccactggttgaatcactggccaagacgtttggttctgagccaaatgatgattcacgcaaaaaaatcggggcgttcttgacgttctctgaatttaacagcaacatcatcacttcggctatgtttatgacggccctggcacctaacctagttatcgttgccttggctaagacgatgaagattcacattacctggctgggctggtttacggctagtgtcgtgccttgtttgctgctgtttatcctggtgccattcgtgatctacaagatgtatccgcctgagatcaaagaaacgccaaatgctcgtgaatgggctgacaagagcctgcgcgaaatgggaccaatgaaggtttctgaaaagatcatggcaggcgtcttcgtcttaacgatcgttttgtggatgatgtccaacaccttgggcattgaagcttcattcgttgctttcttggcaatctcactgctgctgatctttggggttttgactactaaggatctgctgagtgaaacaggtgcctggaacgttttgatttggctttcaattctggtcttcatggcaggcgagctttctgaaatgggtctgatcaagtggctgtccaagtcaattgccagtggtctgcatggtatgaactgggttgcagtgctggcaattctgatgatcatctacttctacgctcactatctatttgccagtgccacggcgcacgttacggctttgtacgctccgtttgtcggggttgccgtttcggcgggggcaccagttatgctggcggcaatgatgctggcattctgttcttcaatcatggcttcgactactcactatgccaacggtcccgcttctattttggcaagctccggttacgttaagcagggtgaatggtggcgcatgagctttgtcttgggtctgctttatctggtagtcttcttgacggtagcacctctttggatgaaagttatcggcatgtggtagacatgcaaaaaagcgatccggtttggatcgcttttttgcattgaaaggaaagattatgaaatttattacatcagatcacgtacgtctggattatgatgatgaaggaactggctatccgattatattggtcagtggattgggaatgtgcaaggaaatctggcggccgaccaaggaatttctgctgcaaaacggctatcgggtggttacttttgatgcacgcaatcaaggcgcctctgaacatacctttaaaggggcgcgcatctcgcggcatgcaatcgatgtttatgaattgctgcagagtctgtcgattgaacattgcttggcagtggggcattcaatgggggcttcgacgatgtttggctatgtttcgctatttggccgtggtcagttggatggcctgattgatattgatcaaagccctaagatgattaatgacgagacgtggcattatggctttaagaatctgacctgggatgaattcccggcagcgctgaaaatgccgcttggccgtgctactgccgtcaagattgacgaggctacggttaatgccgttcgtcaggccaatatcctgcatccgtatgatgaaagcgccaattttaattttgcgattgaccatgcctttcaagactggcgcgatatcattgcattgatgccggtaccgtttttggcggttgctggtgaaaagtcgccatactttaatcccgattttctgcaggcaattcagattctaaatgaaaaagcacagacacaggtcgttgccaatgctggtcatgccgtgatggcagaacagccagctgccttcaaccagattttaaatcgttttgcgatgagcgttcagtcataaaaaagcgccgcctacagcagacgacgcataaaaatcagttgttgtccaattccagcaggactcggttggctacggcctcattggtaataatgtcggttaagagactgccgcgtaaggctcccagcatggcgcgggccttaaacttgcttttgacgacgccaatgcggcaaggtacctctaaaagtgcagctacggaggcaccaaatagtttgtcgctctttggcgtcagaatctgaccaccaatgttgtaggggcgaccgtaaagcataccaacgatttcttgacgatcaacgttctcgaaaatttcgttaagactttgatgccagacccgaatgctgttgactgagtcaatcgtgccaataccggtaaaaagcatgtccatcttaccgcattgttcaaagacgttagccatggctggttcatctttaagctgttctctgacaatgtcgttgagaatgtaaagtggagccggaatggtcaggtaactggatccgtacttggctgcggcgcgctgaaccaacggcgttgcaccaatcgctgagctgtacttgagattgtcgcccataaactgggtaaaaatcaggtcatcacggacgtcggtttggaaacgattgatgatgttcatcagcgttccaccccagctgacgccaacgatctgactgcctttaatatggcgctgaatctcggccgcggcaaaatcgatgatgttttcgatatcagcgttggtcgtggctgcgtctttgatgatcatcgtgttggtgtgcggaaagagctccgcaaaacgagtctctaattcagtgttgcgatcgattggtgaattaatggtgattctaacgatgccagccgcgcgtgcctcatttaaagccttggtaatcagataacggctcaattggtatttttccgacagctgggtgatggtcagctgcccaagataaaagtcgcgggcaatatcggccagctgtccttgctgtgtgatgtcgttcatattaatgatccttctttctaaagacgattctgaatctcttttttaataatatcaaacttttttaattttgaaaaaatattataactatttgaaaaagttaaaaagggagagtaaaattactgatgagagatttgaaataatagatgagtttgagaatttgataacttgaagggatgattagatgacttcagaagaagatgctattcttcgtctgcatcaagcccataccgggatgctggacattaaaactgattttgacattgaggaccgagcagacctgcaaaaggcttatacgcccggggtagcggtcttatcaagaatgattgccgaaaagccggaactcaaagacaagtttacggtcagcggcaaactggttgccttgattactgatggaactgccgtactgggacttggtaacgtcggcccggctgccggcctgccggttattgaagggaaagccttgctgtacaaggatctggccaatatcaacgccattccgctggcagttgatcaagttagcccaaaagaaatcatcaagacgatcaaaaacatctcgctatcatttgctggcattcatcttgaagacattgccgcaccgcgctgttttgaaattgaaaatgccctgagcgaagagctggacataccagtctatcatgacgatcaagaaggcagtgccattgtggttttagctggtttgatcaatgctgccaaggtcgttggcaaaaagctgacggatctgcgcgtcgtaatcaatggtgttggtgcctctggactggcaacggcgcgcctgctgtatgcggccggcatcaagcacttaacgctggttgacgttcacggcgtcattaccagtgaggattaccgcgccaatgattatcagcggttgtttgccgctaagttgggaacgccgcaaaggatggaaaatcaaaatattcatgatgccatcaagggacaggatgcctttatcggactttcaaccggcaatgtcatcaatcgtcatgacgtcaagcagatgaatgagcagccaatcatctttgctctggcaaatccgcatcaggaaattgcacctgaaaaagctaaggaagccggggcagccgtaattgctactggatccagccaataccctaatcaggtcaataacattctggcttttcccggactgttcaaaggcttattggccagcggcttgaaaaaggttgacatggatctgcaaaaagcggttgctcaggcactggccagcgtggttgcggaaccgactgctgagaatatcgttcccagcgtctttgatgagcgcgtcgttccaaccgtagcaaaagcggttgttgattatgccagtcaatcaaaataaaaaggagtcgtcctatggaaaatcacattgttgatctgcatctgagtgatcgagctacccggcagaaatggcagcagtttttggaatcgttgggaattcataacttttcggatgctgaggtcgacaagatcgattttactctgggactgcttgatgaacaaggccagttggttggtacgggatcagctgccggcaatgtcttgaaatacattggcgtctgcaacaaagaagccgtgccgggagccaggttcaatgctattgtcagcgccttgacgaatcgactctttcaagaacatcgctttcatttgtttgtctttaccaaggccagatattccgcaagctttcagcacctcggctttaaggaactggctcattcggatgttgccgcctttttggaaaccggtgatccgaacgttgatgattatttagccgctgttccgcgtgtggacggacaagcgactaaaaaagtagcgggcatcgttatgaatgccaacccctttaccaatggtcatcgctacttggtcgagcaggcagctaaagaaaacgatctggtctatgtctttgtagtcaatacggatctgtcgctgtttaagaccagtgaacgattcgaactggtaaaagcggggacggctgatctaaaaaacgttattgtcgttgacggtggcgattatatggtcagctacgccactttcccagcctactttttggaatcagccgaccagacgattcactaccagacaaccttagatgcccgcgtctttcgcgatacgatcgcaccggcactcaatataaagacgcgttatgttggcagcgagccgttatcacggacgactggaatctataatcaagttttgcagcaggaactgccgcctaaagttgcgttaaagattattgatcgcaagacggcaactaatggaaattatattaccgcgaccgaggtacgcaaatgcatcaaggatgacaatctcgatgccatcgtggggctcgtcccagcaacgacgcagaagttcgttgaagaccatgttgcgatacttcaagagcggatcaaggaaggaatgaacatcaatggaaattaaggaaaccgcagtagctggtaccttggaatcatctgatattcaaatcatgctgtccaagggtacggatggcattgcgattgatttggaatcagacgttgccaagcagtttggcacccagatcaagaaggtcatcactgaaacgctgacggcaatgggaattcaaaacgctaaggttaaggccgttgacaagggcgccttggattgtgtaatcaaggcccgcacgattgccgctgcgcaacgtgctgccaagacgactgatgaacctgcatgggaggtattgtaagcatggctgaaattaaagaacgcttgcgccggacgatgatgttcgtacctggcaacaacccagcaatggttaaggatgctggtatctatggtgccgactccatcatgttcgacttggaagatgccgtttcaatggctgaaaaagatgctgctcgtgacctggtttacgaagctttgcaaacgcaggactatggcgacgcggaactggttgtccgggtcaatggtcaagacacgccatactatgctaatgacgttcgggccatggttaaggctgggatcgacgttgtccggctgccaaaagctgaagatgccgaaatggttaagaagctggatgctgacatcacggctgccgaaaaagaatttggccgtgaagaaggctcaacgatgctgatggctgccattgaaagcgccaagggggttatcaacgcctaccaaatcgcttcggcatctgatcggatgatgggaattgcgctgtctgccgaagactacacgactgacatgaagacgcaccgctacccagatggtgccgaacttgaatttgcccgcaacatggttctgcatgctgcccgggcggctggtgtagctgcctttgacacggtcttcaccaacatgaacgacacggaaggcttctaccgtgaaactgaatacattcaccagcttggctttgacggcaagtcgctggttaacccacgtcaaattccaatggttaacaaggtttacgaaccaaccaagaaggaaatcgaaaacgccaagaacgttgaaaatgctattaaggaagccaagctcaagggttccggcgttatttccatgaacggtcaaatggtcgaccgtccagttgtgctgcgtgctgaacgggtgatgcgcctggctaaggcatccaacctgattgacgaggagggaaactacattgaaaaataatgtaaatcgcgaactgccagaagatctgatgaagcagctcgactacaagccatttgaaactaccgaaatcggccatcccgaggttcaacgggttgcgcctaaggttactgtaacgactggtgacgacaaggttgttgaatcactggaagacgttgttaaaaagaccgttaaagacggcatgacgatttctttccaccaccacttccgtaacggtgactttgtcttcaatcaagtaatggacatcatcttgaagctggggatcaaggacctgacgctggcaccatcctcactgactggtgtcatgaacgacaaagtgattgaagccatcaaggccggtacgattaccaacattaccagttcagggatgcgtggctctttgggcgactttgtatctcatggtggcttaaagaaccctgttatcttccgttcgcacggtaaccgggcgcgttcaatcgaaaacggcaacatcaagatcgacgttgcctttcttggggtaccaaactcagatgcgctgggtaacgctaatgggatgaatggtgatgccgtctttggctcattgggctatgctttgatggatgctcaatatgctgacaaggtcgtcttgctgactgacaacattgtcgactaccctaacacgccagcttcaatcaagcagacgcaggttgactacgttgttaaggttgacaaggtgggtgaccctgacaagatcggttctggagctactcgtttcactaaggaccctaaggaattgaagatcgcctcaatggtaaacgacgtgatcgtcaactcaccatacttcaaggatggcttctccttccaaactggttctggtggtgcagccctggccgttacgcgattcctgcgtcaatccatgatcgatgccggcatcacggcttcatttgctctgggtgggattacctcgccaacggttaagctgcttgaagaaggcctggtcaagaaggtaatggacgttcaagactttgacaagggtgcggctgcttccatgaagaacaaccaaaaccaacaagaaattgatgcttcctggtatgctgatcctgacaacaagggggccatggttgaccagcttgacgttgccattttatctgctctggaaatcgacaccaacttcaacgttaacgttatgacgggttctgatggcgtgattcgtggggcgattggtggtcaccaggatgctgctacctctaagctgacgattatttcggctccattggttcgtggtcggattgctacggttgttccagatgtaacgacggtagttacgccaggcgaatccgttgacgtactggttactgaatacgggattgccatcaaccctcgtcgcaaggacctgcaggatgccttgagcaatgttcctggtctgccggtctacgacattcacgacctgcaaaagctggctgaatccaaggttggcaatccagaaccactgcagtttactgatcggacggtggcactggttgaataccgtgatggaacgatcattgatacgatcaagcaggtcaaggactaattagtctaaactgattaaaattttaaaaaccgcgactggcatttaaaatcagtcgcggttttttaccaaaattgaggatatgatttatggaacagacaagcgctaagctggttaatgatgcgattagagcaatgatttacgaagtctctgtcaaccccaagcctgggctggtggatccggtgtcttctggcccacaccctgatatggatgtattcttatttattgacagtgcccttagtttgcatcattattttgaacaaagcgttgatttgggaatgaattttacagcgactgatctgacgcttatgtttaaaaaactgcgaacttttgggattgaagccgaaaagacgatgtttaaggcaaccaatggcattaatacgcataagggcgcggttttttcgctcggtgtcctaacgtgtgccgaagcttaccgtatcaagcatccccagttggatctgaccacgatcgttaaacggatgcttaaaggattgacagccagtgattacgatattgaaaagctgcatgccaagcccgttgaacagctgacggccggtgaaaaagaatttctgcgctatggcatcaaaggtattcgtggtgaggctgaggctggctatccaactgtcatgcagattggcgtgccagcactgaaaaaaagccagggaacaacgatgcagcgcttgttggatacgtttatgcatatcgtcgcgcagactgaggacaccaatctgatcaaacgggctggtcgtcatgacgttgttgaagaggctcatcaacaggcaaaaagatatttagagctgggcggcacgcagacgcaggccggccgcgactatctggcacggctcaatcaagaatatctgctcaacaactacagtctgggcggttcggccgatctgctgatattaacgatttttattggtctgcgtcaaggaatcttacggccagaagccatgcaatctgaagggatgatttgatgaatacgcgggatctgcagtattttcaagcattggtcaagtataaaaactacacgcgcgtcgccaaggaattcggcgtctcgcagccaaccgttactcaggcgatcaaacgattagaaaaagaatttgatgcccaattagtctatacggatcgtgctcaccggcaaaacatgattacgcgcagcggtcagcttttggcggccagtgctaaggctatcaatgaacagatctcgctggcccatcattcgattgatctggttcaagaacggcagattcgctttggcctgccgccgattatcggtaagcttttggtagccaagattgccaagaaagtaccaggatccatcatgcggcgcgttcagatctgtgaagccggctcccaggaactgctgtccaagctgcttaaaggcgaaattgacgttgccatgctggggtcagtggcaccgctggatgaagaaaaggtctatgtacagctcctaaccaaacgtccatacagtattatggtcagtgccaaaagtcccctggcacagcgaaaaaagatcagttttaaagaactggccaatcagcatttcattacctatgacaagcagtacgttcatgtggccgcaatgcgttcctactttgcctatgcgcatatcaagccaaccgtagccgtctacaaggtacctgatatttcatgggttaaggaattggtcagagaaaacgtggggattgccttaatggtccgggatgccgctaaaaatgagacgggcatcgtgcccttggagattgacgatccattgccagaatggttctatatctcactggcaattcgcaatggctacgtccttagtgatgaagagcagcactttgtaaaactgctgggccaagttgctaaagaagacgaatagtaaagctgaatgaggcttggtatctgaaatcggatactaggcctttttttcatgacttgtgatcattaaaataattttttcgtccaggcagctttaatcgttttataatgataagaagtttgacaatttttgatatcccgactaaggagcgatttaaacaatgagaaaactgccgatcgaacaaggccagcccaaaagcgataatgaggatctcagcaactatcgtcatcatatggcgattcactggcatgacttctacagcagcgacaatgtaacccccgcccaaaaagccaatttggttgagcgttcgacaattgttgggcgcattggcatcatgatgctggcttgtggcacgggagcctggcgagtacgcgactcgatgaacgtggtctctcaaaagctcaatatgacctgttcggctgatattggtctggtttcaatcgaatatacctgtatggacgccaataacagctatacccaggctttatcgctgcctaatactggagtcaatacgaccaagctgaatgcgctggaaagctttgtcaaggagtttgaccaacggggcgatcactggaccgttggcgagattcacaaacgcttggacgtcatacaccggatgaaaggcaactattcgccgctgcaggttggtctggcggcggctttagcctgcagtgcctttgtctttttgctgggcggtggaccaattgaaatgatctgttcattttttggcgctggcatcggtaattacgttcggcgcaagatgattgaccgtaagctgacgctgtttgcctgtctcgcgacttcggtagccgtggcctgtgtaatctatgtgatggccctaaagcttttaaacatgggaatttcgcttaatccgcgtcatgaagccggctatattggggccatgctgtttgtgattcctggttttccattcattaccagcggcttggatctttctaagcttgacatgcgttccggtttggaaagactggcctatgccgtgatgatcattatcgtggctaccttagtcggttggctggttgccatgctggtgcatctcaagccggaaaactttgaacccttggcactttcaccactgatgctctttttactgcggctgccggccagcttttgcggggttttcggcttttcgatcatgtttaattccacgcctaaaatggcagccacagcaggtgtaatcggcgcaattgccaatacgctgcggctcgaactggttgactataacgtaatgccggcaggggcggccgcgttcttaggggcgttgacggcaggaatcctggcctcgtttgttcgtgatcggcttggctatccgcgaatctctttaacggtaccggcaatcgtgatcatggtgcctggactttacctttatcgggccatgtataatatggggctcacgtcgatcagcgttggtgccttatggattaccaaagcgcttttgattatcgttttcttgccgctggggctgatcgcggcacggattttgggtgatccgaagtggcgtcataccagttagtaataccaaagatttctgttattataattgataaccgaaatcttttttatttatgaaggtgaaagcatgcttattgagtatccgccatcactgctgcagcaggctgaggattcattaaaaggtcatcatctaaccggatttgtagccgggcagggtcccaaacatcctaagattatgctgattggcgaagcgcctggaagagaggaagctaaaaccggcgtaccgttcgttggtgcttctggtaaagaattgatgaagctgattgaagaatatcttcacatgaccagagaagacgtctatattaccagcgtggtcagaagacggccttattcaatcaaaagggtcaaagataagaaaaccggtgcagtcgttgaaaaaacgcccaatcgaaccccaaccaaggctgaggtctatgcctatgcgcgtctgtttgactgggagctggaccaggtgagaccaaagattttaatgccgctgggaaataccagcctgcagcgcttattagggccaagtacgaaaattggcagtctgcatggtcagatcctacattgcccgattcaaagagcagccagtgatcatcaaggctatgtcatgagcgatcagagctatacggtgattccaatgtatcatccagcagcctttttatatgcacgcaagctggagccgatcgttcgtcatgattgggaagcaattgcacaaaagctagatcagttggaaaccgataaaatttaaaaaaatcaaataaaagttagcggctgattcgtgataggattaaaggcaaagacaataagaaagtgaatttcagtctatggatagaaaaaattttgatcatcatattttagccgcaatggccgataacctgggcaacagcctgcgcgaaatggcacgttgcggacattcgcgatccaaaagggctaccttaaccgagatgagtattcagctgtcaggcttcaagcagactttggctgatcctcaaaaacggcaggagctggtgacaagctgccagcgagccaatcgagagcctttaaagatcccagccgacgttcagttcagcgttcccgtgaaactggtgacagcgccttacccactgatttggctcaatcagaatgctcaagcacgtaatctgatcgtttatcttgccgggggcgcgtttattcagcggccgttaaaagggcactggcagtttttgaatcgtttggcaaaagcagctgatgccgagatcgtggtacctgattacccattggcacccgatcatgactttaaggatgcctatcaagagctgcttgatctttataaatggctgtatgatcagcggccagtcagcagcattatcctaatgggcgactcatcgggagcagggctggcagctggtttctgtgaaaatctggcacagcaggggttgccgcaaccaggtcggctggtgctgatttcaccatggctggatctgcagctgggaaacccattgatcaaaaagtacgcagccaaggatcgtctgcttgatcaagaaggcttacgggcgttaggaaagctgtgggctgggcagactgatccccgcgatgcacgtctcagccctttgaatggccccgtggatcagctgcgcaacgttacgatctacatcggcacgcatgagatcatgtatccagacgctattcactttacgcggcggctaaaggcagctggcgtcaacactaataccgtgattgggcgtgggatgtttcattcctatccattgtatccaattccagaatcagagcatgtgattatggagatggctcatgattttgatcaacaataggcttatttggactatcataactatgaggtgataaaaatgacaaagacggcagcagtagtttttgcagatggctgtgaagagattgaaggcttaacggtagtcgacgttttgcgccgtatgggggtaaaatgcgatatcgtaggcgtcttaggatcggaaattcacggagctcatcagattgattttaaggctgacaagctaatcagtgatcaactgttggattatgatatcgtggcctttcctggtgggtatggcaatgcgcagaccttacgcgataatgaccagttgatggcaatcatgcagaagcgtcagtcgcttggcaaatggtgtgcggcaatgtgcgcagcgccgattgcactggcacgctatggattgctagatggtcatgactatacctgctatccgggaattgaaaaagaaacgcagcagttggcaccaaacggtcattttaaagaagaacttacggttactgatcaagcaggccacctggttaccagtcgtggtccggcaacggcatgggcctatgcatttgcaattgctgaggcactgggactagataccaagacaattaagcaggatacgctgtacgactatcttaaagaaaacatctaaaaaagatccggagaattactctccggatcttttttgcttgattaccagcccatttcagcagccttagccggcagcgtaagcttgccagctgccagctcgctaaaggcttgatcaatcatcgtaaaggcctgatcaagctgagcctcggtaattaccaaaggcggctggaaacgtagaatattgccgcgcagactgatgatgatcgcacccagttcaaagattcgatacatcaatttaaccgtggcattagtgtcgccttgaccggttgccggatcaatgatatcgatcccgccatcaagaccatacatccgcacatcgccaatgaagtcgaacttttctttttcggcctcaaagaatgccttggctttttgccccagcttagctgagcgttccaacagatgctcttcttcaaaaacatccagcgttgcgttggcagctgccgtcgtaactggattgccggccgtcgtaaacagatgcgctggcgcaccaagcgattccatgatttctttgcgcccaaccacggcacttaaaggcaggccggatgccagcgacttgccgactgacatcagatcaggctcaattccgtcaaagttttgaatcgaccaccatttgccggtgcggcccatgccttggttgatttcatcaaccgcgaacaagatgccatgagccttggcaaagtcatagaccttcttcataaaggcaggcggcgtcttgcagatcccaccgtcgccttgaatggcttccatcaagataaccgcggtttcttcagccggcaggtaggtttcaaatggccgcatgaactcacggaagaaacggtcaacgaaatgttcttcactttcgtcgggctcgcgttcccaaggagaagggaaggggaccttaacaacgcccggcagcagcggcgccattttgcggctcatgttcatgctgatgctggaaagcgacattgagccataggtagacccatgataggcaccggtaaaggccaccagatactgacggccagtataggcacgtgcaaacttgatgatggcatcgttggcatcggagccggacagtccccatgaaacctcaaccggaccgctcattggtgctaatttagccaaacgcggtgccaactgagcttcttgagtgttggcaaagtaggctggcgtatactggatcagcttggccgcttgatcctgaattgccttgacgactttagggtgggcatgaccggtattggttgaactggcactggccaaaagatcaatatagtcattgccgtcagcatcggtgattactgcgcccttgccatgatcgataacgatatcgtaatagttgatccggccagaagaagcaaacgctttggcttcttcttccagcagatgcttgttgttactgtccgtcatttgacagccgcccccttttaaagcttacaactagtcctttttcgtcttattcaagtaagagtgacgcattccgtaagtgaagtagattaccagaccaagcaggaaccatacaccggcatagatcttggcatcaatgtcaagtccccagaacacgaacagagaagccaagaatgccaagcatggcattacagggtagaatggcatcttaaaggctggcgttggaatatctttaccttcacgagggcgcaatgcatagatccctaatgaaacaaacataaaggcgatcagcgtccccgcagagatcaactgtgataagaatgcgaatgggaacatggcaccaatcaggatggcaatgattgccaaggtccaaagagcatggttgggacggttcttttcgtccagcgtccccaagaacttaggcagcatgccgtcacgaccgaatgagtagatcaaacgagaaccagccatggtcatcccaatcaaagcagtaaacatcccgacaacggcaacgatttggacaaccgaagcaacgactgggtgaccaattgaacgcagagccagaccaactggttcagcagagttggcatacctttggtaaggcaaaaccccaaccagaaccaaggctacggcaacgaacagaaccacggcaattgccagtgagcccaagatcccgcgtggcatcgtcttgccagggttgatggcttcggcagagttggcggcaatggagtcaaatccgatgtaggaaaggaagatcatcgaaaccccagcgtagataccttgccagccaccaaaagcaccattagaagtcatccggtacttaggaataaatggaacgaaattactgtgcttaactgcagttgcaccaacgacgatgaacagcagaattgccagcaccttcagcgtaaccagtacgttttcaacacgggcagcatccttaaccccttgggaaaccaggatggcaaccagtgcaatcacgatcagagaaatcaggtcaacgaccccgccactggtaccaaaagcattggaaagtgaagccggcagcttgataccaatgttggcaagcagtggccgcaggttggcagaaaggccagagccgacaaaggccaaggcgataaagtattcagccagcagtgcccaaccggcaatccagccgaagaattcaccaaatacaacagtgatccatgaataggcggaaccagcaaatggcatggcagccgacatttcagcatatgcaaaggcaaccagaccagcaacgacagccgcgatcacaaacgagatggcaacggctggaccggtatgcatggcagcaacctcaccaggtaaagtaaagatcgaagtggacacaatcgtcccaacccctaaggccaaaaagtcccgtacgcgtaatgagcgaataaggtgactgtccttatcttggtagacactggggtcttcttttcgagtgatagttttccaaaatcccataaatcttcctcctgaactaagtgagacaatcctaattctgcaaaaagttccaatatgattgcaacgcatccagacttggcgggaaaaaccaagcgataaataattatatttaaattagaattctctaatgttttaaattataactataatttaaacagcttgcaagaactttttgtgcattctaacaatctgcctaaaacgtgtaagcgtaaacttatcaaatgtgacgcgctgaattaagtttagcaatgtttgattaaaaattaatttttttaattcttatcgaagaactgccccccaattactgattaaaaattggtcaaccaacaaaaaagccgcctcatcttaagagacgaccttttaatcaatgtttgagaatatcttcaattagctgcggtttcagccgccgactgtgatcagggtttgaacgctgattgacgacactgaccagggccagcattgaaccgaccagcgagctctttttacggtagacggtgtagcgtgacagccagatatcggcatacttttccttatagttgcgcagtccttggaagccatagagccgatagccgtactcgtaaataaagtgcgcggccttttcttcgatgaaactaaactgtgattcgcccacgttgctcaatggggccattcccagatcaaaatattcgtagccggctttttgaccatacagaaatagattgacgaaaatcatatccattatgcctgatggtgccagatcgcgatcgtgacgcatcaaatcgatcgtcagaatctgtttgcctccggtaggcatcaacgttgcaaaggccacaatctgctggtcttgatttttaacgatggcaattggggcttgctgcaggtaatattcatcaaaaaagcccaatgaaaagcccttttcaacctgcttgcccagccagctgtcggaaacgtgcttcagttcttttaacagatcttggttaaatggcggttctactacatcgaacgtgtagccttcacgctcaaacttgtgcatcaaggcgcgctgtgaacgctgacgcttaccggcaagcgtgaagtcagccagtttaaccagaccgtcctcaccggttttaagaaagtcaaagccaaattcgtgcagcagcatggttgtcgactgtccgacctcataaaataccagctgatagccatagcggtcggcttcaacgatgaactgtctcagggcatcgtgcagcacgctttggtcgccgactggttcgcccatgatgatcagcttgtcatatttgcgtcgatacatgaaaaagagccggtcttcgttttcaacttgataatagtagagattcttatcgcgcaaaaaagccaggtgactggtctcattgccgccaaagcgctcaatcagctgtcggcagcgttgggcatcgaatgaatgatagccgttaaacggatcgtagccgctggtgaagtagcgcagaatggccagcatgaccaaaattcctaagatcaagccgatgaaaccggagaaccagagactttcaccggggaagaacatgaactgaggaatcttatgatggtgatagtagtttggctcatttacaatcccaataataatgtaaagtataaaaataccgacaaagacgatcccatcactaaatgcctttcctagcgaataagccattttttctcgatacagggcatgccgcatggtcaaaacgagtagcagcaggatcagcaggtagatggtcagtccccaggttcccagattccatagcgtgttgaccataccaatcagcagcagaatcaaagacggccagtatgcttttttgagcttggcctgcacgccgcgcgcacatgccagcatcgcaatggcaaataaaacggtgcttaactgatgcaaaaagaagaaagtgaaaggatagaaacgctgcagaaagcggctgttttcagtcagatcgggcaaggaggcatcgatcagcatgaggataccggaaaagtacataaagaccgtgatcaagacatgcgcgctatgatgccagattaagttgggcagacccttgaaaaagcgattaatcttctggcagaaatggtatacaaacaataacgccccgaaagccaacggaaccaaatagtaaaagacgcggaagaaaaccagccagaccagagccgttgagcgatcaacgcccagcatactcaactccatcagcatgatgatgtcaaaggagccgattgccccaggcagcatggagatgacgcctaagagctgggcaacgacatacatcggcaggaccaataacaaattgatcttaacgtccaacagccagccaatcatcaagaaaaagagtgccaccagcagccactcgccagttgagctggctacgatgaacaactcaagcttgggcgttagatccttaaaaaagctggaattttttagacgcgtgaaaataaagacgatggggaaataaaggccgccgccaaccagccagacgatgtagcgatcgaaatgatgaccgtttggcactaaaagcagtactgccagcgccagccagcaaagaatcgaaagcccggacagtaaaaagatggcaatttttgagatggcaaacaggacctgttttttactggaatgcttgccataaaaataggctcttaaggttgcgcccaatagtccgccaaaaccggcgacgttggtcagggtgttggtgatccagccgcttctgataatgtagtgcttagaaaaacggccagacaaaaaatgagtaatggcaaagtcatagccaagcataggcacgatggagatgcagccgcctatcagcatcatcaaaacgtgaatgggcgactgactggcaaggccaataccgacacggtgccagtcaacatcttttaaaaagctgcccagcgccgtgattacaaaaataatcactgaagcaatgaacagcagcttcagcagtttggcataatgctgccaccaatttttaatgtgtgtagctagggatgagttcatgtttcagaatcctcacttttttattatgtcagtctgacaaacaaaatggtctgccaatttgcaattcaatatcaataatagtagattgcatctgacgtggcaaaaaatttttcaatttaaaacggcttaattttggtcgctgctattgacgctgagcaaatcttttcgtatactatcaattgttgtggaattggtccgttggtctagttttggttaggacgcatccctgtcacggatgagatcacgagttcgagcctcgtacggaccgctatagtttttgaaagttgggatttcggtctcaactttttttgtatgctcgtttggaggaaaaaatggaaaatacttggatctatcgtggtcaagaaccgatcaagattaaaaaatatctacagactttaggtatgggacatcggatgtttaacgatattaaaaacggtgccggtgaatttcaggttgatcatcgaacggtgcgaccaacgactaagattttacccaatcagccactgacgatcaaagtcgtgccagagtttcccaatccagacgttcagccaagccacggtaccctggagatcgtgtatgaagatgccaactggctggttgtcaataagccggctggtctggcatcgattccaggaccgacgactggtgacgacacgctgcttaaccgcgtaaccggatacttgatggatcaagactcgacagatcagcggccgcatctgattacgcgcctggatcgctttaccagtggtctgctgctgatagccaagcatcaagtagccgtcagcatgatcagtcaacaggttcagcagcatcgaatggttaaggaataccaagcgattgttgaaggcggcttggaaaacgatcatggcataattgaagaaccaatcgcgcgcgtagcaggacaggcgcgacgcgaggtcagtgccgatggtcagtttgccagaaccgaatactgggttgaagagcgcggtgatgactggacattggtcagagtacgactgcatacgggacggacgcatcagattcgggtacatttcagctaccttggtcatccgctgctgggagatcatctgtatggcggtcagaccgcacagtttgatcatcagctgctctgcgcctcgcatatcgcgtttgacgatccattcacgctgcagcatcgcgactttacgattgaattgccggcaacatttgcccaggccatggtttgataattttattcatacagagctgattaaaagttctataataaggctaattaagttttaggaggaatttttcatggctaaagttgaaagtttcacactggatcatacaaaggtaaaggcgccatacgttcgcttgattacggttgaagaaggacctaaaggcgacaagatcagcaattacgatctgcgtttggttcagccaaacgaaaatgccattccgacggctggtctgcacacgattgaacacctgttggccggcttgctgcgggaccgcttgacgggcgtgatcgattgttcgccattcgggtgccggactggctttcatttgattacctggggcgagcacagcacgactgaagttgctaaagccttgaagtcctcattggaagaaattgcctaccagaccaagtgggaagacgtccaaggaactacggaaaaaagctgtgggaactatcgcgatcactcactgttttctgccaaggaatggtgcaagaagattctggcacaaggcatcagcgaccagccgtttgagcgccacgtcgttgattaggctttttgcgatattaacaaaaaacgacagcattacatcgaatatgatgtgacgctgtcgttttaatgttgtttaagcgatgactgcttttatttggcagccatcatttttttgatcatctgtgcttgatattcctgttgtgcctgttgggcgagtttttgcagctgagcttccgtcagatcaggattttgctgcttggctgcctgaactctagctgtaacgtaggcggccgcttgtgcttttaactgagcctgagctgcgggtgatttcagtgcctgggcctgcttttttagcgcctgggcctgtttgactgaaatcttaacaaacgtttttggatatctaaacgtattggtccgcgaaactagattcccatccattttggaaccggcaaacagtactttataaaagtcgtttttaaagcgccagcgagtctctttgacggttaaggtcgcctgatctgaatcagtccaaactaggtaattggtcgtaaactcattggcctgcgtatgctgcggcgttttttgccgtggtttggtctggtagatgtatacgttgtctttaccggaagtgccaactggctggtagagcgccaactgcatctgcgagctggttgaatagatcttttgcgtcttggtcgttgtgacttgtttcattccccaatgctcatggaagttggccgtaatcattaaagtcgatcccacaaagatcaagccggagatcattcccaacagccaacgggtacgattgctaggtgagaacatgatcgcggcaaagaaggcaatggcgccgagaaacatgataatggtaatcattatgcattgcctcctttcttggcatttgagtcatatttggcgtgaatcttattgccattccccagtcgcgaagtggtcaaaagaccgattacagcaaaggcgatcgcaatccaaaaggcagcatgatagccgttgagcgtagcatcgatcatctgcgacttgtactgcaacggtgaggctttaagcagtgaatgggccggtttctgcgaattcgtcacgttggtcaagactgagatcaggattgctgaacccattgaagaggctacttgacgaatcgtgttgttaacggcagttccgtgtgagatcatgctgaatggcaaagcgttcataccggaagtagtgactggcatcatgaccattgagatcccaaacatgcgcacggcatacaggaaaacaacgtcgaggattggcgtttcgcgggtcaagaatgcaaagggcagcgtgccgatcgtcaagataaacatccccgtcattgccaagcgacgggcaccatagcggtcgaaaagatttcccgtaattgggctcattacccccatcatgatggccccaaacagcagcgtcaatccagaatggaaagccgacatgccatgaacgatctgcagataaagcggcaggaccaattcaacgccgaccatggcaatcattacaacggagctgagcagcgtggccagggcaaattccggtgttttaaagaccttgaagttcaagaacggatgctccaaacgattctggcgccataccaaaatggcaatcaaaatgacgccgatcaaaatggtgccccagacgatggcatcagtccagcctttgtcgccgactgatgagaaaccatacaagacactgccgaaaccaaccgtggaaataagcagcgaaagccagtccaacgtaggatcggtagtcttgataacgttttgcatcaagaagaagctggcaaagatcacgatggcaacgattggaatgatcatgccaaagagcacccgccatgagtagttgtcaactacccagccggaaagcgaaggacccagagctggtgccaacgcgattaccagaccgttgattcccatggcagcaccacgtttttcaggtgggaagatcgtcagcatgatattttgcatcagcggcatcgtgattccgaccccagttgcctgaatcagacggccgcatagcagagtgccgaaattaggcgctgcaaaagccgtaatggtgcccgcctcaaagatcgtcatcgctgagatatagagccattttgaattgaatttattgctgagatatgccgaaacgggaatcataatcccattaaccatcataaaaccggttgtcagccattgaacggttgccgtactgatgtcaaaggccttcattaaagttggaaaagccgtggccagaatcgtctggtttaaaaccgtacaaaagctcccgatcagcattaccattaccaacagattacgatggtatggcttgccattgatgtcgactgctgtatttgcagacacgtaaagccctcctttgaagttactgattttttaaaagcgattttaaatatatgataattaaatatatttgtcaaatttcttgataaatatatttaaaaatattatattgattagtgtttttaggttacaatgtaaaatggttataattgatagaaaataggaaaggaatcagaaaatgagtcccattacggaagagttccgcaagatgttcgttcatgaaaaactgcgcatcagcatgagcgagctttcgcaagcagccaacgtttcaccaagccagatcagatattgggagcgcaaaggctatattgcttcagagcaggatcagcaaaataaaagccataagtatacgctgatgacgctggtgcaggtgaccggtatcaagtattttttagatgagggctttacgctgccggttgccgtcaaaaagcaaaaagagcatcaggtaatggccaagtcgttcaagcattttattggcgaccggctgttggattttgaaaatgatgaaaagaccggcgcgacgctaattaatttaggaaagctggatgatgcgccagataaggaagtcgttgcaatcgttcaaggacccgaacacgttaaattaacactgcgaaaccgtcaataggttggcaactgcagaagtcgtaaaaagtgttaagctagtaatgtacaaattatttttaaaggggacgacttccatgagcgaagatacttttggctttaatgagctgaccgatgcagcacaagacaatgctttagaaacatttgccaagtactacgtccgccagtacaagcaggacaatctagaaattattgacgcgctggccggtgacgatgaggcagtggcgatgatcaatcagattctggaagaaaacaactatctgaccgttgccaaactggctgcaatgagtatttcgatggttaagtcttgctacgttaagatcttaaatgagctgtcggcgcggtttgatgccgatggtgaaccagttaagacctgggcagaatggatgcagtcagagcatgccaagctgccccaagaagattagaagattaaatcaatcatggcacggtactcagccgtgctttttatttttccaaaaacgacttactactaatgccttctaggatgtgttagaataaactaagttttatttgaacggataaataatacgagttgctcattttcaaattcagatgtgacgtcagctgtttgacggcgctatttttacttgcattgatttctggattgcgaaaattgacgaaatttaataacacaaaggaaagaaaggtattatgcgcaaattaaaaatcaaaaataatgaagtcgctttttatgcgatgggtggcttgggcgagatcggcaagaacatgtactgtgttcaattccaagatgagatcatcatcattgactgtggggtcttgttcccagaagacgagctgctgggggtcgactacgttattcaaaactacgactacctggttgaaaacaaagataagattaaagggatctttattacgcacggtcacgaagaccacattggcggactgccattctttttgcagaaggtcaatgcaccaatctatgccggtccgtttgccatgtctttgattcgtggcaagctggaggaaaaacatctgttaaagagtgccgagctgcatgaaatcaatgagtttgatacagtgcactttaaaaagctgtgggtctccttcttccggacgacgcactcgattccggataccttgggagttgccgttcatactccacaaggcacgatcgttcaaaccggtgactttaaatttgacttaacgccggttggtcatctgccgggaccaaacttccaacaaatggccaagcttggtgaagaaggcgttttgcttttgacctcggattcaaccaatgcggaacgaccagaatttaccaaatctgaacgctgggttgatattcatattcgccggatctttgagcgaattaagggccgcatcatctttgcctcatttgcctccaacgtctaccggcttcgcgaggccagtgatgctgccttgaagcagggccgcaagattgccgtgtttggccgcagcatggagaatgcaattacggctggacaagagctgggctatctgcacattccagaagatgccctgattgatcaaaatgacatcaacagctacccgccagaaaaggttatgatcatgtgtaccggttcgcagggtgagccaatggccgcgctcagtcgcattgccaatggcacgcaccggcagattgccattcagcctggcgatacggttgtcttttcttccaatccgattccaggcaacactaccagcgtcaatgctctgatcaataagctggaagaagacggtgctgaggtaattcatggttatgtcaacaatattcatacatccggtcatggtggtcaggttgatgaagaactgatgctgcgcttgatgaagccaaagttctttgcaccggtccatggtgaatatcggatgcagaagattcataccaagctggctgagctaaccggtgtaccaatggatcacagcttcgttttggctaatggcgatgttttagccttgaccaaggatacctgccgcgttgccgaccatatcgaaacggccagtgatgtctatattgatggccgcgatgctggcgacacggttggtaacccagagatccgcgaacgacggatgctttcagaagaaggggtagttactgcgattgccgtcgttgacttaaaagactaccagatcgtggctgggcctgacatcgtttcgcgaggcttcgtctacatgcatgaatcacaagagctgatcaaggcggctaaccatgaagtcttctgggcaattctgaatacgtttaagaaccatcagcacgttgatcggcgggcaatcaaccgcaccatcgtcagccgactgcaaaagcttttgtttgagtggacggggcggcggccagttattattccgatggttactattttgaatgctgatgaagaagggcagggcagcgatctgcagcgtgacgttcaccataacgcacgacagactaattcgcgtcctaagcacaaggcaaaaaatggtgctgccaataatgaaagcgacaagccacgtccgcgtcggcgtagtcgttcggcagccaagaaaaacgcgcagccagtcgcaactgaaaaatagcaattaactaaagctcgtctaaatggcgggcttttttgattataataaattgactttttcgattccggacttaatcaattgtctgccctctggtatcatgaaaactgtaattatttttgttttttcattatttaaggaggctttttgatgtcagggagagactatcttcacatctggtatcaagcccagctggtcggcgctttgattttcttgattgccgttgcttggtggaacgtcttgattatggggcgcgggatccggttgctggtattcattttggcgctggttgccttagaggggctgatgatcacgattgtcacgcatgtaccgcgctggctgcaggttgtcgacgtgttcttacagactatgctgcagccgatcatgctgatcatgctgtggggaaccgtcaccagagagatcatcgtgcggctgcatctgccggcacgaggcgtaattgccgtaacgctgctatactacctaatcatgtttgcaccgtttgccagtgagattggcggtcaattggaaaacgtgattgcccgcatcgtctttttggtttatctgtttatgacaacagtaatgatgatgcagtactttttgccagataagtttattcagccacagctgtttaaggagtttattgggaccggcttttggggtgccatggcattttttgtttcggtaacggttttgatgcgagcctggcatctgtcatggcctgggctggtaccaacgtttggcactggctggagctggtgggtaatgagcgttctactggctgtttatgtaatttatgtggcatttgacattttccaaactggctggctgcagtttgattttcacgttcaatggaaccggcgcttggtcttgacggctctggaagcaggaattgctgaagagacgctttgccgatttgggattttaggcgcgctgctttatgcctgccgtaatctgacgcagcgcgtaccaattgcggtgggcctgagtgcgctctgttttggtctgctgcacctgccaaatgctgccgtgcagaaatgggacgtcacgcttctgcaggcgatttttgcgattggtctgggtctatatctggccgtcgtctatctatacacgggacaattatggctgacgatgctgatgcatttctttatcgatgcagcaatcttttgcttaacgcatcatgaaacgatcgtcggcagcaccagtctggctgattggattgccctgacgattgagtttctctactttgttgcggttacgctttggatgatgtttggcaaccgccgcttggttatggagcggcatgccgatcgttttactggcgatcaccagcatttcgacttctcatttgactttagaatgtgaaattttggtaaaggccctatattatcttaaaaaaaaagcttatcattataaacagcgatttttgaaaggatgtttaacttaatgataattgaattaatcaagtcctttatctttgggcttgtagaagggatcactgaatggctgccaatcagcagtaccggccatatgattctgttggaccagttcgttaaattggatgtgtccaaatcgttttacagcatgtttgaagtcgtcatccaattaggggcgatcatggccgtcgttgtaatctactggaagcgcatctggccgttccatcacagtcaagccgtggggattgacgcaccaaaaggcatctggcgctatgttgataaagacatcatgatcatgtggctgaagatctttatctcgtgtctgccggctgggattattggggtagccttcaatgataccttcgaacggcttttctacaatccagtcagtgtcgcaatcgccttaatcgtttttggggtggcctttatttggattgaaacggcgcacaagggtaaaaaagccaaggttaattcaattgctgaaatttcatataacatggcagttatgatcggcttctttcagctgattgctgctgtcttccctgggaccagccgttctggggcaacgattgtcggtgcgctgcttttgggagtatcacggacggtagcggccgaatataccttcttcttggccattccagtcatgtttggggcagcattgtttaagctgcttaaatttggtctggcgtttacctcaatggaattttggatcatgatggtcggcttgattacggcatttgtctcatcgattatcgttattaaattcttgatgcgctacatcaagaagcacgactttaaggtgttcggctggtaccggatcgcccttggtctgcttgtgctgctgtactttttggtcttgaagtagtcaaagcagatggaaaatcagacagtcgtggcctgaacttctatttttcttaaaataaaatggtgcttactcaagttttagcggcttgagcaggcaccattatttgttttcggcaattttatagctggctgatcagtaggaaaaaacaaaatttcccaggaaatatgctacatttcttcacccattttgcgataggaatccatcccgcccagccagagctcatttaatggcacatggcgttcttcggcaaaggcgcgcattagggtcatgtgatccatcagctgatattgtttgttgggatttttgggatcaacgacttttaattgtgccatcatgccgccgtcttcatgctcaagaatgtggcagtgatacataaagacgccgggcacgtcaaaccagactttgagtaggacatgttcgcctggattgatggcaatcgtatctttaagccccagctcgtttggatttggcgcatgcccatcccgagctaccgtgacaaagccggttccgtgcatgtgatatggatgaatcataccaggtgcgtgattggtgttttcaatatcccaaagctgaaccttatgcattggcatctgatagtcgatgcgatccatcttaaacttcttgccgttcattgcaactgcttcgtccattccatccaaggttacgtaatgaatcggcatttcaggcgatacagccggattaggcgtttcaaacaagacatcaggcagtatagcgtgatctggtttgaattcgtgaatcttaaagcgcagcaatggcgtatcatcagaatagagcacaacctcatcaccagggcgataactgccaaagtcgacgatgatttcggcacgttcggcgcacgtcagcatcagtttggtcattttcaacggcttagggagcagtgaaaggtcgccggcaatttgggtaaatggcagatcatcgctaaaatgcagccgccattcgcgtcggttggcaccgtttaagaaacgcagccttactttttgcgtggtaacgtcgaagtaggggttgatcgtcccattgatcattggcgtggtgcctaaaataccatctggatcgtagtcttggcgatagtcccattggttgtcctcgtgaaaacggcgatcctgcagaataaccggaatgtcatcgacgccatagttacgcggcaaaggtagctgagcttcgtgctggtcttgaacgatggcgccaccagctagtccatgccagacttgttcggcagtggccggacatggatgagcgtgcagccagacaaaggcagctggttgatgaatcgtaaattcaacgtcgcgcgtctgtccaggatagacaggagcatgacagccgccatcctcgatcggtcccggaattgccaggccatgccagtgaaaagtcgttacttcgggcaggtcgttgatatagtgaatgtgcacggtttgtccatctttaaagatgacggttttgccaagcagcggtccgttatatccccaggttgcggtctttttgcctggcaggagctgaacggcgccggtttgcgcggtgatcgtatagtaaacatcagtagcagtttcttgatcgggttttaaaatttctggaatccgcagaggctgttctggtgcgtctgccacctgcagcggaatgtatgcacgatcatggtagtcaaaggcggcttcatcataacaatagtcttgaatcgtttcttggtcgttcatgtcaataacctcccttaaatgaatacgtttacaaaactattataacgctaataatcattaattgaactaaatagcctgcaaacattttatgattcattaaataatatttaggcttgtctaaaaaattgagtttacaaagtcggtaaatgtagtaacatagacatagatgagttaaatgaacatcagtcagtaccggcgagtggcgtcggtttgctatctaagagaggagtcgttagtttgttcgacattaagccaaagaaatttaaaaagattctcgtcggcgttgatgatgcgcctgacgctcgggctgccttttcctacgctgttgataaggccaagcgcgatgggtctgagattggaatcgtttcgatcttggagactaaccgagtcaacatttatcaagtactggacaaagactacgttcacagtacggaagatgatttacgcaaacgcttgaacgactacgtgcaggctgcgattgattatggcgtggatcctaaaaaaatcacggcgatcgttgaccaaggcgatcgtcccgctgaacgaatctgcaatcatgtgattcctgaatttaagccagatctgctgattattggttcaatcggcaaaaacggcaatcgcaatacggttggttcacaggcttcatacatggtcaagcattcgggaacttcggttttcgtgattcgcacggatgaggttactcactacgaatagtcagctgatcaaaaatattttggcaatcaaaaaggcaagccgaatgctggtggcggcatcgggcttgccttttagttttagctgataaaataaaaagcttgtcggttctcagttctatgttataatgattctaaactaggagaagaaaagaggactggcttatgaaaaagaaaatgtcgctggcacaaaagatcaatgtgctgcgagccagtgtgatgggggccaatgatggcatcatctcggttgctgggatcgtaattggggtggcggctgcgaccagcaatccgcatgcaattttgatttcaggactttctggcagtctggcggggacgatttcgatgtgtatgggtgagtacgtttccgtttctactgaaaaagactcgcagaagatggcattgattgaagaaaaggaacgattgtcagaagactatgatcgtgaattcaactatgtcaaaaataagttcttagcgcaagatattgatccaaaattagctcaccaagccactaaagagctgatggatgaggatccgctggttacgacggttcaagagcgctatggcttcaatcccaaggagtttaccagtccttatgcggcagcaattgcctcattgatcgcgtttcctctgggctcggttttaccaatggttgctgtgatgagctttccgcatgagatcgcgattgccgctacgattattgctgttttgattgccttgattattactggctatctggcagctgttttgggcaagtcaaaccggttgaagtcagtgattcgcaacgtagcatccgggtttttgacgatgttggtaacgtacttgatcggtcagctttttgcacgttgaaaggggtaagtgaaaatggatcaaaataaaaagcccaagcagacgatgcaagaaaagctcaatacgctgcgtgcgggtgtcttaggagccaatgacggaatcttgacggtcgttggcgtgctggtttcggtagccgcggcaacaacggatcaatttacgatttttatcgctggtctgtcggatctgctggcctgcgctttttcaatggcatctggcgagtatgcatcagtctctacgcaaaaggatacggaaaaatcagccgttgctcatgaggaatatctgctcaagcatgactttgaaagcgaggttgtcgcagttcgcgatcactacatggaaaaaggggtcagcgaggcaaccgcaacggcaattgccaaggatctactgaacaaaaagccgctgcagacggtggtacgcgttaaatacgatattgagctgggacattatcttaacccatggaatgcggccttctcatccctggcagcggcggcggcaggaggattgctgccgcttttggcaatggtcttggcaccgttggcctggcgctgggaagccgtaattctggcagtcatccttaccagtgcgctgaccggatatatcagttccaaattgggcaatggcttggttaaggtagcgatcgtccgtaatattatcgttggtattattaccgttattattcactactgtgttggtaagatgttctgatagatcaatttatactaatccgagatgtttatcatttcggatttttttgtgtcaaaaaaagtcctcgtctcaggttttgagacggggatttgagactattgagcgatttgaacgttttttcttaattgaaccatgtcttcaaatcgattggtaaaaatgccggcaacgtttttttcaaacagctgctgggcttcttgatcatcattaacggtccagacgcgctgtgtagcggtggttgcttggtaatgatgcgggtgaatgccatgcaggtgctctttttttacgaattcctgggctttgggcacgtcattttcagtcagccagttatagtcctgcgttgcgtcaagctgcatgcagttttttaacgtctgcagattaaatgatgagtagataaccggatgcagcaattggtgttggttgaccattggcataacgattttttcaatgtcttggtaggcaatgttgtcggtcttgaattccaggttgatccagacgtctttgttttcaaatacgtccagcagctcatccagggttggaatggattcaccattgctcagcttgaactgacgcagctcagccagcgtatagtcaacgatgcggccagtaccatctgtcgtgcggtcgatggtttcatcgtgcatgataaccggaatgcgatccgaagtcagatgaacgtcaaattcaacgccatcgatctggtgggcaaccacataacgaaaaccggctaatgaattctccggaaacttggcagggtagccgcggtgcccaaaaattttggtttggatggcttgatttgattgagtattcatttttttacctcttaaagattgtctttgcttatttctcgaaccgaattatagacgcttggtatgataaagcaatagcaatttggtaaaaatcgtgtaaattattgatcggaccgctcaaaatcgtcagtcgagcgtcatgatgagctcatcagcacagcttgtcatgatcaaccggtggattaaagagctcttcgtcacgtccacgctggcattcggcctgcaaagtgacgtgtttgatgtcatatttgtcgtttaggattttttcaacctgcagatagatcttttcgacttcgctcagcatcatatcatggcagttgaggtgtgctgaaaagacgatgcgatgttcgtcaatcgtccaggcatgaacatggtggacgcctacgactcctggtacctgcatcagatcatgcttgatggcttcatagtccagatcaggcgatgactgcatcagaatgcttaaggtctgcttgatgattggcaaagcttccttggcgatgtagagtgcaaccaggatcgtcagggttgggtcaagccaggtgatgttgaaaaacattaagatcacaccgccaaaaattacggcaattgaagacagtgcatcgcttaagacgtgcaggtaggtagccttgacgttcagactgtcatggctgccgctgtgtaaaagctgtgcagaaaccaggttggcaatcagcccgataatcgctacgatcagcatgatccgaccgttgatgtgttcgggatggctgaatcgcttaatggcttcaacgattagggcgattgaaacaacaatcaaaaagatactgttggccattgctgaaagaatctcagctcgccggtagccataagtacgtcgccgattttccggccgccccgaaatgacttgggcaaagtagcctaaaacaatcgagattgagtcccctaagttgtgaaaggcatcggaaagcagtgccagactgccggataccaatcccccaataatctcgacaacggtaatcaaaacattaagcagcgtcacgattaagaaacgctgtttggaaacgttgggccgttccatgaaatcactccccgccttaaaataaataagctaaaaatagatttaggtattccaaattacatttttatgatatgttataatctgattagtttcaatatggaaaaatacatggttaaaagctcgacgacacttactgccgctgatattttaggaggaagttgtacaaaacatgaccccaatgaaagaagactatttaaagataatttttgagctgggcggtggctataaaaaggtttctaataaagaaatttcactgggattgggcatcgcagccggttcagtaacagaaatgatcaccaagctgacggaggaaggcttggtatctcatgagccatatgatgggatcgctctgacgccagagggaatcaagtatgctgctgaattagtcagaaagcatcgtctgtgggagacttttttagttgatgatctgcactacagcatgactgatgttcatccagaagctgagatcttggaacataataccagcgatcgtttggcaactgctctggatgcctttttgaatcatcccaagtactgtcctcatggtggcgttattccggctgctaatggcaagtttgacagcgtcagtcatcgtctgctggccgatgcagaagatggtgaaacggtcgtcattgaacgcttcttggacaatcatgagctgctgacctatttaaatgaggttggtcttcagctgcatgccaaggttaaggtaatcaaacacgaaccatttgagggaccgatcttggttgaatgtctggataatgatcagcagctcagcatttcctataaggcttcgcataatattttcgttaatcaagagcctttgcaggactagacaattaaatcttaaggctcgggtttaatgcatgatgcattgaacccttttgttgttttagctgctgcctggataaattcaccaataataaggatggatgattgaaagtggaaagcaaggataaaaagaatcttgccattaccgcgtgtctactagcggggcgtttactgatcgaaaacggctcaaacatggaacgcgtcaatgacacgatgcgacgaatggcactgagcgcgcagctgcaaaactttgaggcatttacaacgatgacagcgatcgttgccagcgccgaacacctaccaaacgctcaggtaattgatattcatcaacgaaaattgaatcttaacaaggttgcagctgtcaacagtctttcgcggcagttcgctgctcgtgaaatcgatgttgagacactgtatgcaaaactgcaaaaagttgaccagcagccgcagcagacttcagattttgttcagtgcgtggcagccggcgtgcttagctgggcattgacgatcgtttatactggcaatgtccatgattcattgtttgcagccgtgattgccctggtgagctatcaagtctatctgactttaggaaagcattccaaagcgcgctttgttaatgagttttgtgcttccttagtgattgcgcttttgaccgtgggatttgttaggctgcattgggccaacgacgttaatgacattatcattggctgcgtgatgccgttggttccaggggttcctttgaccaatgcggcccgtgatctgatgtctggtgatctgatcagtggcacgtcacgcgcggttgaagccacgctgacggcaattgccattggctgcgcaatcgtttttgtgttgcgatacgtttgagcgaggtagagcatggaaaacttttgggttagattaatctttgaatttgtgctggctgacctttcgacaatttgttttggaattctactgaacataccgcgccgggcctatcattatgcaggtgcaatcggtggtgccagctgggcgttttactgggcagtctattatcagctgcatctggggctggctttaagcaatctgctggctgccattatgattggcgtcttgagtatggcggccgcccgctggcaaaaaatgccgatgatcatctttaacgttcccgcgttggtgccgctggttcctggtggacaagcctataagatggtgcgcagctttgttttgggcagcaacggtacggcattggtatatctttatcaggttttggtgattgctggtgcgattacgctgggctttggcctgggtgatctgattaatcgactgttattctctgaacaccacttaagaaaccggtagggtgtgatataattaaatttattgtggctgatgccatgacaagatccaacaaaggagcaattttaacatgctgataggacaagatccgaatcgttggaagcgattcatggtaagctttgtattgtttttgattgtcgctggtatggtaatgagcaactcaatgatcctgcaggttttggattcggttttccaggcgctactggcaccaaatcctaaccatacgcccaatgcaacatatcatataatggtagttgtttcgtttttgggcagccccaagatggcccttgtctggatgctgatcattaccttctttctctggggcttcaaatataaggtaccggcactctgggcttggctaacgctgattgtcggtgaccttttagatgagatcgtcaagtacctggctaagcgggatcggcccctgcagcatccgaccggcgaccatggctacagttttcccagtggacatgtgatggggacgtttctggtggctgccgtgctgtttttgatcgtggtgccattgattaaaaatgctgcagtgcgagtggtctgccagctactgttgatcatggccgttttcttggtagccgtttcgcgcatctatctttatgctcactatccgtttgatacggtcggagcgatgctgctggcctatgcctggctgcagatttccgagacgctttacctaacgtttgccaatgatataaaaagacgttggcgcaagaccgctaattcgaaactttgaatcaaaatacccagtgtctcttttaaaatcgacaccgggtattttatatttcctgggtaattttatttaaatagatcgtcaagccactcacatgctagttcaacccagtgggcaacgtggggctgatcaacatcatcatgatgggcaaccaaggcattggcaatgtccattccatgcgggccatgcgcaaaaacgtgcaattcttggggaatctgatgggccagcaaagcttggctgtagctaagcgtattttgcactggtacgacctgatcggtaaaagtcgtccacataaaggttggcgcgtttaagtcgttgacatgtgtcgcggcattataacgagctggatcatcggcccacttggcacgcgttgtggcgtctttaggaaagccaaggttaaggtagatgacgggatagcctaggataaccgcattggggcggagctgatcgctggcagcgccactgagtctgctgagccattttgcatgccagtagtcattgtacagcgcggtaacctgaccgccagctgaaaagcccatgatcgtcagctgatcggtttttaaataccaggctgcggtttgttttctaagcagcgcgacggctaatgccaagtcgatcagtggatttggataaaccggctgatgctcgctggtgaaggtatagcgcagcacgaaaacctgaaagccgcgagctgaaaaactgagcgcagtcttctcggcttgttcgactggaatatgcgtcattgagccgccagggacaaaaatcagcggacggaactgctgcaccggcgacttgggaacgggtgtctgcagatagccagtcagcacagctttggtttgatagcttgcggtacttaaatttttttgaatgatttccattaaaaacactcctgaaaaaagatcctggtaggtgaaattataatgcacaaacaattgctttggccaattaagactgcccgtctcgtaattaaaatgggctgtcaagatgatcttcaagctgtcttgaatctattaagcgatggtgaactggttagattaagcggactgcagctgccagatgatcaaatgatgcgcggctgggcggtcaataactggcttgggcagcagcagcttttgttaatcactgatccggctgggcaactggtcggattgatcagcttattcccaatatatgcaagtgatggaaactatcaggcccacgctatggagctgggatatttactgagacgcgatcgttggggaagaggaattatgagtgaggcgcttgcagcttttttgcaagcgctggcaaaaaatagtgatattaagcggctgcaggcgtatgtggccatcgataatctacgttcgagatctttattgaaaaagtttaaatttgatcagatcggtaatgaaaacggttatttgaaaatggttaaagctttataattacatgcataaacttgtttaaatatttattttattgtataatctttttcgttgtcgcagataagccaatttgggcagatagtccaattgatatggcttttttgctgaaattgcgctaaaatgtttaatcatattaagtatgcacaccttatactttatccatgagaaatgtataactggcgctcgaaattgtcatagaggaggaatccatttacgatgagtggagaggcaaagaatggtggtacggaaggtcagacaataactggcaattccggccatatgaaacggacgctgcagacgcggcacctgtcgatgattgctttgggcggttcaattggtaccgggatgatgattgccagtggttcggcaatttcaacggctgggcctggtggggctttggtcgcctacagcatgatgggaatcatggtttactttttgatgaccagcctgggtgagatggcaacctatattccattgacgggatcgtttgctacctactgtactaagtttgttgacccagcattgggttttgccatgggttggaactactggctgaactgggtgattacgattgccgttgacgcggttacctctggagttatcattcaattctggtggccccagtttcctgaatggatttttagcggctttgttttgctggtaatctttttgatcaattatctgtcagtacgctcatatggtgagactgaatactggctgtcaattattaaagtcgtgacgatcattgtcttcttgatcgttggttttatgattatttttgggattatgggtggtcaaggaccaatcggcttaaaaaacttccattacaaaaaagcaccgtttgttggcggctttcccagcatcctgaccgttttcttggtagccgggatgtcatttcagggtactgaactggtcggcattacggctggtgaatccgctacgccggaaaaatccgttccaaaggccattcattcaaccttctggcggatcttgctgttctacattctttcaatctttgtcatggcctgcattttgccatataccgacaaaaaccttttgagcagcaacgttcaagacgtggcgatgtcgccatttacgattgtctttaagcgagccggtttggcagcggcagccagtgtgatgaatgcggttatcttgacggccgtaatctcttcagccaactcaggactttatgcctcaacgcggatgctgttctcgcaagcacgggaaggctatgcctggcgagtgtttggctatgttaataagcgggggattccgatctacgcgctgctggggacgatgaccgtctcgctggcgatctacctgctgcattttgtcagtgccaacgcctacaactacctgattgatgcatccgggttgtctggctttatcgcctggttagggattgcaatggctcactaccggttccggcgggcctttgttgcacagggacatcagttgagcgagctgaagtatcatgcgaccatgttcccatttggtccaatttttgcttttgtcttctgtatgattgtgattgttggtcaaaacattccagcattcattcacttagattgggacaacatcttgattacctacatggcagtgccgatcttcttgatcctgttctgctactacaagttccgctataagacgcacctgctttcgctgcaggaagccgatttatcgcgcagctcgcgtggtgagaagtacattactgctgatggtaaagaaatcaagtagaaaattaaaacttgcttaaaatcaaaagtgagttataatcaaataatgtgtaaaagagaagaggtgcgagtctcatcagtagaccaggctggatgcttcagaatcaatgcctggctgaaagggatgctcgccgaaacgcgtatcgactgaaggctttacgcgttgggccgtagttaaataaattacggactgtcgcagaagcttctgcggggcgcttccatgattgattcaacaattacgaagttaagttgagtcgacaagcagggaagtcctggcttgccggctctttttgtttgcctttctcgccaataaatttgaggaggattttttcatgagcgaaaacagtcatgaaggcagtgagggtcatattcaacggacattgaaaacgcgccatctgtcaatgattgctcttggcggtacgattggaacgggactgtttattgccagcggttcggcaatctcaacggccggcccgggtggtgctttagcagcttatgccatcatggggatcatggtttatttcttgatgaccagtctgggtgagatggccacctatattccagtctcgggttcttttgccacctattcaacaaagtttgttgatccggcattaggttttgccatgggttggaattattggtttaactgggccattacgattccagttgacgtaacgacggcggggctggttttccaatattggctgccgcattttccaagctggctgtttagtacgtttgtcttgcttgcgatttttctgatcaattatctttcagttcgttcatatggtgaaacggaatattggctatctttgatcaaggtcgtaacggtcgtcatctttttgatcgttggggtctgcatcatctttggaatcatgggtggtcaaggaccggttggcatgaagaatttccactacaaggacgcaccgttcgttcatggctggtcagggattttgagtgtgttcctggttgctgggttctcattccaaggtactgaattgattggaattacggctggtgaagctgctacgccggaagaatcggtttccaaggctattcattcaactttttggcggattttgctgttctacatttttgcaatctttgtcattgcctgcgttctgccatataccaacaaaaacctgttgaattcaaacgtgcagaacattacgatgagcccatttacgattgtttttaagcgggcagggatggcggctgcagccagtgtgatgaatgcggttatcttaacggccgtgatttcggcagccaactctggtctgtatgcctcgacgcggatgctgttctcacaggcacgggaaggctatgcctggaagatctttggctatgtcaacaaacgcgggattccaatctatgcattgttgggcaccatggttgtctcgtgtctggcttatttgacacagtttatcggtcccgaagcttataactacctgattggggcatctggtctgtgcggctttatcgcctggttagggattgccgtttcacacctgcgcttccggcgggcatttattgcgcagggacatcaggttggcgaattaaagtatcatgctacgctgtttccgtttggcccaatctttgccttgatcttgtgtgtcgtcgtaatgtgtggtcaaaacattgatgcctttatcaagatggattggtcaaatatcgccatcacctacatggccgtaccattgttcttgattttattcatctactataaggttcgttacaagacgcacttgattcctctcaaagacgttgatctgtcacggagcaacaatagtgagtcattcgtttctgaatcggaaaaggaagctgaataatcatcgaatcctcgccggttttggtggggattttattgttgaggctgttgatgatggtgcagactgtaaaaatgcgatcagtcaaaagccatttagtgctgagcagcaaaatattaaaaaaaggacagctcgttgattagttgagactttatggtgttgactgataaatgaaaaacattttactcacggtagcggatcaaagatgatacaatatagctcgtgtctttttagaaaatggaaaaaggggaaaagcaatgattgtactagcaggaactattggtgcgggaaaaaccagtttaacgcagatgctggctgatcatttgggcagtcaggctttctatgaatcggttgatgataatgaaatcctgccgctgttttatcaagatcctaagaaatacggctttttgctgcagatctactttttaaacaagcgcttggccgagatcaagaattcatttgataatgatctgaacgttttagaccgctcaatttttgaagatgccctgctttttcggctgaatgccgatttggggcgagctacacagactgaagctgacatctattcctcgcttttgggcaatatgatggaagaattgcctcagcaggcacatactaaagcaccaagtcttttgattagtattcaggtctcatttgaaacgatgctgaagcgaatcaagaaacgcggccgttcgtttgaacagattgaaaatgacccaagtctttatgaatactatcgcgaattgaatcagcgctatgttgactggtatgccagctatgatgaaagtcccaaaatgctgattgatggagacaaatatgattttgtcgaagatccccatgcagctgatcaggttttgcaattggttgatgataagctgacggaactgaacctaaagtagttgagttcttgacagagtttattcagatatgtataattaaattgttgattttcatatctgatacggaggattagctcagttgggagagcatctgccttacaagcagagggtcacaggttcgagccctgtatcctccattttttaatgctttacttgcggatgtggcggaattggcagacgcgcaagatttaggttcttgtatcttatgatgtaagggttcgagtcccttcatccgcattattattaaacggctgtcctgaagcaaggtacagtcgttttttgattttttttgcgtttgatcgctgatatagttgttcttagaagttttaatcgggaaaggaagccataaaaatgatcacgtttggtcgttatcgcctttcattctcaaaagccttgacgtttgggttcttgatcgtgattgcaatcggtacgctgcttttaatgctgccgattgcaatcaagcctggcgaggatccatcatttatgacggcattttttaccgcgaccagtgcaacctgcgtgactggactgacgctggttgatacggcgactcactggtctttgtttggtcagctggtaattacggctttgattgagattggcggactgggttttatgacgtttgcaatcatgatgtttttgtttgcgcgtcaaaagatcaggctttcagcacgtctgttagcccaagaatcattgaacctgcagtcgccaacacagattacgattgtcaatctaatcgttggtctgtcactgatcattcaagctttaggcgctttgctgctgtggcctgattttggccgccggtttggtttgatcaaggggctatggtacagtatctttcactcgatctcagctttttgtaatgccggttttgatctgtttggcaacagtctggcgtcatttgccgatgatacttatgtcttgtttatcatggcggttttgattattgctggctcatttggttttttggtttggcgtgatctattgctttatcgaaaaaagcatcggttgtcgctgcatacctcactgtcactgtcgactggcgccattatcctgctgttatcattgatgagctatcttttgactgaaaataatctagttgctcagtttccacatatgtcagttgagcatcgtttcatcaatactgtttttatggctattacgccacggacagctggtctgacgactttttcctatcaaaatctttcaccggccggcatcgcggtaacggtaatcttgatgtttattggggggacgccaggatcaacggctggtgggatcaaaacgactacggttgggctgttgacgctgcagagtattgccactttaaaaggtcagcgcgatacggtttttggcagacgccgctttaaagaagaaaatatttttcgggcgctgacgctggtttttgttgcctttgcaattcttgccgcggcaatcttgctgttgtgtctgacacagcatttgccagccaattttactttggaagatattatttttgaagttatggctgcttttgggacgacgggtatcagcatgggggttacgtcgcatttgaatttgtttggcaaactgatcattatggcattgatgtttatcggtcgggttggcatctacaccgtaatgtttacggttttaaatgctcatccaaagcaaaagaactatcgctatccggaagaaggggttttgattggctaataaaaacaactatgcagtaattggtatcggtcagtttggcagctcggtctgtgaaactttggccgaggcgcatcaagatattttggccattgataagaatgaagatgtcgtcaatgaatatgccaatatggtaacgcgagcagtcattgccgatgctcaagatgaagaggcgatgcgcgagctggatctagggagctttgacaatgtctatatttcggtgggcaatattcaagccagtatcatggcaactttaatcgttaaagagttgggcgctaaaaacattatctgtaaggcagaaaatgaaaatcatgcccgggtgctggaaaaaatcggggctgactatgtcgtgcgtccagaacgtgacatggctagacgaatggtgtttcatcagctgcatttaaatattgccaattatttgatcttgaatcatgagctgacgctggccgagatcgaggttaagagtccagatttttgtgagcatacgctaaaagagcttaatctgcgcgatacgtatcaagtcaatgtgattgccattgtcagcggagagcaggttaacaagctgccacaagccgacgatatacttcatcatggtgatcatatctcggttgttggggatgtcggatcgattcaaaagctcagttcggtaatcgctaatgaataaatgatctaatcataaaaacagcgctgtgcagactttagtgtccagcacaacgctgttttaagttgggtcagtcatcaatatcagacgtcccgtgacgagctcttaatgcccaaagaattgagacggtatcgattacttcctgcagcattgccccaataaaagcagggatgatgccaaatgcggcaatcagcattaaagccgtacagatacagataccgatcaagacggcctgttgagcaatgcgcatggtttcttgtgagattgtaacggcaatggcaacccggtgcaggtcatctttaacgattaccagatcggcggactcactggctgccgttgatccatgagcacccatggcgatcccgacatcggcagttgccagtgcgggtgcatcattgacgccatcaccaaccattacgacaggacgacgattttccggaacgttttttaaggccgcaatcttttgttcgggcaataggtcagcttttacctcatggatgccgaccagtttagcaacgtgctgcgcaatggctttttgatcgccagtcagcataaccaggtgctcgacgcccagctgacgcagctgctccatagtacgtggcgcttcaggacgaatctgatcttggaaaaccacgcagccccaatactgatcatccacgctgacatagattgcagtctgagacagcggcttttgggtcgtatccggatcagcaaaaatcagcttgccgaccttgacttgtcgaccgtcaacgattgctaagatcccgttgccgacgacctcttttaattcactggcagaactaagcggaatctggtgtgcttgcgcataggcgacggttgaacgggcaaggatatgtggcgactgttcctcggcactggcagcaaagtgcagcagttccttaatgtcgattcccttagccggttcaagatggtcaacggtcagctgaccgctggtaatcgtaccggttttgtcaaaggccatggttttcggatgcgccattttttccaggacgctgccagtcttaacgatgatcccgctgcgtgaggcccgactcatccccgaaacgatggcaactggcgccgctaaaatcagtggacatggtgaagcaacaaccattacttgagcaaaacgactgggatctttgctgacgatccaagcgataccgccaattacaagggcagccgcagtaaagggaacggcatagcggtctgccaaacggacaaagtgagccggggtgttctccgcttctttaaccagggccaccagtttttgatactggctgtcacgtgctagtttgactgcttgaatgacgattgcttgatcgccattcagcgagcctgacattacctgatcgccaacttgcttatcgattggctttgattcaccagtcagcgatgattcgttaacctgcgtattgcctttaatgatttcgccatcgattggtaccagctcgccaggcttaacgataatcgtatcgccaaccttaacctggtcgacatgaacgtcttcaatctgatctttcatcagccggtgtgcagactgcggcgagttgtcaagcagtgccttaagctcagagttggccttacgtgaggcatagtcttccaaagcgtcgccaccgaccagcattactaaaatcaccatagcggcccaatactcaccgacgcttaaagtggagacaacggcaatgattgccagcagatcaacaccatagcgaccgcttttaagagtatggatcatctcaatcagcattgaaagcgcgatactggctcccacgatggttaccagaatctgggcagccagtgcctgcttaaaagcgtattgcaggagcacggctactaaggcgacagctaaaatcatgaacaatttttgccgatgcgaaaattttttcataattttcagctcctttccccaaattttgtcttaattataacgctattcagcaaccgcttccagatgtcggcttgaggcaatctgccaagttgatttcatttaggtcaaaattaataaatatcggaataattgacgaaaatataaaattagtattgacatcaaacgtttttatcagtaatatatataactgttgatacgttatcaacgaactcaaataaacatttgcggaagtagttcagtggtagaacatcaccttgccatggtgggggtcgcgggttcgaatcccgtcttccgcttgattccattatttcatgcacccatagcgcaattggatagagtgtctgactacgaatcagaaggttgaaggttcgactccttctgggtgcattaatcgggaattagctcagcttggtagagcgcttcgttcgggacgaagaggtcgcaagttcaaatcttgtattcccgattcataaatgaacattatgcggaagtagttcagtggtagaacatcaccttgccatggtgggggtcgcgggttcgaatcccgtcttccgcttgaattgaatatttattatgcacccatagcgcaattggatagagtgtctgactacgaatcagaaggttgaaggttcgactccttctgggtgcatttcttgcggaagtagttcagtggtagaacatcaccttgccatggtgggggtcgcgggttcgaatcccgtcttccgctttttgtatgccgatgatttttcatcggtttttttattgaaaaagatccggtcatcaccattttggtactgaccggatctgattgttactaggcttaaatcagccgatattcttttaagagttcttcgatataggttcccttgacttttttgagtccctctttaactaatagtttctgggacaatggcaggtcaagttcagttaatttcttttgatcattaagatagtacatggcattcatcatcaaacgaacgtcaaaggctgaggcaaatacttcaggaacgccccggtcaatgtcaagcagcgtatagacggcttccatggcagtgcgaacggagtattcagttgtaaagaccgtatcacgtggcgtttcagcaaagttgccgataaaggctagattcttggaatgctttggtacgactaatggacgatcacccaaagcgcgcggcatgaagtaggatgtgatatacggcatgtgagcaggaattgttgtcgctgcttttgccatggccggaatatcattttctggtacacccatatgatatagccactcttcgcatagttcgataccggtacattcgggcattggcttttttacgtagttgccggctttgtcagagaagaggccgtatagccagacgatcagttcattaggcttctgttggtgaaaatgaggctgccgactgatcgaatagcctaaaagccagttggagttcttgattgttgtaggaccgctggttacgattgagccactgtgcggatcttttttatttactttttcgataaatggtacgatatcattatttttaaaagtaatcgtagccgacatggtccagttggcatttggaatttgctcgcagaacttttctggatgaccaaagtcactgtcttgggctgccaggttcttccatagctgccagctagcgccaagcggatgatcgattggtgcagggtgatcattgtcgccgtacgtggtgctttcggtaatcgaaccatttgttacaaagaccagatcatttggtgtcagttcgatactttgcggttcactagcaaccgtcatctcgatcttggtggcaagcttgtcattaccggagcggttgacgatgagattgtcgacagtagtttcttgatggaattgaacctcatgatccttcaaaaatttaaccattgggagaatcaatgactcatattgattgaatttggtaaagcgtagtgaagaaagatttttgagcgtaccaacgtgttgaatgaaccgcattagataacgacgcatttccatggcactggcccatggctcaaaggcaaacattgtacaccagtagagccagaaattggattggaagaactctttgtcaaagacttcattgattttgacgtcctggagtttttcttccggcgttaaaaccaggtcaacgatctctttgactgcttttggcgtcagcagcagctgtccgtcagttggcagagcttcaccacgattctgaatgacacgagttttagcatagcaagggtctttacggtttagacgatagaactcatccaatactgaagcgccggggacttcgagtgacggaatcgaacgaaatagatcccagagcgtctcaaaatgcggttccatttcacgaccgccgcgaataatataggaattgcgctgaacgctgtaaattccatccatgctgccgcctggaactgataattcttcaagaatatggatctttttacctggcatctgtccgtcgcgaatcaaaaagacggcggtggctaatccagccagacctgctccaatgatatatgccgatttttttcgatatcggctggcttgtcagcattaacgaacgcctcgtagtttccatttgtataatgcatcatgctcgctcctttcaataccaaaaatcgttacacctgtaactatacttttgtgatattgttgacgctttcatttgtcaattatttttagaaaagcgaggaattaacattaatgaataaaaagagtcaaaaaacacaactgaaaatcgagcaagcaatgtttgagctgcttaaggaaaagccttacgctgaactaacggtagctgaaatcgcacaacgagccatggtgtcgcgaatggctttttaccgtaatttcggtggcaaggatgcaatcttgacgcattttttgcaacaggaatttgctgcttttattcaagatatcaaagaacatgacctgaattcattggaacagcagcttacggcctatcttagccacttcaagaatcatccggatctgatgcgtgttttgttgaaagcaggttttgaaggtgaactgctcaatcagcaaacagcctacctgcattgtttgctgattgagtatcatccagaactcgatctttcagactatgcaatcagctaccagtctggcggaatctatatgctgctggtttggtgggttaatgatgattttactgcgccggttgagctgctggtcgattatgcacgacgccatatcatgctgaataaataaaaactgaccgtcatcgatcaaatggattggtgacggtcagactgattataatcattttgaatgcttattttaacgccttttggtagacgtgttggcccttaaaccaggtttcggttgcatttacggttgccagttcatcatttgagacactgaagatatctttgtttaaaattacaaagtcagctgatttgccaacctccagcgttccgttatgcgtgaagccgccaatttctgctgcccatttggtatagcctaagatggcctgcggaacggtaatggcttcttcaatgtttacaacgtcattattggcagcctggcgcgttacggctgcatagatactgtagaaaggactgtcaggctcagcccagggagtacatggcgcatcagagcttaaagtcgtcagtgcctttgatttaagcattgatttaacacggtaggccagtttgaactgttccggcgtcaaatagttgcgataggattcatcttctgcaaagaaaaagattggctgggtggaaagaccgtaccgcattttgacgtgattgatctgatcaagcatctggtcgctaagcagcgaagcgtgttcgatgcggattgaaggcatatcatccagccagggatctaaatcacaggtcgtatctaaaaccagctgaattgctgcatcacccattgcgtgaatggcggcctgcagctgatgcttttgggcaaatttgatggccgtcttcagcttggcctggtcagtaagtaaaacaccgcgcttgccagaaggataaggcaatgagttgtcagcagtctcgccagaaatactgccatccatgaaaatcttgatgccggctactcgcagctgatcatcgcccactggatcaagggcttgaccaggcttcagctcatcatagacataatagatggaggctcgcggcttaaagccctgcttgacggcatcctgataaaggtgcagcgtagggtaggggttaagccgtcccatcatttcgccaattgcaacgataccgttttcgagataatgatcggagctattgaccatgttttgtacgtcattttcgtagctttgcgccgatttggctcgaatcagcagctgactggcggctacctcacgcatgaagccagtaggacgaccatctggaaaacgttcgatatggccgccttttggatctggggtgttttgatcgataccggccagtgccaaggcttttgagttgccaaccgatgaatgacagtcggaacggtagataaagattggctgctcggtagtaacttggtccagatcgtcaacggttggcgagcgatgttctgccaacttggtttcgtcaaagccccagccctcgatccagacatccgggccttgaccatactgcggggatgccttgagagcggcgatcatttcttgaatgctgttgacgttagggggcgtacaggccgttccgtgaagagcatccgcgatatatttgggatgggtatgacagtcgatcagtccaggcaaaactgtttgctgatgcagatcaatcgcttggggatcgtcaacctgttcagtctgaccaatccagctgatacggccatctttaaccttaaaggcagagacaaaatcagtttcgctggtaccgacaaataccttgccgttgacaaaagtttgttccatagttagttcctccgtgatattttggtagcggtaacattataataatccgctagccagattgagacaaccttggaaaaataaaactgaacattatattgattattatctaaaaaacaaaactagcattttaatcaggcatgggccagctaggtgatgaaagccttcacttaattttgataagtttaaatctgcacaagctaaaaatatttttgaaagtgctttagatggctgtgaagccctttacatcggcagaaaaccggtttttgaattcagtggtctaggctaaatgtgcaaacgttcactttccaaatcgatatgaatctgctaagatagagactgtaaaggaaatctaatgattgcaaaggagattttgctctatgaaagctgctgttattcgtgaaaattgtgatggcttcgttgacgttaaggacgttacgctgcgtgatctgaagccaggtgaagcactggtcgacatggaatactgtggtctttgccacaccgacctgcacgttgctgccggcgattttggcaagaagcctggtacgattattggtcacgaaggtgttggccgcgtatctaaggttgctcctggtgttaccagcctgaaagttggcgaccgagtatcaattgcttggttctttaagggctgtggccactgtgagtactgtctgacggggcgtgaaacgctttgccgcaacgttttgaacgccggctacactgctgatggcgctatggctcaacaatgcatcgttcctgctgactatgcagttaaggtaccagaaggcctggacccagttgaggcaacttctctgacctgtgccggcgttacgatgtacaaggcactgaaggtttccggcatcaagccaggtcaatgggtatcaatcgttggtgctggtggtctgggtaacctggggattcaatttgcccacaacgtatttggcgctcacgttgttgccgttgatggtaaccctgacaaactggaagctgccaagaaggaaggcgctgaagttctgatcaaccgtcatgacggcaatgttgacgaacagatccaagaaaaggttggcggcgttcatgcagctgttgttacggccgttacgccagctgcctttgaccaggctgttggttccctgcgtccagatggcaagctggttgccgttgctctgccaaagggtgacatgcagctgaacattgccaagacggttctggatgggatcgttgttgctggttcgctggttggtactcgtcaagacctggctgaatgtttccaattcggtgctgaaggcaaggttcacccaatcgtcaagacccgcaagctggaagaaatcaacgacatgattcaagaacttaaggacaacaaagtggttggccggaacgttgttgactttgtacacaataaataattgaataacggctaaggcaagctgatcttagcaatctaaaatttaaggctcatcgttgtttttgcagcgatgagtttttttaatttaaaatcggaattttatggatatatatgataaaatgaaggtcaacattagtcagataaagaaagagggggcgaaattttggaagaccgcagtatttcggatattattgaagcttatcttaaagagattcttggcaactcagagcagatcgagatacgtcgttcagaagtggccaaccatttcgatgtggtaccatcacagatcaattatgtaattaaaactcgcttcaccctgcaaaatggctacctggttcaaagtaaacgtggcggtggcggctatatccgtattgaacgcatcaatctattggatgatgtcgatgtcttggacatgctgatcaatgcaattggcgactcaatcagtgaacgagatgccttcgatgtgattcgaactttatatgaagaaaaagtcattacgcggcgagaaggcgatttaatgatggtgatggtcgccaaacaaaccttgaaactggatagtcgagttaaagaaaatcagctgcgggcccgggttttgacttcactgttgaaccggctgcgttttgaaagctaagagagaaagagacggtgatttaatggacaataattcatacacccgaagcgcgcaaaacgttttgcagattgctcaagaacaggcacactactttaagcatcaggccgtgggcaccgagcatctgctgctggcgttgagcatggtttctaatagtattgcgggccgtgtcttgaatcagtttaacgtcaccagcgatgatattcgcgaagaaatcgaaagcctaaccggttatggtacgatgcaagaggctgatcgcgatacctatttgcctgattcgcccaaactgcgcagtattttattactggctaagcagatggcccaacgtctgcaggcccctcaaattggcaccgagcatctgctgttagccctgctgagtgatgatgcaattctatcatcacgaatcttaagcaatctggatgttaatcccaaacaggcgcgtcggattttgctgcggcgcctaggaatcgctgaaaatcagcagcgacgggcaccacggcgacgtcctggtgaaaacgatggcagtgacggtgaggttcagggaacgccaacgctggacaagctggctcgtgatctgacacagattgcgcgcagtgatggcatggatcctgtagttggccgcgatcgtgaaatcaagcgggtagttcagatcctcagtcgtcggactaaaaacaatccggtgctgattggtgagccaggggtcggcaaaaccgcgatcgcagaaggactggccgaacggattgtagctggtcgggttcctgaagaactggctgataagcgactgatgatgctggatatgggttcgctggttgcgggcaccaagtatcgcggtgagtttgaggaccgcttgaaaaaaatcatcaatgaaatctatcatgacggccatgtaattctttttatcgatgagctacacactctggttggagctggcggtgcagagggggcaattgatgcctcaaatatcttaaagccggcgctggcccgtggtgagctgcagacgattggcgcaacgacgctggatgagtatcaaaaatacattgaatcagacgcagctttggaacggcgctttgcaacggttcaagttgaagagccgactgctgaggatgcgctggcgattctaaaaggactgcggcccaaatatgaagagcatcatcacgtcaaaatcgatgatgaagccttggaagctgccgttaagctgtcaacgcgctatttgacgagtcgttttctgccagacaaggccattgatttgatggatgaggcagcggccatggtacgcatcgaagctgaagaacagtcctcaccgctggcaaacgaacaggctcagctgcgcaaattaggcgaggaaaaagaacaggccattgaacagcaagactttgatcgcgcggcccagctcaggcaggctgaactgaccatcaaggcgcggctgacgcaagaagaagagcagcgacaaaagcaggctgatcagtatcagctgcacgttaccggcgaagacattgctaaagtggtggctgagtggacgggtgtgccgctgacccagctgcagaaaacggaaagcgaccggctgatcaatctggaacgagtcctgcatcagcgcgtgattggtcaggatgaggcggtttcggcaattgcccgttcaattcgtcgagcgcgcagtggtcttaaggatcctaatcggccaattggctcatttatgtttctggggccaaccggcgtcgggaagactgaactggctaaggccctggctgaagcaatgtttggctcggaaaacaatatgatccgtgttgatatgtctgagtatatggaaaaatacagcatcagtcgcttgattggggcggctcctggctatgtcggctatgatgagggcggtcagctgacggaaagggttcgtcagcatccatatagcgtcgtgctgcttgatgaagccgagaaagcgcaccccgacgtattcaacttgttgctgcaggtactggacgatggctatctgacggattcaaaaggtcggcgcgttgatttccgcaatacgatcttgattatgacttctaatcttggagccacccagctgcaggatgaaaaaacggttggctttggggctgccgacatgacggcggattgtcaggccatgtcagctgccatcaagcagcagctgaaactgcacttccggccagaatttctaaatcggattgatgaaacaatcatcttccactctttgaatcaaaaagagctgcatcagatcgttaagctcctggctgacaaggtaaaacaacggatggctgaacgtgatatcaaggtacgctttacgccgggtgcgatcgatgtgattgccaaagccggctatgatcccgaatatggagcacgaccattgcggcgctcactgcagaatctggttgaggatccattgagcgaggcattgttggccggggcggtccaaactggtgatgaagtcgtgattggttcgcatcagggcaagattacgctaaaggacaagcgtggggatgccaagcctgaattgattgcgctgccttaaaactttgctggtttcgataaataacctgatagataaattttattagtcattgaatcatcatttaatgaaatgagatttaatgacttttatttttggcgaattagtaacccaaacttgcaagaactgagttttcgtgtgagaattatttttgactaatatgggaaaccgataagggagaatcgatagaacatgaaacgagcagaacaattggcaaaaactcgccaagcaattttgaaaaccgctacgacactttttttgcaaaaaggcttttctggtgcctccaccagagatattgccaagcagatcggtatcactcagccagctttgtaccaccactttaatgataaggaagttttatacctggctgttttgaccaatctatgcggtaaggttcgccaggatatcaacaaggttatgcgcaagcagcaggtcgatccagaagaacgactgtatggaattactgaagtattgagaaagcatcatccgctcaacgtctacgatcagtatcaagaagccaaaagagagctttccgaaagtgctcagcgcaaactggacatgctgtttacaatggattaccttgaaccgattgctgatttctttaaacttcctgaagtgcatctgcggccggatctgttgcctaaagaagcggcggagttgtttattgctgatctgtcgccgatctttaaatcatttcaaccaattggtggccatgccatctctgaagagcagcgtaccaaactgattttgagctgcattttgcgcggcctgacggttccagtaacagccagtgaaaaataaaaactaaatattgacaatggattcgcaaacgcgtatgataattggtgtatgtaattgcgagttcatttgagttccgtgatctcttgtccatgggattctttataaaaaccaaagacagcacccagctgtttttggattttttttgcccaaaagcaggaattttgatgatttgtaatcaaaatgtaatattacaaatttgaatgaacttgcccaacaaatttgagaggtgaatagtttggccggacatttagtaaaatacggtaagcaccgtacgcgtcgcagttactcccgtatcaaggaagtactggacctgcctaacttgattgaaatccagaccgattcctataactggtttatggaaaaaggtctgcgggaaatgtttaacgacatcatgccaatcgatgacttccaaggcaaactgtcgctggaattcgtcgactaccaactgcttgaacctaagtatacggttgatgaagcccgggaacacgatgcaaactactctgcaccgctgcacgttaccctgcgcttgacgaaccacgaaactggcgaaatcaagtcccaagacgtgttcttcggcgacttcccactgatgacggaccaaggtacctttattatcaatggtgcggaacgagtaatcgtttctcaactggttcgttcacctggcgtttactacaatgaagaagatgacaaaaacggccggccaagctatggtgctacttttattccaaaccgtggtgcctggctggaatacgaaaccgatgcgaagggcatctcttacgtacgggttgaccggacacggaagctgccgttgactgaaatggtgcgtgcgctgggctttggctctgacgatgagatcattgacatgctgggtggcaacagtgaaggcctgtctgctacgattgataaagacgtgcacaagaaccctgaagactcacgagttgaagaagccttaaaggacatctacgaacgcttgcgtccaggtgagcctaagacggctgactcagcacggaatctgctgacggctcgcttctttgatccaaagcgttacgatatggcaccagttggccgttacaagaccaacaagaaactgatgatgaagtaccggctgttgggtcaaacgctggccgaaacgctggctgatccggaaactggcgaaatcctggctaacaagggtgatgtagttaccaaagaagtattgaagactttggaaccggccctggacaacgatgacttcaagatggttacctacacgccatctgatgaagctgttgttacggcaccggttaagctgcaaaagatcctggtttactccaagaacgatcctgaccgcgttgtgccaatcgtagccaacggtcatattcctttggagcttaagcacattcagccagccgacatcattgcgtccatcaactacttcttcaacctgcaagaaggcattggcacaactgatgacatcgaccacttgggtaaccggcggattcgttccgtaggtgagctgctgcagaaccagttccggatcggcttggctcggatggaacgtgtggttcgtgaacggatgtcgattcaagacattaacacggttacgccacagcagctgatcaacattcgaccagtagttgcctcaattaaggaattctttggttcttcacagctttctcagttcatggaccaaaccaacccactgggcgaactttcccacaagcggcgtctgtctgcccttggtcctggtggtttgactcgtgaccgggctggttatgaagttcgtgacgttcactatactcactacggccggatgtgcccaattgaaacgcctgaaggtcctaacatcggtctgatcaactcactgtcatcctatgctcggatcaatgaatatggcttcatcgaaacgccataccaccgtgtttcatgggatacgcacaaggttaccgacaaaatcgactatctgactgccgatgaagaagataactacatcattgctcaggccaacaccaagcttaatgatgacggctcatttgctgatgaagaaatcatgtgccggcataaggatgactatgttgaaacgactcctgaaaacgtcgactacatggatatctcgcctaagcaggttgtttccgttgcctcagcatgtattcctttcttggaaaacgatgactccaaccgtgccttgatgggtgccaacatgcagcgtcaggcggttcctttgatcaaccctcatgcaccgctgattggtactgggattgaatacaaagccgctcatgactctggggttgccttggttgccaagaaggctggtacggttgaatacgtcgatgctcgtgaaattcgcgttcgtgaagaagacggcacgcttgacacctacaagctgatgaaattccgtcgttccaacggtggtaagaactacaaccagcgtccaatcgtcaaggtcggtgaacatatcgatgctgatgacgttttggctgatggtccatcaatggaacaaggtgagctggcgctgggtcaaaacccattgattgcctttatgacttggcaaggttacaactttgaagatgccattgccatcaatgaacgcttgattaaagaggacgtctacacttcaattcatatcgagtcatatgaatctgaagctcgtgaaaccaagcttggacctgaagaaatgaccagcgagatccctaacgttggtgccgatgccttgaagaacctggacgaaaccggtgttattcgtgttggtgctgaggttaacgacggtgacattctggttggtaaggttacgccaaagggaatgactgagctgtcagctgaagaacggctgctgcacgccatctttggtgaaaagtcgcgtgaggttcgtgatacgtcgctgcgggtaccacacggcggtggcggtatcgttcaagacgttaaggtatttacgcgtgaaaacggtgatgagctggctcctggtgtcaacaagatggttcgggtctacattgctcaaaagcgtaagatccaagtcggtgacaagatggccggccgtcacggtaacaagggtacggtttcaatcgtggtaccggaagaagacatgccatacatgccagatggtacgccaatcgatatcatgctgagtccaatgggtgtgccttcccgtatgaacattggtcaggttatcgaactgcacctggggatggctgctcgcaagctgggtatccacattgctacgccagtctttgatggggcaaccgatgaagatgtttgggaagcagttaaggaagccggactgccatctgatggcaagacgattctttatgatggccgcacgggtgaaccatttgaacaacgagtttccgttggtgtcatgcactatctgaagctggcacacatggttgacgacaagattcacgctcgttcaattggaccttactcactggttacgcaacagccattgggtggtaaggcacaatttggtggtcagcgtttcggtgaaatggaagtctgggccctcgaagcctatggtgctgcctacacgctgcaagaaatcttgacttacaagtctgatgacgttgttggtcgtgtcaacacttacgaagccatcatcaatggtgacccaattccaaagccaggtgttcctgaatccttccgcgtgctggttaaggaactgcaatcccttggtctggatatgaaggtgcttgatagtcaaaacgaagaagttcaactcaagaacatggatgaaggcgtggccgacatccgcaagctggctcgcgatggcagcgacaagcacgaagaagtcaaagacgaagcaaaacaagactagtttgcctgaattgaaataaggaggatcatcctttgattgacgtcaataaatttgaaagcatgcagatcggtctggcctcaccacaaaagatccgcagctggtcgtacggggaagttaaaaagccggaaacgatcaactaccggacgctgaagccggaaaaagacggtctgtttgacgaacgaatctttggtccaaccaaggattacgaatgtgcttgtggcaaatacaagcggattcgtttcaagggccgcgtttgtgaccgctgtggagttgaggttaccagctccaaggtacgtcgcgaacggatggggcacattgagctggccgcccctgtttctcacatttggtacttcaagggtatccctagtcgaatgggcctggtcttggacatgagcccacgtgccctggaagaagttatctactttgcttcttacgttgttttggatgccggtgatacgccactggaaaagaaacaattgctctctgaagcggaatatcgtgaaaagaaggaagaatacggcgatcgctttactgctgaaatgggtgctgaagccattcaaaaactgttggctgacgttgacctggaaaaggaagcaaccgaattaaaagccgtcttgaaagaagctactggccaaaagcggacgcgtgccgttcgtcgtctggacattctggaagccttcttaaagtctggcaacaagccagaatggatggttatggacgttattccagttatgccgcctgatttgcggccaatggtacaactggaaggtggccgttttgcaacttctgatttgaacgatctgtaccgtcgggttatcaaccgtaacaatcgtctgaagcggctgttggaattgaacgcacctggcatcattgttcaaaacgaaaaacggatgctgcaggaagccgttgatgccctgatcgataacggtcgtcgtggtcgtccggttgctggtcctggtaaccgtccattgaagtcgctgtcgcacctgctgaaaggtaagcaagggcgtttccgtcaaaacctgctgggtaagcgtgttgactactctggtcgttcagttatcgatgttggtcctaacctgaagatgaaccagatggggctgccagtaccaatggcaatggaactgttcaagccatttatcatgcatgaattgaccaagcggggcctggctaccaacgtcaaggctgctaaacgcttgatcgataagcgtgacaacaaggtcttcgatgtcttggaagacgttattagtgaacacccagttctgcttaaccgggcacctactctgcaccgtttgggtattcaagcctttgaaccggtattggtatctggtaaggcaatgcggctgcacccactggtttgtgctgcctacaacgccgactttgacggtgaccaaatggctattcacgttccgctgtctgatgaggcacaagctgaagcccgtctgctgatgcttgctgctcaccatatcctgtcgcctcgtgacggtgaaccaatcgtggcaccttctcaagatatggttatcggtaactactacatgacgaccgaagataaggctcgtgaaggcgaaggcatgatcttcaaggatgcaaatgaagcctacatggcctacaaggatggctttgttgccctgcagacgcgggttggggttcaggtttcttcaatgccaaagaagccatttactgatgaacagcgcagtcagatcatggttaccagtgttggtaagctgatcttcaacggcatcatgccagaagactactactacatcaatgagccaaccaatgacaatctgctgaatggtgttcctgacaagtacttcttggataagggtgaagatattcacgcctacttgggaaatgcaccattggttccgccatttaagaagggcttcttgtccgatatcattgccgaagtctacaagaagtacaaggttaccaagacctcgcaattccttgaccgcatcaaggatctgggttactacgaatccacgatttctggtgttaccgtggggattgccgatattaccgacttgaaggaaaagccggcaatcatcgaaaatgctcataagcaggttgctttggttaccaagcagttccgtcgtggtctgattactgatgatgaacgttatgaacgagttatcggcatttggaatgatgctaaagatgaagttcaaaacaagctgattgaacacatggatattcacaacccaatcaacatgatgtctgactcgggtgctcgtggtaacatctccaactttactcagctggccgggatgcgtggtctgatggccgctcctaacggtaagatcatggaactgccagtcctttcaaacttccgtgaaggtctttcagttctggaaatgttcttgtcatctcacggtgctcgtaaaggtatgactgatacggcccttaagactgccaactcaggttacttgactcgtcgtctggttgatgttgcccaagacgtggtcgttcgtgaaaaagactgtggtactgatcgcggtctggatgttgccgcaattactgaaggcaatgaaatgatcgagccgctttacgatcggattctgggtcgttacacgatgaagtccgtctttgatccagaaactggcgagaagatctgtgacaagaacgtcttggttgacgaagagatggctcaaaagatcgttgatgctggagttaagaaggtaacgatccgctcagccttcacttgcaacactgaacacggtgtctgcgaacgctgctacggtcgtaacgctgctactggcgacaaggttgaggccggtgaagccgttggtacggttgctgctcaatcaatcggtgaaccaggtactcaattgacgttgcggaacttccacactggtggggttgctggcaacgacgatatcacgcaaggtcttcctcgtgtgcaagaaatcgtggaagcgcggaatcctaaaggtaaggcaacgatttctgaagttaccggtgaagttcaatcaatcgaagaaaacccagctgaacggaccaaagacgttacgattgctggtgagaacgatacgcggacttacacgctgccaatcacggctcgtcttaaggttgaagaaggcgactacattcaccgtgggatgcaattgaatgaaggttcgattgatcctaaggaactgatccgcgttcgcgacgttctgtctacggaaacctacctgttggctgaagttcaaaaggtttaccggatgcagggtattgatctgctcgacaagcacgttgaaattatgattcgccaaatgatgcgcaaggttcgcgtcatggatcctggtgatactgatcttttgccaggtgaactgatggatatcagtcaattccgtgatgccaaccgtgacacgctggttgccggcaacattccagcaacgtcacgtccggttatcttgggaattaccaaggctgccttggagaccaacagtttcctgtcggctgcctccttccaagaaacaactcgtgtcttgacggatgctgctattcgtggcaagaacgatccactggttggtttgaaggaaaacgttattatcgggaagttgattcctgccggtactggtatgagcaactaccgcaacatcaagccaaaagaagttgctgtagctgccgatgcaccaatgaaatcaaccagcgatatcgaagccgaaatgaaaaagcaaaagtaggctaaagcttttgtgattaaatagtgctattcgtggggcctagtatttggtttgattccgaatgctgggccccattgttatttttgggaatttgctatgaaaaaatatcgaattgatttaccagccaaagcagtagaaaatctagagctggagaaaaatacctctttagtattgatggttgacaataagacattgacaattcggccgagtcgcactgttgaaatgctgcctcagattatgatgcgctggtatctgatccccgcggtgctggcagcagttatctttttctgccttagctggtccaatcatcattgggttatttcattaactggtaactggtcaattggctttgcgtcactttatcttgggacgtttagcggcgtcgtggcttttgcgactgcgtttatcagacaaaaaagacatcgcagcgggccggcgatggagctgcattggcgtaatctgccgacgctgctgattgcttttggaacgattttggcgatttcgatcatgattgttttttggctcgcggagaaaatgtttgcgggggctagctttgatatctatacgtcaactttattcgtttttttatttgttgcagcaatcacctatggaatgcttaatctggcgatgacgatttccgaagcggttattaccaattcaatgatgattatgattattggtggaatgctgttctcaatgctgaccaattcaaatcgtgactggtggcactataatttcagctacttggggacgcagcagaatgctacctattggcgatttaacattactttgattttttcagctctattgatggcgactttagttgattacttgttctttaatctgcagaaaaaatatcctgatcgtggtgttaaggtcctgcgaattctcctgtatgctgaggcagcatgtttaggtgggatcggctgttttccaaatgatccgcaatatcacgtcttgcatgatcgaatctcaatgtggctggtttatattatgattttgatcatcggcctgttaagatggctgatgccagggctgtccagacagtttttaaagatttcctatattattggcggcatcatggcacttgactggttggtgtttaaagctaccagctatctttctttaaccgcctttgaactgttggaattcggtctatcgttttcgtggctgcttttactttttcaaaacctggagtatcttgctcggattggtgatcagatttttccggttcgaatcgaaaaaaatgacgatcatcaatagttgcaatgactagattcaaagttgatctagctcggtgttaatatcaaagtgataacgataccgaggcttaagtagggaacaaaaggcaaagcctgataccgagatcgaaggcttaatattcccagaccagccgcaattaaaacggtagtggcaacaaattttattgaagtacagagctgcaggataaagatcaactcaatatcgccaatgccgatgccgttactggtcaaaaaactcataatcaataaaccgcctaagatggcaatggccgctgacaaacgcagccattgccatttttgatttaaaagccaaaatagactaaacagaccaattagccagattggccagatccactgggcaaaataatcagttgctgagcacaccagcaggctggttgatagtatcaataatgccgttataattttaggatcaaggataaacagttcataccaaagccagccatttatgagctcactaaatgttgagtaacagctgatagatgcatgacaaaaatgacaccgacctttttgaatcagccagccgatgactggaatcagctgccaccagattagctgctggtggcaactatcacagtaggatctttggggatcaaacagtgagatctgattaagcagacgccagataactgtattgatgaaagaagccagacaagcgccccagacagcagccaataattttaagacaatcattttaagtttctcctttctaatattgctatatgcaaaaagttgaatttagcactaaaagaaaaatcgacagtccgttgacattttagaggatgcatgatagggtatttaaggtgctttttttagcaacggattgtgtctgtcgttggggcagatgacatgcgtcggcgaaggcacataaaagaatagcattcgggaatttttttatactcaaaaaagaatcacctggatgtgtggacttaaaaacaagaaaggggtataactacatgccaaccattaaccaattggtacgtaagggccgtaagagccacaagggcaagtcaaagtcacctgccctgggttacgtttacaacagtttcaagaaggaagaaatcgctgcaccatctccacaaaagcgtggggttgcaactcgtgtcggtacgatgacgcctaagaagcctaactctgctttgcggaagtacgctcgtgttcgtctgtccaacctgatcgaagttactgcctacattccaggtgttggtcacaaccttcaagaacactcagttgttttgatccgtggtggtcgtgtaaaggaccttcctggggttcgttaccacatcatccgtggtactcttgatactgccggtgtggaaggccgtatgcaaggtcgttccaagtacggtgccaagaagcctaagaaataattaaaggaggggtaaatcaatgccacgtaaaggacatgttgtaaagccagaagtattgccagatccaatttacaactcaaagctggttactagtctgatcaaccacctgatgatcgacggtaagcggggtactgctactaagattctgtacgctgcttttgaccgcatcaaggaacaaactggcaacgatccagtagaagttttccaacaagctatggacaacgttgaaccagttctggaagttaaggcacgccgtatcggtggttccaactaccaagttccaatcgaagttcgtccagaacgtcgagtaacgctgggcctgcgttggattgttcaatacgctcgtcttcgtggtgaacacaccatggttgaacgtctggcaggcgaaatcattgatgcatccaacaacactggtgcttcaatcaagaagaaggaagatactcaccgcatggctgaagccaaccgtgcttttgctcactaccggtggtaagcttcatcaattgttgatagctgcttagctgtcgactatgatgtgaggggtgacgcagatatttaatcgaacgtcacccctttttctaaaactaatttaaattgatttttttaactggaaggagaaaacttttaagatggctaacaaacgtgaataccctcttgaaaagacccgtaacattgggatcatggcccacatcgatgctggtaagaccacggccactgaacggattctttactacactggtaagattcacaagattggtgaaacccatgatggtgcttcccaaatggactggatggatgaagaaaaggaacgtggtatcacgatcacgtccgctgccactacggccgtttggaaagactaccgtatcaacatcatcgacaccccaggtcacgttgacttcactgtcgaagttgaacgttcgctgcgtgtccttgatggtgccgtaacggttttggacgctcaagccggtgttgaaccacaaaccgaaactgtttggcgtcaagctgacgacttcgatgttcctcgaatcgtctttgccaacaagatggacaagatgggtgccgactttgactactctgttcaaacgatcaaggaccgtctgaacgttacgccattgccaattcaaatgccaattggtgctgaagatgacttcatcggtgttatcgacctggttaagatggttgcctacgtttatgatgaagatgctgaaggtaagaactgggataccgttgaaatccctgctgacctgaaggacgaagctgaatctcgtcacgatgcactgctggaaacgctggctgacgttgatgacaacatcatggaaaagtaccttggcggtgaagaactttctgttgaagaaatcaaagctgctatccgtaaggctactctgtctgaagagctgttcccagttctggcaggttcggcctacaaggataaaggtatccaaatgatgctggacgctgttatcgactacctgccatctccactggatgttaagccattcgaagcaactgatgaaaatggtgaaaaggttgaactgactgccggtgacgacaagccatttgccgctttggcatttaagatcgctactgacccattcgttggtcgtctgacgttcctgcgtgtctacactggttctctgcaatcaggttcctacgttctgaacgcaaccaagggcaagcgtgaacgtgttggtcgtctgctgcaaatgcactccaaccaacaacacgaaattccagaagtgttctctggggacattgctgctgctatcggtctgaagaacaccactaccggtgactctctgactgatccagatcacccactgcaactggaatcgatggacttcccagaaccagttatccaagtttctgttgaacctaagtctaaggctgaccaagacaagatggacaagggtctgcaaaagctggctgaagaagatcctaccttcaaggctgaaactaaccctgaaactggtgaaactctgatcgccgggatgggtgagctgcacctggacatcatcgttgaacgtctgcgtcgtgaattccacgccgaagttactgttggtaagccacaagtttcctaccgtgaagcatttacgacggctgcctctgcacaaggtaagttcgttcgtcaatccggtggtaagggtcaatacggtgacgtttggatcgaatttacgccgcttgaagaaggtgccggtttcgaattcgaagatgccattgtcggtggtgtcgttcctcgtgaatacattccagccgttgaacaaggtctgaaggaagctatgcaaaatggtgttctggccggttacccactggttgacttgaaggctaagctctacgatggtagctaccacgaagtcgactcttctgaagctgcatttaaggttgctgcttctctggcattgaagaacgctgctaagaaggctaacccagttattcttgaaccaatcatgaaggttgacattgttgttcctcaagacaacatgggtgacgttatgggtcaagtaactgctcgtcgtggtacgatcgatggtatggaagaacgtggcaatgctcaagaaatccactccttcgttccactgtctgaaatgtttggttacgcaacggctctgcgttctgctacgcaaggtcgtggtaccttcacgatgacgtttgatcactactctgctgttccaaagagcgtgcaagaagacatcatcaagaaaaacggcaaagaatagttaatcttgttctttgcttcaaagctcgtctgctgttatgcaggcgagctttttcattttctactataatggatcgtgccagatttgcatcaataaaattgaagattgatttataaaaaatatttagcttttttgagaaaagactcgacaagctcaaaaagacgtgggataatactcggcagactgttgccattcagtcgttcactggctgccgttaatttaaaaacatttcgactgatttttttgcgccgcatctgcgtcaaaaaattttcaggaatgttacaaattaaatcatcaagaattaattcaaaaaaaaccttgatacgacggcaattctttagtattatggataagtgcttgagcttagaaacggggattttaaaggccccggggttcagccaaacagtgaaagctgtgatgtggaaggttgcgacacacccggccgctttgccatagggcgtggcggtaatttccacggagctagtcaaattttaaatctgacgaaggagggaataaaatggcaaaacaaaagattcgcattcgtttaaaggcttacgaacaccgcgtacttgacgaatctgcagacaagatcgttaacaccgctaagcgaaccggtgctcaagtttcaggcccaattccgttgccaactgaacggactctgtacacggtgattcgttcaccacacaagttcaagaagtctcgggaacaatttgaaatgcgtacccacaagcgcttgatcgacatcatcgacccaacccctaagacggttgactccttgatgaaacttgatctgccaagtggcgttgacattgaaattaaactgtaattaaaaaactaataacaaataaattggaggtgtactcatgaccaaaggaatcttaggcaagaaggtcgggatgacgcaagttttcgctgacaacggtgaattggttccagttacggtaatcgacgtaacgccaaacgttgttatgcaagttaagacggttgaaaacgacggctacagtgctgttcaacttggttttgacgacaagcgcgaaatcttaagcaacaagcccgaacaaggtcatgcagcaaaagcaaacacgacccctaagcgcttcatcggtgaaatccgcgacgctgaactgggggacgacattaaagtcggtgacgaagttaaggcagacattttcgcggaaggcgaaactgttgatgtaacgggtatcactaagggtcatggttaccaaggtaacatccacaaggacggccaacgtcgtggccctatggctcacggttctcgttaccaccgtcgtccaggttcgttgggtgccatcatcaaccacgtattcaagggtaaggcattgccaggtcgcatgggtggcaacactgttaccatgcaacacttgaaggttgtaaaggttgatctggaaaacaacgtactgctgatcaagggtaacgttccaggtgctaacaagtcctacgttacgattaagaactctgtgaaggccaacactaagaagagcctgagcaagcaacacaactaatcagaagggaggaagaaagtaaatgacaagcgttgcattatttaagcaagacggtagccaaaacggcaccatcgaattgaacgcagacatctttggtattgaaccaaacgaaaacgctgaatacgaagccatcctgcgtcaacgcgcatccatgcgtcaaggtacgcacgccgttaagaaccgctccgcagttcgcggtggtggtaagaagccatggcgtcaaaagggtacgggtcgtgctcgtcaaggctccatccgtgcaccacaattccgtggtggtggtatcgtcttcggacctactccacgttcatacaacttcaacctgccacgcaaggttcgtcaactggctatcaagtcagctctgtcccaaaaggttgctgatgaaaagtttgttgtagttgaatccatcaacttcgacgcaccaaagacgaaggaatttgccggcgttatgaacaacctgaaggtttctgaaaaggtcctggtcgttgtttctgacgaagacaagaacgctgctctgtctggtcgcaacctggttaacaccacggtcgtaactccagctggcgttaacattctgaacgtcgttgacagtcaaaagattgtcatcacgaagtcagccctttctcaagtagaggaggtgctcgcataatggaagcacgcgatatcattttgcgcccagttatcactgaagcatcaactgcagtgatggacgaaaagcgctacacgtttgacgttgacttgcgcgctactaagacgcaagttaagaacgccgtagaagaaatctttgacgttaaggtcgttaaggttaacatcatgaacctgaagggcaagaagaagcgtcaaggccgttacgttggctacactaagcgccgtcgcaaggccatcgttactctgtcagctgattctaaagaaatcaagttgttcggtgacgacaacgaataaattctagataggaggaaaacacagtgggaattcgcaaatacaagggtaccactaatggtcgccgtaatatgaccggattcgacttcgctgaaatcacgaagacgaccccggaaaagtctttgctggcaccattaaagcacaccgctggtcgtaacaactacggtcatatgactgttcgtcaccgtggtggcggtacgaagcgtcaataccggatcatcgacttcaagcggatcaaggacaacgttcctgcaaccgttaaggctatcgaatacgatccaaaccgtactgctaacatcgctctgctggtttacgcagatggtgttaagtcatacatcctggctcctaagggcctgaaggttggtatgcaagttcaatccggtccagatgccgacatcaaggttggtaacgcactgccattgaagaacattccagttggtactgttattcacaacatcgaactgaagccaggcaagggtggtcaaattgctcgttctgccggtgcttctgcacaactgcttggtaaggaaagtgacaagtacgttctggttcgtctggcttctggtgaagttcggatgattctggctgcttgccgtgctacgatcggtgttgtcggcaacgacgaacatgccctgatcatcaaaggtaaggctggtcgtactcgttacgcaggtcaacgtccacacgttcgtggttctgtaatgaaccctaacgatcacccacatggtggtggtgaaggtaaggctccagttggtttgccatctcctctgtctccatggggtaagaagactgttggtaagaagactcgctcacacaaggcacgttcgaacaagttcatcgttcgtggtcgcaagcgtggtccacacactcgttaatgagtaacaaatagctaattacccgagaggaggtacaacaatgggtcgtagtttaaagaagggacctttcgccgacgcttctctgttgaagaaggttgacgcacaaaaggataacgaaaagaagacggttattaagacctggtcacgccgttccacgatttacccaagcttcattggttacactttcgccgtttacgatggtcgcaagcacgtgccagtttacgtacaagaagatatggtaggccacaagctgggtgaattcgtaccaacgcggactttccgtggtcacgccggtgatgacaagaagacgggcaagaagtaaggaggaaatttgatcaatggctgaaaacattacgtcagctaaggcaacggccaagatggtccgtgtttccgctcgcaaggttcgtctggttcttgacaccattcgcaacaagagcgttgccgaagcatttgctattctgaagttcactcccaatggtgctgcttcagacgtcgaaaaagtattaaaatctgcagttgctaacgccgaaaacaactttgacttggatcgggcttcattggtagttagcgaagcctttgccaacgaaggaccaaccctgaagcggttccgtccacgtgccaaaggttcagcttctccaatcaacaagcggaccagccacattacggttgttgtaactgaaaagtaggagggataatagtgggtcaaaagattaatcctaatggtttccgtgttggggtcattcgcgactggactgctaagtggtacgccgaaaaagactacgccgcttacttgagcgaagaccttcggatccgtaagtacattgaaaagcgacttgctgacgcctctgtttcaactatcgaaattgaacgggctgctaaccgcgtaaacgtttcaattcacactgccaagccaggtatggttatcggtaagggtggctctgaagttgaagcactccgcaaggaacttaacgccttgactggcaagcgcgtccacattaacgtggttgaaattaagaagccagacttagacgcacacctggtaggtgtaagcgttgctgaacaacttgaagcacgtgttgctttccgtcgtgctatgcgtggtgccatccaacgtgctatgcgtgccggtgctaagggtatcaagattcaagttgctggtcgtctgaatggtgccgacatgtctcggatcgaatcatactccgaaggcactgttccactgcacactctgcgtgccgacatcgactactcatgggatgaagcacggactacgtacggtgcactgggtatcaagacctggatctaccgtggcgaagttttgccagagaagcaagcaaacaaaaacactaagtaaggaggggaaataaaacatgctagtacctaagcgagtaaagcaccgcaaggttcaacgtggccacatgcgtggtgaagccaagggtggcaagaacgtaacgtttggtgaatttggtctgaaggctctggattcccactggatctccaaccgtcaaatcgaagccggccgtattgctattacgcgtcacatgaagcgtggtggtaaggtttggatcaagattttccctcacctttcctacactagcaagggtgttggtgtccggatgggtaatggtaagggtgctcctgaaggctgggtagccccagttaagcgcggcaagattctgtacgaagttgccggcgtgcctgaagacgttgcccgcgaagccctgcgcttggccggcagcaagatgccagttcgcactaagatcgtaaagcgtgaggaaggtggacaatctaatgaagactaaagattatgttcaagaactgaatggattaaccactgagcaattgcttgaccgtgaaaaggaattgaaggaacaattgtttaacttacgtttccaattagcaaccggccagttggaaaacactgcaagccttaagagcgttcgcaagaacattgcacgggttaagacagttcttcgtcaacaagaattaaacaaataagaatacgaaaaggaggattagcgcatgagtgatgaacgtaatgcacgtaaggtctaccaaggccgcgttgtttccgacaagatggacaagaccatcactgtcgtaatcgacacttacaagagtgccccagtttacggcaagcgtgtacggtactcaaagaagtactacgctcacgatgaaaacaacgaagcaaagtccggcgatacggttgaaatcatggaaactcggcctctgtctgctaagaagcgtttccgtctggttaagatcgttaagaaagctgattaatcccgctttgtgatgatttcgtattcttaattattcttacttactgatggaaggaggacactaacagtgattcaacaggaaagtcggttgaaggtcgctgacaactcaggtgcccgcgaaatcttggtaatcaagatcttgggtggttcccgtgttaagaccggtaatattggtgacattattgtcgctactgtaaaacaagcaacaccaggtggcgttgtcaaaaagggtgacgttgtaaaggccgtcgttgtacggacgaagcatggtctgcaccgtaaggacggttcatacatcaagtttgacgaaaacgctgctgtcctgattaacaacgacaagagccctaagggtacccgtatttttggcccaatcgctcgtgagctgcgtgatgatgactttatgaagatcatctccctggctccagaagttctgtaagattaaccgaaaataaggaggtgcacaccacatgtttttaaagacaggtgacaaggttcgcgtcatcgccggtaaggacaagggcaaggaaggtaccatcaagaaggtcctggtcaaggaaaaccgtgtgatcgttgaaggcgttaaccaaatcaagaaacatcaaaagccaaacaacgctaacccaaacggtgggattattgatgcagaagcaccaatccaagcatctaacgttatgctgattgacccatctaccaacgaacctactcgtgttggtttcaaggtcgttgacggtaaaaaagttcgtgttgccaagaagtctggcaagacgatcgactaaaaattaggggaaggaggaattattgctcatggaaaaccgtttaaaagcaaagtacgaaagtgaagtacgtccagctttgactgacaagttcaactacacttctgtaatggctgttcctaagatcgacaagatcgttttgaacatgggtgtcggtgacgctactcaaaactccaagctgttggatgaagctgttgaagaactgggtctgattgctggtcaaaagccactgatcactaaggctaagaagtccatcgccggcttccgtctgcgtgaaggtatgtccatcggtgccaaggttacgctgcgcggtactcgtatgtacgacttcctggacaagctgatcaacgtttcactgccacgtgttcgtgacttccatggtgtatcaaacaagtcatttgatggccacggtaactacacgttgggtgttcgcgaacaactgatcttcccagaaatcgactacgacaaggttaaccacgttcgcggtctggacattgttatcgttacgactgccaactctgatgaagaaggtcatgaattgcttgctcaaatgggcatgccattcgctaagtaattaaggaggtccacaaattggctaaaaaatcaatgatcgctaagtgcaaccgcccagccaagtactccacgcgtgcttacacgcgttgtgttcgttgtggccgtccgcactccgtttaccgtaagttccacctatgccggatttgcttgcgtcaacttgcccatgaaggacaaattcctggtatgaagaaggctagctggtaaacaaatcaccgacaaaggaggaaaatatcgatgtctatgagtgatccaattgcagattttctgactcggattcgcaatgccaacatggcacaccacgattctgtagaagtacctgcatcaaagatgaagaaggacatcgctgaaatcttgaagcaagaaggtttcattcgcgatgttgaatacgttgaagacaacaagcaaggcatcatccgcgtattcctgaagtacggcaaggatggcgaacgtgtcatttctggtctgaagcggatttcaaagcctggcctgcgttcttacgttaaggctgacgctgtgccaaaggttctcaatggtttgggtattgccatcatctcaacttctgaaggggttgtgactgacaaggttgcccgtgctaagaaaatcggtggcgaagttatcgcctacatttggtaattaataaaataagatcggaggtgtacacatgagtcgtattggttacaaggcaatcgaactgccacaaggcgtagaggtttctcaatcaggcaacgtcgtaactgttaaggggcctaagggtactctgagtcgcgaaatctccccattgatcaagatgaacgttactgacagcgaagtaacgtttgaacgggaaaatgacgacaagaaggctaagatggtccacggtactacgcgtgccaatgttaacaacatgatcgaaggtgtcgttaacgggtttaagaagactctgaagctggtcggtgttggttaccgtgctcaagccaagggtagcaagctgatcctgactgttggttactccaacccagttgaaatggaaaagccagaagatctggaagttaacgttccagacaacacgacgattgaaatcagcggtatcaacaaagaacacgttggccaatttgctgccgaagttcgtgccgttcgttcaccagagccttacaagggtaagggtattcgttacgaagatgaatacatcctgcgtaaggaaggtaagactggtaagtaatcgtctagcagcttagctgcataaataatttaaaatcaaaattaaaagaatcaagaggtgacagttgtgatttctaaaccagataagaacaagatccgtcaacgccgtcacatgcgcgttcgcggtaagatctctggtactgcagagcgcccacgtttaagtgtttaccgttctaacaaaaacatttacgctcaattgattgatgacgtaaagggtgtgacgctcgcaagtgcctcaactctcgacagtgaagtcagtggcaacactaagacggaacaagctgccggtgttggtgctctgatcgctaagcgcggtgtagaaaagaacatcagcagcgttgtttttgaccgtggtggttacctgtaccatggtcgtgtacaagccctggctgaagcagctcgtgaaaacggtctgcaattctaaggaaaaggaggaataacctgtatggcatcacaatcttacattgacccatccaagctggatctggaagatcaagtcgtttcgatcaaccgggttaccaaggttgttaagggtggtcgtcgtctgcgctttgccgctttggtaattgtcggcgacaagaagggtcacgttggttttggtactggtaaggctcaagaagttccagaagctatccgtaaggcttctgcagctgctcaaaagaacctgattgaagttccaatcgttggtacgaccattcctcacgaagttattggtactttcggtggtggcaagatcatgctcaagccagccgttgaaggttctggggttgctgccggtggtgcagttcgtaacgttatggaactggccggcgttgccgacgttacttccaagcgtttgggctccaacacgccaatcaacgttgttcgcgcaacgtttgaaggtctgaaggctctgaagagtgccgaagaagtttctcaacttcgtggcgtctccgttgatcacctggcagaataaggaggacatagatcatggctaaagttaaagttactttgatccacagtgttgcccaccgtaagccaactcaacgtcgtacggttaaggcattgggtctgggcaagatcggcagctccaatgtcctgccagacaacgcggcaacgcgtggtgcaatctttaaggttgctcacttggtttccattgaagaagtcaagtaattaaaaatctacaataaggaggtgcctacctaatgaaattaaacgaattgaagccagctgctggttcccgtttcaagcgtctgcgtaagggtcgtggtctgtcatctggtcacggtttcacttctggtcgtggtactaagggtcaaaaggctcatggtaagactcgtctgggctttgaagggggccaaatgcctctgtaccgtcaaatgccaaagcgtggtttcagcaacatcaaccgtaaggaatacgctattgtaaacctgacgacgctgaaccgttttgatgatggtgccgaagttacgccagctgttctgctggaaaacggcgtgatcaagaacgttaagagcggtgttaagattctgggcaatggtaagttgaccaagaagctgaccgttaaagccaacaagttttctgcttcagctgttaaggcaattgaagctgctggtggtaaaactgaggtgatgtaattgttcacaaccgtcaaaaatgcattcaaggttaaggatattcgtaagaagattctattcaccttgtttgtactgattgtttaccggttaggtgcctctattacggtacccggtgtaaatgctgctgccttagagcagatctctagtaccggcttggcatcaatcttgaacactttcagtggtggcggtttggataactactcattatttgcgatgggggtttccccgtacatcacggctcaaatcgtagtccaacttcttcaaatggatatcgttcctaagtttgtcgaatggagcaaacaaggggaagttggtcgacggaagcttaatcaggctacgcgatggttaacgatcgttcttggttttatccaatcgattgggatcaccgcgggctttaacgcattaagcacgattaaactggttaacaatccgggggtggaaacctatatcacgattggtctgatcttaactgccggaaccatgtttgctacttggttaggggacatgattaccgagcgcggtctcggtaatggtgtttcaatgctgatctttgctgggatcatcgctgaaatgccaagtgggatcaagcagttatggaatgatcagatcactggtgaatctggcgcaaacctctggatgggaattggctttattgccctagttgtggttgcgatattggcaatcgtgacgttcgttacctggtttcaacaggctgaacggcgtttgccgattcaatacacgcggcgaacaactacttcgccgtcaaacagttatcttccattaaagatcaacgtttctggggtgattccagtgatctttgccggctcgtttatctcgacgccgcaaacgatcttaatggcctttcagcaaaatcatagtcaagatacctggtatcaggttatgacaacgatttttaatatgcagtctggtccaggcattgcgctgtatgtatttttgattgttgtatttacctttttctacgcctttgttcaagttaatccagaaaaactcgcggaaaacttgcaaaagcaaggcagctacatctctggcgtttggccgggcaaaggcacgcaggactttgtttcaggactgttgatgcgtttgtcgacggttggatcgttattcttgggattgatttcattgattccactgctggccagcaacatctggaaccttagccaatcaattggtttaggtggtaccagtttgttaattgtcgttcaaattgccttggacgttgttcggcagatgcgtagtttaacgatgaagcgtgagtatattggatttatccgcgaataaaataggaggaattggcaaatgagtacgatgaacctcgttttgatgggtctgcctggtgccggtaaaggtacgcaagcccaagaaatcgtcaaggactttgatatcccacatatttcaactggtgatatcttccgggcagcaatcaagaacgaaacgccaatgggtctggaagccaagaaatatatcgataaaggcgaattggtccctgacgaagttacgaatggcattgtgaaggaacgtttggctcaagatgacaccaaacaaggtttcatgttggatggcttccctcgcaacttggcgcaagccgaagccctcaacaagatgttggctgatgatggccgtaagttggatgcagtaatcgacattgatgttaactctgaagtgctggttaagcgtctgagcagccgaatcatttgccggaagtgtggtacgacctacaacacgctttccaacccgccaaaggttgaaggtacttgtgatgtctgtggttcccacgacttctaccaacgtgatgatgataagcccgcaaccgttaagaaccggttagacgtcaacattaaactgaacacgccactgatcgacttttacaagcaaatggggattctccatgagatcgatggtgaacaagacatcgataaggtttatcaagccgttaaggaagttctgactagcctttaagactcattgttagttgaatccttgcgtaattgtgtactctatggtatactacgcaaggtttatctagcttgcagtggaaggcgcctgccgctttccaccgtttttacgtaattttaccggcaaggaggaaccgttcagtggcaaaggccgatgttatcgaagtcgaaggtaaggttaccgaaaccctgcctaacgcaatgtttaaagttgaattggaaaatggggttgaaatcctggcacatgtctcaggcaagatccggatgcactacatcaagatcctgcctggtgatcgtgtaaaggttgaaatgtccccatatgatctgaccaaaggccggattactttccgcttcaaataagtctttagtctaaaatcatttttaggaggattatttacaatgaaagtacgaccatcagtaaagcggatgtgcgaaaagtgcaagatcgtcaagcgcaatggtcgggtaatggtaatttgccctaacccaaagcacaaacaacgtcaaggcaagtaattatattttagaattggaggtgtaactcaatggctcgtatcgcaggtgtcgacttacctcgtgacaagcgaatcgtaatcggcttaacttacatttatggtattggtaacacgactgctaagaaggttctggctgctgctggtgtttctgaagacattcgtgtcaaggacctgacgccagaacaagaagaaaagatccgtggtcaagtagaccaactcaaagttgaaggtgaccttcgtcgtgaagtttccctgaacatcaagcgtctgcaagaaatcggctcttaccgtggcatgcgtcaccgtcgtggtctgccagttcgtggtcaacacactaagaacaacgcacggactcgcaagggcaaggctgtcgctatcgccaacaagaagaagtaatcaatactataaaggaggttagttagttttatggcaaccaaaaaaggttcacgcaagcgtcgtgcaaaaaagaatgttgaaactggtgttgcacacattcactcaactttcaacaacacgttgatcatgatcactgatgtgcaaggcaatgccgttgcttggtcctcagccggtgtgctgggcttcaagggctctcgtaagtctactccatttgctgctcaaatggcttctgaagctgctgccaagcaagcaatggaacacggtatgaagacggttgaagttgaagttaagggccctggttcgggtcgtgaatcagctatccgtgctctgcaagcaactggtcttgaagttactgccatccgggacgtaactccagtgccacacaatggttctcgtcctccaaagcgtcgtcgtgtctaatcgcatcaacggcgaaattatcattggccaggtgcttttaaacaatctacggaccacgttttgaaaggggaaacagagtagaatgatcgaatttgaaaaaccaaacattcacaaagtcgaagaaactgacaactacggtaagtttgttgtcgaaccactggagcgtggctatgggaccactctggggaattctcttcgtcgtgtaatgatggcttctctgccaggtgccgcaattaccagtatccaaatcgacggtgtgcttcatgagttcagtaccgttcaaggcgttacggaagacgttacgcagatcatcttgaatctcaagaaggtttctttgaagattgaatctgaagatgccaaagatttggaattggatgtcaagggtcctgcagaagtaactgccggtgacatccaaggcgatggcgacgttacgatcttgaaccctgacttgcatattgcaacggtcgccgatggggctgaactgcacatcatgatgacggctgataagggtcgtggctatgtaccagccgatcaaaacaagctgcgtttgagcggtcttgaaattggaactttgccaattgactccatctacacccctatcgaacgggtcaactacaccgtagaaaacacgcgggtcggccaaagcaacgactttgacaagttgacgttggatgtctggacggatggttcattgaccccaacggctgctattagtcttgctgccaagatcttgactgaacacttggagatgtttgtcaacctgactgaagaagcaaaagatgccaaagtgatggttgaacgcgaagaaactcaccaagaaaaggtactcgacaagacgattgaagaactggatctgtcggttcgttcttacaactgcttgaagcgtgctgatattcaaactgttaaggacctgactgaacggactgaagctgatatgatgaaggtccgcaacctgggtcaaaagtccttagaagaaatcaagctgaagctggccgacttgggcgtaggcttccgccaagaagactaattaaaacaattaaaaggagggaaccacttcatgagttaccgtaaattaggacgtactagttcacaacgtaaggctttattacgtgatttgaccactgacctgatcgtcaacggcagcatcaagactaccgaagctcgcgctaaggaagttcgcaagactgctgacaagatgattacgctggcaaagcgtggcgacttggcttctcgtcgtcaagcagctgctttcctgcgcaatgtcgttgctgacgttaaggaagatggcgacaacgttcgcgtacaatcagctctgcaatacctgtttgaagagctggcaccaaagtttgccgaccgtaaaggtggttacacgcggattctgaagaccatgcctcgccgtggtgacggtgcacaaatggttgttctggaatttgtcgactaatcattttcgtcaattcaatacgtaataaagaatcactacagctggtggtatagagcgctacgatggtggaatcataattcctagtctagctcgaatgcgggacgtttatatcttcgtgcaccccagttgtaagtgatttttttgtatatttttaaattggctgcttcactgttaaaataagataatgagttcaaaaagaaatgggtgacgtgattgattgatattcaacacctttcgtttaagtatccggatcgcacacaggcggcgttaaatgatgtaaccttacagctgcccatgaaaaaatggacggcagtgatcggacataacggtagcggtaaaagcaccctggcgcgactgattgatgggcttttaataccaagcagcggtacgattaagattgatgagctgttggtagacgaaaaaaatcttcagcagctgcgacagcaaattggtttggtgtttcaaaatcctgacaatcagtttgttgggactacagttgccgatgatgttgcatttggtcttgagaaccatcagataccacatggccagatgcaggctcgtattgacgaatccttaaaagccgttggaatgcaggactttgctgacagtgagccagccatgctttctggtgggcaaaagcagcgggttgccttggctgggattttagcaatcggtccacgagtcatcattttagatgaagctaccagcatgctggatccaaaagggcgacatgacttgttgaaactgttgaaaaaattaattgctgagcgtgatatgactgtaatttcaatcacgcatgacccagtggagctttctcttagcgattacacagtggtcttggatcatggcaaggtcgcaatgcagggcgaaacaacgactttactgcaagatccggctaaactggctgatctgcatctggcattgccgtttgctcaacaactgcagctgctgttgaaaaaacgggggatcaatgtgccagcacaatatttagattcagaacggatggtggagtggctatgtcagcaattgaattcttaaacgttgattatatctaccaagccgatacgccaatggctgcctgggcaatcaaggatttttccttaaagcttgaaactggcagttttacggcaattgtcgggcatactggcagcggcaagtcaacgctgatggccatgctggatggattattggtgccaacgcatggccagctgcgcgtaggcgaggtcgtaattgacaatcgggctgacaagaaggcgttggcaagactgcggcaaggggtcggctatgtgtttcagtttcccgaaagccaactgtttgctgaaacggttttaaaagacgttatgtttggtccgctaaatctgggtgtttcacctgctcaagctaaagaacaggcactgacggctttagaagctttaaaactgcctagtgacatcaatgaacgatcaccgtttgaactttcgggcgggcaaatgcggcgagtggcaattgctggtgttttggccatgcatccaagcgtattgatcttggatgagccgactgcagggttagaccctcaagccagtaccgacttgctagatctggttgatgagcttcatcaaaaaggtacgaccattttgatgatcacacaccagatggaacaggcagctcgttttgccgatcatgttttggtaatgaaccatgggcaaaaagccgcttttatgacgccgcatgaactgttcagcaatgcagctctgcttaatgaagctggcatcatgccaccagccagcgttgcgtttgctcaacagctgcaaagtcatggcctgcgcttagcggatagcgtaccgctgacgattgaaaaactagcggatcaattaacgattagacttaagcaagggggacgagcaaatgggtaatgccaaggtaatactgggcgcgtacgtacctggaagctcgtggctgcatcatcttgatccgcgcgttaagcttttcagctgtttttggtacgtggtgattgtctttttggcaagcaactggctgggatatctgtggctgtttatcgtactggggactttgattgcattgagcagactgccattgaagctttattggcgcggcattaagccgttattttggatcattttgtttacagtggcgattcaactactgttcagcagcggtgggcacgtttattggcagtggggctggttggcaattaccagtggcggcttttatcagtcggcaattattttggcgcggtttattctgatcatcaccatctcaactgttttgactgccactacgccaacgcttcaattagcggcggccatggaagcatttatgaagccgttgcgttatctgcacgtgccagttaatcagattgccgtcatgctgatgatcattttgcgctttatcccaaccatcatggatgaaacaaccaaagtgatgaatgcccagaaatcaagaggcgttaactttgacgaaggcagtttgattgagcgtgccagacgactggagccgcttttgataccattgttcgtcggttcatttaaacgagctgaggagctggcaactgcaatggaggcccggggctatgatccagatgcaccacggaccaaatatcgggtgctgcattggcatcgaaatgacacgctggcgatgattggcctgacattagccaccattattctcctggcgacgcggctgatgtcagcaggaatgctattttaatttgaaaggaattatcaagtgtatcgctacaaaataacttttgcttacgatggaaccaatttttccggttttcagattcagcctaataaacgtacggttgagcagaccttgaaaaatgccgtcaacaagattgccaagaatccagaaccgccattgtccgtaattggttcaggtcgtacggatgcgggggtacatgcgctcaatcaagtggcgcattttgactgcccatataagctggggaatgattcaatgcgtaaagccttaaacagtcttttgccgctggacatcattgttaaaaaagccgaattggtcagcccggactttcacgctcgctttaatgcccattcaaagcattatcgctatcgagttgatcagagtgatttcgttaatccgtttaaacgcaactatacggcccatttcaaatatccggtcgacgtggctaaaatgcaaaaagctgctcaagatctggttggcgagcatgattttaccagtttcgtggcatcgggaagtcaggctttaagcaatgtcagaacgatctatcaggcagatgtgcatcgtgatgaggccaataatgagatcgtctttgactttgtcgggaatggcttcttatataatcaggttcgcattatggtggcctttttattagagatcggcagcaatcagcgaccggtcgatgatgttatcagggttttggacgctaaggatcgcaatcaggcccgcatgacagcgccagccagcgggctttatctggtcagtgttgattatggtgatcagaataacaaaaccattgacgaatcggaatctatcaagtaaaataacgaatggtatttcttttccatctaattactcggtacacaattatttgtaaaagaaagacaaaaattggaggacttaatcgtgagaacgacatacatggcaaaacctggtgaagttgaccgcaaatggtacattgtcgacgccaagggtatctccctgggtcgtctggcatccgttgttgcttccgttctgaagggcaagaacaagccaacctacaccccacacgttgacactggtgacaatgtcatcgttatcaacgctgccgaagttaagttgactggtaagaaggctgctgacaagatctactaccgtcactctgactaccctggtggtctgaagcaaaagacggcgggcgaacgtcgcgccaacgaaccagaaaagctggtggaagattccatcaagggcatgctgccacacactcctcttggtcgcaagatgggtatgaagctgcatgtttatgctggtgaagatcacaagcacgctgctcaacaaccagaagtgcttgacatcacgaacttaatctaaggagggaacggaattggctcaacaagttcaatacagtggtactggtcgccgcaaggatgctaccgcacgggttcgtctggtaccaggttctggtaacattacgatgaacggcaaggcaatcgaagaatacattccgtttgccaacctgcgtgctatcgttaaccaaccatttgctgcaacgaagacggaaggtcaatacgacgttctggtcaacgttcgcggtggtggcttctctggtcaagccggcgcagttcgtcacgggattgctcgtgccctgctgagcgtcgacccagatttccgggatgctctgaagaaggccggtctgttgactcgtgaccctcggatgaaggaacggaagaagccaggtctgaagaaggctcgtaaggcttcacaattctccaagcgttaatattttttaccggaaacggcttaatatcaacacttcagagatttggaatggtcacatatggttcacaaatcatttgcgatcaaaaaaatcaagcatcagcatccagctggtgcttttttttatatttttgcaaatttagcatttcacagttttttaaatgattttagtttggtaaaatgcaaaatagaactttaaattacgttaaacaaacagggggaattatttgtggcaaagaaacgccgctcaaaaacgcggcactcaaaaaagctgtttcaacatcgctggctgattggtattttaacggtcatcgtactctttttgggtgcctacgttggtcatcatttctaccaacgctaccagcaacagcagattatcgaacgtcaacaaaatgccaagcgtctgtttatcaagcaggttgctcctgaagctcaggcaatgcagaaaaaatacaacgttccagcttcaattaccattgcccaggcaatcctggaatccgactggggcagcagcaagttggcggctaaataccacaacctgtttggcatcaaaggaaccggcgaaaattcccaggttctgacgaccaaagaatacgtaaatggtaaatggatcacgactaagggccgttttaaggtttattccagctggagcgagtcaatcaaggatcacaccaagctgatgattaatgggacggattacaacagtcagaactatcaagccgttacccaagcttccgactacaaagaagctgctaaggcgctgcaagaggcccattatgcaaccgatccggattacgcccaaaaattaatttcagtaattcagacctataagttgtacaattatgataaataagccgttaaggaggactccatgaaagaactgcaggaaaaaattaaagagtatggtacggttttacctggcaatgttttaaaagttgatgcctttttgaatcatcaggttgacccagtcctaatgaaacacatgggtgaagaatttgccaagctttataaggatgcgggcgttaccaagatttggacggttgagtcttctggaattgcaccggccgtaatgactgggctggcaatgaatgttccggtaatttttgcccgtaagcataaaagtctgactttaaaagatgatctgtatacggccagcgtttattcatataccaaggaaacgaccaatcagatctcaatctccaaaaaatacgtcagcccaactgacaaggttttgctgattgacgactttttggcaaatggtcaggcactggaaggaatgctccagattgctcaagcagcaggcgttgaagttgccggtgctggcatcgtaattgaaaagacgttccaaaaaggtggtcaggaactgcggaaacagggactgcgcatcgaatcattggctaaggtcagctcattagccaatggcgaagctgaatttgaagactaactgctaatgggggtgggctaatgagcagtacaaatgcattatatccaggagcgacgctgggcattatcggcttggaccgcaacggcagcaccctgattactgctgctaagcgggctggctttaacgttggcgtttatgtcgatcatgcacagcccattttaaccaaacaggcagattttacgatcagtggggcctacaataaccaggaaaaactgacgatgtttgcccagacgtgtgatgctattatctatgccaacgacttgatcgactccagcgtcttgcgctatctaagccgtgatgcctatctgccacaaggagtcaacgcgttggaaatcgttcaggaccgtttgatggagcgggcatttttggaccagatcaacgttaatgtagcaccatacgttacggtaatcagcttggatgacgtctatcagtccattgactcaatcggctatccagcaatcttaaaaccaattcaaagagggattggcgaacagtcgatgagaatcgttaaacagtctgatattacccgtgcagctgattttatcaatgcgggaacctatcttttggaatcctggattgatcacactgctgaatatacgatgctggcagctaccgatggcgaaaacgttcaggtgtttcctgcgattgaactgatgctgaatgccgatgagcagctgttgggagtcaagacgccagctaatctgagcgcggatatttcccgggaaatggagcggatcgtaaccagtgtagctgaaaacctgcagtatcgtggcgtctttcgtgtcgacttctacgtaacggcaactggcaatctgtatgtccatggaattgagccggggctgtcgacttatggcagtgtttttgactatgccactaatgtttcgcaaactgagcagcttttgcgggcaattgccggaatgccgctttttgaggttcagacgctgcagccgaccgtgatgatgctggcacgggtagcacaacgcgcagccctgcagcggcaatggctgttaaaagacaactggcactatcgtttctttaccgaagtgcgggaggatccgcaagcagtagctggattcgtctgggcagtcggtaagtctagcctggaagaactacagcatcaaatcgaggataccgaggtttggaatgaaaaagcatcaaccgattcaaacctggctcctgatcagcaataacctttatgcgagcagcgctgagcaatcgttgctcgttttttaatgagccacgggaatttgctataataaagtctatgataattttaagagaggatggaaatacggcgtgacaagtcaattactgcaaggaatgaatgataagcaggcagaagccgttttaactacggaagggccgcttttggtcatggctggtgccggttcaggtaaaacccgagttctgacgcatcgagtagcctacttaattgaagagcagggggtcaacccttggaatatcttggcaattacttttaccaacaaggctgcgcgtgaaatgcaggagcgggtgggcaagctgttaggcgaaagcgctcgtgatatctgggtttcgacttttcatgcgctgtgtgtgcgaatcctgcggcgcgacattgataagctgggctataaccgtgcctttacgattgccgataccagcgagcagcgaaccttgatgaagcggatctgcagtgagctgaacgttgatactaaaaaatatgatccacgggcaattctgagtgcaatctccaatgccaaaaacgctatgcagacggcaacagactatgcaacgcttaacagtcatgccaataatccgctcaatcaaatcgtggccaaggcttacgtgctttatcaaaaggaactggaagacagtcaggcgctggattttgatgatttgatcatgaaaactattgagctgtttgaaaaggatccagaaacgctggaatattatcaaaataagttccactatattcacgttgacgagtatcaagacaccaatgacgcacagtatcaactggttacgctgctggcggctaaatacaagaatctgtgcgtagtcggggatgcggaccagtcaatctacggctggcggggtgccaacatgaacaacattctgaattttgaacgcgattatccagaagcacatacagtcatgttggagcaaaactaccgctcaacccagacgattctaaaagcagccaacgaagtgattgccaacaacctggttcgtaaggaaaagaatctgtggacagaaaacggtactggcgacaagatttcttattatcgggcccaaaatgaacatgatgagtcccagtttgtcgtcagcaagattcaagctgagattaaagagcatggctaccactataacgattttgccgttttataccggaccaacgcccagtcacggatgatcgaagaaacgtttatgaagtcaaccgtaccatataccatggttggtggccataagttctatgatcgtaaagaaattcgtgacattctggcttatctgaccttgattgtcaaccctcgcgatgccatgagctttgagcgggtcgtcaatacgcctaaacgtgggattggcccaggcagtatcgacaaattgcggcagtttgccaatgaaaatggctggtcgctattagaagccgcccaaaacgttacgctggctaatgcaatcagtgcacgaattcgagctaagattgaagactttggtcgcttgatggctgatctgaccaaagaggccgactatctgaccatcactgagctgactgatgagattttgaccaagagcggttatctccagatgttacaggccgaaaacgatctgcaggcgcagtcacgtcaggaaaaccttgaagagttcaaatcggtaacccaagaatatgatcaaaagcatgctgaagatgacgttgacaatcgacaaaaactcatgaacttcctgtctgatctggcactggtttccgatcaggatgacgttgatgaagaagcgcctaaggtaaccttgatgaccctgcatgctgccaagggtctggaatttccggtgatctttttggttgggatggaagaaggaatcttcccgctttatcgctccttgagtaatgaaaaggaactggaagaagagcgacggctggcctatgtcggtatcacgcgggccaagcgcaaactgtatctgaccaatgcctactcacggatgctctatggtcgcgtgcagcgcaatcagccttcgcagttcgtcgaagaaatcaatgatgatctgatcaaatttgaaaacgcggacggctcgggcaaggcaaagagtatgaacacgccgtttgccaaggcagctgctcaggcaacaacctttacggctcagcggcgcgcacatggcctgaagcactcagctaagcaggaaagtacgggaactggggctgataagaaggcctggaaagtcggcgacaaggttcagcataagaaatggggacaaggcatggtcgtttccgttaatggctcaggcaacgacatggaattagatattgcctttccaaacgagggcgttaaacgcttgctagctcagtttgcgccaattaccaaggttaattaaaagcgaggcctgcaatgacagaacaaaaatcagtcaatgacttgacgcttaaagaagccacggcagaaatcggtccgttgaaagcccagctgctgcagtggggcaaggaatattatgaacaggatgcgcctaccgttgaggactatgtttatgaccgtaattatcagcggctggttgacattgagaatcgtttccctgaactgatcacgcctgattcgccaacgcaaaaagtcgggggcgcagcggaaaccgtcttgaccaaagtcgaacatgccattccaatgctttcgatgggggatgtcttttccgtcgccgaattaatggactttaatgctcgccagcaggataaccctaattttaccgggacgacagaatataatctggaactgaagattgacggcctttctttgtcactggtttatgaaaatggtcgtctcgtgcagggttcaacacggggtaacgggatgattggcgaggacgtcaccgaaaacgtcaaaaccatcaaatcgattccgcaaaagcttgccgagcccttgtcactggaatttcgtggtgagtgcttcatgcccaaagccgcgtttgctaaattaaacgaggaacgcgaagccaatggactgccaacgtttgccaacccaagaaacgccgcggctggcagtctgcggcagctggatgccaaagttaccgccaaacgagaactggatacttttatgtactacattcccgaatatgaaaagctgggcgtcaagactcaggcccaggctttagataagatgcggcaattaggatttcacgtcaatgaatttaatcgtgtcgtgcataatgaagcagaaatcaaggactatatcgatgaatacacggccaagcgcgatgatctgccatatggaattgacgggattgtcgaaaaagtcaacgatctcgccgttgaagaggcactgggcgcgacggttaaagtaccgcgctgggagattgcctataagttcccacctgaagagcaggctaccgtagtcagagatattgagtggacggttggtcgaacgggcaacgtcacgccgactgcagtgatggatccggttcagctggctgggacgacggttagccgggcttctctgcataatcccgactatctaaaagacaaggacattcgcctgggtgatacggttctattgcataaggccggtgatatcattcctgagatctcacgcgttatcttaaataagcgtccggttgacagtcagccatatgagattccaacgctttgtccggtctgtcaatccaaactggttcacctggatgatgaggtagcgctgcgctgcatcaatccaatgtgtccggcacaggtaaaagaaggtctggttcattttgcctcacgcaatgccatgaacatcgaccatctgggaccaagagtaattgagcagctctgggatcgtcatttggttcatgatgttgccgatctgtatcgtttaacctatgaccaattattaacattagataaatttggacccaaatcggctaataacctattgacatcgattgccaacagtcgcaataattctgttgagcgtctattgtttggcttgggcattcgtcatgtcggtgccaaggcggctcgcatcttagcccagcattttggctctctggcagcaataatagcagccgatgaggaatcgattgccgagatcaacacgattgggccaacgattgccgacagtctgaaaaactattttgccaacgagcaggtgcaggaattgattcaagagctgcaggcggctggtgtcaatctggaataccatggaccagcgccgatcgctcaagacagcgcggcggccaaagaatggcagggcaagcgcgtggtcttgacgggcaaactcaatgaaatgacgcgcgatcaagcaaagcaatggttggaagaacgcggtgccagcgtaaccggcagcgtgtcgaaaaaaacagatttggtcatcgctggagaaaaggctggctccaagcttaccaaggcccaggatctgggagtcgaggtctggaatgagagccgatttgctcaagcgatgaaggaggattaacgtgaaactacagaagctaaaaaagctgacgctgacggtagtcgtgttgatgagcacggtacttttggcctcatgcagcattggaaagaaaacctcttcgtcatccagcaagcttacgacgacggggactgccagtggtcagtatcaaggcgtcattcaaaatggccattacaaggtcagcaaggcgcgtggtgtcaatatcaaccaaaatgacaacagctacaacctaaagagttttgaaaccggcttgacggaagtttccaaaaaggtcttttcgactaagagctatattttccaagaaggccagtatctgagtacggatacgattgaaaactggctgggacgcaaaaccaagagcaatccaaccggtttaaacgccgcccagggtaaaaagagtgatccgaacccagaatacgttcagcagattgaagaacaagacttcatgcagcaaaacggcaattcgctgaccttaaaggggattaccattgggattgggatcaactcggtctactactaccaaaagacgacggacggtcctacctaccaaaagaaactttcggatgctgaaattcaaaagcagggtaagattgctgctcaaaagatcttaacgcggctgcgcaaaaagtccgcgctaaaaaacgtgccgatcgttattgcattgtacaagcaggcaccaaatgacagcctggtagggggcagcttctttgcctatagcaagaacaacggcaataccatcaagagctggaagaaattgaactactcaaccaaggtgctgccaaaagccagtgacgctacttcaaccaacagcgacaatgagactgacaacacgagcttctccaacttcaagagtcagattcaaagcttcttcccgaaccttagcggcgtgacggctcaggcccaatatcagaatggcacgctttcggggatgcacattacggttacgacgcagttctacagccagtctgaagtgcagagctttacgcaatatattgcacgcgcggccaagaagtatctgccaaacggaattccaatcgatatcaagattcaatcgtcttccgaaatgcaggcggtcgtctaccgtgattctggttcaaatactttccgaacccatgtcttcagctcatattaataaaatttaaacgtcatcgcgcttgcggtggcgtttttgttaaaaacagcgggctttgtgtgataaaatagatgaacgtatgcaatacctaacttaaggaaaagaggagaaagaatggctagtcagatcgatcagcagcaggttaagcacgttgccgaattggccaaactagaattcaatgatgccgagcttgctaagttcaccccacaactgggcagcatcatcgatatgtttgaagaactgcaggcgcagaatactgatggcgtggaaccaatgtattcgccaacggatcgcgtcaacgttatgcgtgaagacgttgcagtcaagagcaacgagcgagaagccctgcttaaaaatgctcccgacacggaaggcggcttgattaaggtgccagcaatcatggatgatgaaagtgaggacggcgaataatgaagttcaatgaaaccgacttgactcagctgcatgaagacctgcagaccaaaaaaatcagcgccaaggaactgaccaaggcagcctttgaccggatcaaggaaactgatgatgacgtcaaggcctttatcacgctgaatgaagatgaagctttaaagcgtgccgaagcaatcgacaatgaaggaatcgcggcggacaagctgctggctggggtgccactggcagtcaaggacaacatcgtaaccaagggcttaaagacgacggcggcctccaagatgctggaaaactttacgccaatctatgatgccacggtaattgaaaagctgaatgcccaagacttcattaatgttggtaagaccaacctggatgagtttgccatgggtggctcaacggaaaactcggccttctttacgacccacaacccttgggatctgacgcgggttcctggtggttcttcaggtggttcggcggctgccgttgcggcgggtgatgtcattggcgctttggggactgatacgggtggctcaattcgaatgccatcatcatataataacgtggtcggcttgaagccaacttatggtcgggtctcacgctggggggcaattgcatttggctccagctttgaccagattggctggatcaccaacagcgttaagaacaacgcgctgctgacggaaatcatcagtggacaagacgatcacgatatgacttcttcagatcgtcaagtgccaaactgggctgccagcctgaacgaaaacacgaatgttaaggggcttagaattgccgtgccaaaagaatatctggacgaaggaattcagccaggcgtgcgtgcggtaatcaataacgccttaaagcactttgaagaactgggtgccatcattgatacggatgtttcgatgccgcataccaaatacggcgtgccagcctactacatcctggcctcatcagaagcttcatccaacctgcagcgttatgacggaattcgctatgggttccgagctccagatgccaaaacgctggaagaagtctacgtcaagtcacggacgcagggctttggtgatgaagtcaagcgtcggatcatgctggggacgttctcgctttccgctggtttctacgatgcctacttcaacaaggctgctaagattcggacgctgattgcgcaagactttgccaacgttttgaaggaccatgatctgatcatgggaccaaccggcgctaacccagcttttgaaatcggttctgagattgccgatccaaagacgatgtacatgaacgatatcctgaccgttcccgttaacatggctggcttgccggcaatgtctctgccagccggctttgacaatggtctgccagttggtctgcacatcatcggcaaggcctttgatgaacaaacgatctacaatgccggttatgtctttgaacagacgaccgacttccacaaacaaatgccaaagttagggggtcaagactaagatgaactttgaaacgaccattgggcttgaagtccacgtggaattgaagacccactctaaaatctacagtccaacgccagtagaatttggtgacgagcccaacgccaacaccaatgttatcgactgggcctacccaggtacgctgccaacgttgaacaaaggcgtcgtgcgggatgggattatggctggtctggcactgcacgcccaaatctcaaagcacatgcactttgaccggaagaactacttctatcctgacaaccctaaggcctaccaggtaacccaatccgaaacgccaatcgcacatgatggctggattgaaattgaggttaatggcaagaagaaaaaaatcgggatcaaggaaatgcacattgaagaagatgccggcaagaacacccacacgagcaactactcttacgtggacttgaaccggcagggcacgcctttgatcgaaatcgtctccaagccagacattgcctcgccagaagaagcggtggcctacttggaagctttgcggcagcggattcagtttactgggatctctgacgttaagatggaagaaggttcgatgcgggtcgacaccaacatctcgattcgtccaatcggctccgacaagtatggtaccaagacggaaatgaagaacatcaacagtttcaatttcgtcaagaaggcgctgaactttgaacagcagcggcatgaaaaggtcatcatggctggtggcacgattgcccaggaaacgcggcgctttgatgaggcaaccggcgaaacgatctcaatgcggaccaaggaaggaagcgacgactatcgttacttcccagaacctgatattccacctctggaagtcagcgatgaatggatccaagaaattgaagatgccatgccagaaatgcctggtgaacggcgcgctcgctataccaacgatctgggcttgagcgaatacgacgccatggtattaacgcagaccaaggaaatgtctgacttctttgaggctacgattgccttaggagctgatccaaagaaagctgccaactatctgatgaatgatgtcaacagctacttaaacgacaagcaggttgatctgcaggataccaagctgacgccggccaacctggcagggatgatcaagctgatcgatgatggcacgatttcttctaagatggccaagaaagtctttaaaggaattctggatggtcaagaaccagctgcctacgcagaaaagaatggtctggtacagctttccgacccagccaagctgcagccaatcgttgatgaagttttggccaacaaccaacagtcgattgaagactacaagaatggtaaggatcgggctgtcggcttcttagttggtcagattatgaagcagacgcgcggtaaggctaacccaggcgtggtcaacaagcttttgatgaaggccttgaacgaaaagtaaactgatttgatggcggaggaaactatgcgaaaacgagcacggattatttataacccgacgtcggggcgtgaagccatgcgcaacgacctggttgacatcttagcggtctatgaacaggcgggctatgaaaccagcgcgtttgccacgacgccggcgcctaattcggctaagaacgaagcaacgcgcgcggctaaggaaggctttgacctgatcgtagcagcaggcggcgatgggacgttaagcgaggtcgtcaacggaattgccggacttgagcatcgtcctgccctggcgattattccggcggggacgaccaacgactatgcgcgtgccctgcggattccgcgtgatgatccgatcgctgcggccaagctgatcttgcgcaaaaacaaaaagttcaagatcgatattggtcaggctggcgacaactactttatgaacattgcggctggggggaccttgacggagctgacttatgaggtgccttctcagatgaagtcgctgtttggctatctggcctacctggcaaaaggggctgaactgcttcctagaatcaagccggttgaaatggacatcaaatacgatggtcatgaatatcgtgggcaggcttcgacgattctgattgccttgaccaattcagtgggcggttttgaacagatcgtactagacgctgcgcttgatgatggcaagtttaccatgatcatcgttaaggaaagcaatttaatcggcatgatgcgattgatggccaaggctttgcaaggtaagcacattggcgatcctggtatcatctacgccaaggccagcgagattgacgttacgcccgttgatccaaaagatcgcgtcatgatcaatctggatggcgagtatggtggcgatgcgccgatgcatttccgcaatctcaagcagcacttggaagtcgtcgccaacctagatgagattccggatgatgcaatcactatgtcaccagatatgaagcgggtagaagactactttgtacgcgaggtcgacaatatccacgacgacgattcatcacaaaaataatagaaaccaaacaggggctgcgggcaatcttgtcagcagtccctgtgtttgctaaaggagagaaacatggcaaaaatcaatgtaccggtttataaaggcgaggtcttgacggcaacggtagctgatctgacctatgaaggcaatggcgtcgtcaaggttgataattatccggttttcgtgccgtacgtcttgcccggtgaacaggccgaaatcaagattaccaaagtgacggctaaatttgcctggggagagctgcagcagctgttgaccaaaagtccggaccgcgttgagatcaatgatgcccgttatttgaaaaccggcatcgcccccttgggaattctcagctatccggcgcagctgaaatttaagcagcatcagattgaagaactgctcaaaaaggctcacttggatgaattgaaggtggcgccaacaatggggatggaccagccatatcactaccgcaacaaggcgcaggtaccggtcaagtatatgcggggccagctgcagaccgggttttataagcggggcagccatgatctggtaccgattgaggatttctatattcaagatccgaaaatcgatcaggcgattctggttgtccgtgatctgctgcggaaatacaacattcgtgcctatgatgaaagaactggccgcggctgcattcgaacggtcatggtccggcgcggctactacagtcatgagatcatggtggtgctggttaccaataccaaacagctgccgcatgccgaagaaatcgcagccgggatcgtcagcggggtgcccgaggtcaagagcatcgtgcaaaacgttaacaccaagcggacgaacaagctcttaggattggagaatcatacgctctggggcagcgatacgattcatgatcagctcctgggcattgactttacgatttcgccgctgtcgttttaccaggttaatccgcaacagaccgaaaaactttatcaaacggcaattgaagcagctggactggatggtacgcagactgtgattgacgcctattgtggcattggcacgatttctttggcggtggccaagcatgccaaaaaggtctacggggttgaaatcgttccagccgcgattgaagatgccaagcaaaatgccaaggtcaaccagatcgataatgccgaatttgtagtgggtaaggccgaagaacagatggcgaaatggcaaaaagaaggcttgaagcccgatgtcttgatcgttgacccgccacgtaaaggtcttgatgaatccttgatcgatgctgccggtaagatggcgccagctaagattatctatgtcagctgtaatcctgccactttggtccgcgacctgcagcgctttgcctctgtcggctaccatgtcgtcaagccaatccagccagttgatcagtttcctcagaccccgcatgtcgagagtgttactgtccttgaacgtacagaaaaatagccgataaaccgcgctctgacggtatttatagatgattgaaagtgtacttttttccttctgaactattggaaatagtacacttcttctatttgaagctggcgggtcgagtgttctatgtcctatttcgatagtcgagtagacgattgtccagtttggcaggtcgtgtcgattagggtagtggaagtagaggtgagccttgatatggtagcgtttgtggtatgtacgaatcggtcagttttgtactaaggattgagttaacaaaaataatattgaatttatgctaattcggttagaatatcgaaaattcgcaggggagttgtatactcgacgtatatgacaaaaattattctttttaaatacatatagaataaacatgatgattacgaacgaaggtgctttcatgaaaaataaaataagtgataagaatatgtttcagaattttgaggtaaaggtctactggtttcttaatgacaatcaaaattccggctcttacggttttttaaaatggcctttaagaatttcgatggaagtccccattttttaccaatatgtttttgaattaatttctgggcctttttatgtttaccttgactagccaaccaacttggcgaggctggtagtttagcaaccgaacgaaaaacagcagtcactaagcctaaaatggctgatgaagctaaaataatttgccaattgcggctaccaaagccatgaattgttattccggctatgtaagaaaagataaaaccaatagtccaatagattatcaattggctctgtttttttccactttcattgagtggcagccactccactaacaatgaattaccaacagtgtaatcaatagcaatcattaatccaataaagaagcagatcagaaataaagcaattgatttatttttagcagctgaagaagggagaaaagagaaaatacatacatatcaatcataagcatttttcgccgaccaatacggtctacaattctacctataatggcactccccatcaatcccagtaaactaccagctccaattaggccaacccaaaagtcattaatatggatataattttgggcttcgctgagggcggttccactaatacctaatgcatatccacacgccatctgtccaaggataatagctaatagtacctttaagtgaaccttctttattggtgcccttttataattctttttagaatagttttgattaattatcgtaatctttatcttctcctttcttcgatcaacttaataaaacgcaatgggcaaaaataagtaccatatgttaaaatttccagatagttggctatacataactaacaagtcttaatacatctcgctattttttaatggcgggaccttattatcagttagtcaataagtaattaaaattacaaggaggcaggaccattatgttaaccaatacttttatcaaaaagcttacgaatgacagtaaactaaatattgagaatcttgtaatcctaacatgtgcaatattcattgctagtattggattgaacatgaactcaacagcaacgattatcggggcaatgttgatttcaccacttatgtctcctttattagctattggtactggactggctatttacgacataaaattaattaaaaacggtagtacgacaatcctcgtagaaatcattattagtcttttagcttcaaccagttatttctttttttcaccgctttcttatgcaagtaaagaaattatcgctcgaactagcccaactatttgggacgtaatgattgcattcttcggaggagtagcaggaattattggtgctagcaaaaaagaagctactaacattgtaccaggcgttgctatcgctacggcattaatgcccccgctttgtacagttggctatggaattgcttcgcataatttaacattctttctaggtgcctcttatctctttttaattaatgcagtatttatcattttaactgcatttttaggagttaaggctatgcggtatttaagccatgctaataattattctactagcttttttcgtttgcctactagaaaagagtttttctttataattgccatattatcattgactattccaagtatattttctgcaaaacaaatggtacaacaatcaattattgaaaataatgtccataaattagttgcgtccgaatttgctgattcactagttattaaagaagatattgataaccaaaataaaactattaacctgacaatctctggctccaaagaaaattctcaaaaaattaaacgtatcaaaaaaagcttaaccaattataaccttaaagactattcattaaatgttatccaggtagcgcagcttaatgcagcaactgagacgcagctaaataatcaggtaacaagtatcattaaccgacaaagacaaacagaagatgagaagaataaaaggcgtttaatcaagcaaaataaacaaaacaagaaaattgctaagttatcacataatattaattctgtcacttcagttagtgacactaacaacaatcattccatcattgtggaacttcacaagaaaataaatcgtgaacagaaggaacaattgacgataaaaataaaaaagaactttcctcatattgataaaattgaatatgtattagaggattcctaaaaaagccactattaacaaagattattgcttaatatctgtcataaagcgtaatgaaacacaaaatagtaatccaattactatgtcgatctctttgtgatttctaaagacttgcttcgcttcgacggagggttccctacaggctagcttcgtgtcgaaaaacgaactagcaagctagttctgtctcctttttcagtctgtgatatttaactcgaaagcgattcgatgcgtatctgttttataatcatatcgaaaattcgcaggagagttgtatactcgacgtatatgacaaaaatattcggctttatggttagaatctttattttacaaaaattagggataaccattgataaaccaaagatacttaataaatttaagaatgttttaactactcattactattaagtaacacgaacttactgtaaattaggtttaataaagatcagaatgtttaaaatagcacccagccaaaatagctgagtgccgtacaccataaatttcacatattaactctaattacttcaccatctttgaacgtgaattccatgtagcgttggaagatggtgattttttctactaagcgacgaaccaattgttcatcaaagtcaactaagccatacttgtgcaattcgactaatttgttgatttcatcaaggttgtgtagtttggcttgttgatcagtttcacgactttggactttttctttttgcttccgcaggtccatgatttgctgggttagtgcgtcgcagtcttgatgctggttagcagcttgaattaatttcatctgcacttcttctagttgcttatcgagctggtcaagtgttggtcctttggagcttttgatgactttcatgatgtttgcttttatctgtttactggctaactcgtggccttcgattaactgattgaaagcttcaacagtggcttcttttagaaggggttctttaacgtttcgaattatgcagcggcgaccagttttacttctccttatccgactggcgcagcgccagaccgctactttttctggtcgataccacatgttccgttggagaatatcaccgcatttaccacagaataatttttgagagaagcaatatttgccgttcaggcgtctatgcttaccgtttttagtggtgattccgttacgtcgttgtttgatgatctgctgtacttgcatgaaaacagacttgggaataatcgccgggtgatcattttccacgtaatattgtggcatgatgccttcattcttcactcgttttttattaagaaaatcaacggtgtaagtcttttgtaaaagggcatcacccatgtatttttcattctttaggattttagccacgctgctagagcgccaattttttgttttgccaccagtcaagataccatcagctttgagcgaatcggcgatttgtttcatagtcattccgtttaggtagctatagaagatccgtttaatgaccttggcttcctctggttcaactactagatttccctgagcatctttggtgtaaccgaggaagtgattatgattgacaaacaccttaccttgttggtaacggtattgaatccccattttgacgttttgcgataaggactcactttcttgttgagcaagggaagccatgatggtaatcagaacttcacctttggcatccatggtattgatattttctttttcaaagaagattgcaacattgatggcttttaagtctctgatatacttcaggcaatcaatagtatttcgagcaaatcggctaattgacttggtgacaattaagtctattttaccggctttacaggctgcaatcattttattgaattgttcccgtttcttggtgttggttccggagattccatcatcagcatagatacctgcaaattcccaggttggttccttttgaattagctctttgtagtgagctacctgagtttcgtaggagctagcctgctcatcatagtcggtcgaaacccggcaataagcagctacccggagcttttcaaaaggttgtgaactacgttgatgatggacgctgtttccttttggctgatgggcaggaataatgcgtactttacccaattaaatcaccttcattttcgataatactgtacaaatattctgcttgtttgattggatcgttataacgttgtttgatgatactacgaaagaatttttcatcgacggtggcagctttgtttagcttttcaggtaacgctaatccgcatttcaagatgaaggttgctttgtttgaactgttaaccacaatctgttggacgaactcttgaaatataccttcatcaaattcagtaagctttttcctttgctggcaccaattcaacaaggtacgaacatcttcaaaattatttgctgaatcggtattcttaccattgagctgtttaatcttttcttgacattggtaagtgtcttgctcgagcttagtggtttggttgatatagatggctcggtcgagtaacccagtttgcatcaattgggttaatgtttcagccttatggtcgttggacttgatttgcttatttaaagaaatcagttgaccatcgctgttggcattagcttcttctttcagggcttctaacaatggctgtaataagaacttccgactgtgaaccagtttattcatcatattacagaaggctgcttccaaacctgcttcagacactgctttagttgggcattgtttagcagaccttaaatgtttttgacaggcccagtaaattttatggggacgtgtttgccgcttaaaagtagtcccacaattaccgcagatgatttttccagaaaaaaggtaatggtgttggtatttatggctaccagtttcgatatggcgtttttgggctgcttctttaagcaagacttgagcccggttaaaagtttcgtggttaaccaaactagggtgatgctcttcaattaagtattgggggagttcaccttggttaaaatgacagtgatattgatcatcacggtaagttttctgacagagcatatcactggtgtaattgatatttcgtaagatattgggtgtgtcaataattttgtgtaaaaagggatcttcctgtgcgtatgatgaagtctgatttttaaaacattgcgtcaagcgtgtctttacagttggtaaatccagtgctggtccggcgtattctggacagattctgatcataggtcgctaataagcggttggctgcagtaaaaaagttatcggcgcgttatttgccacagacaataaaaacagccgcagtatactaaaaattaagcgtgacggatggctgattcatatggcaaaattattaaaaagattagtgtagtcagaattgccgaccaatgcagagatatgggggattgccatgattatttacggaactaaagaaacaagaaaagtctaccatatgccattgtctgatcagattgtcagtccacttttgcgtctaacgattgccaatactaagcaaaaggaagcaggcgatcggctctttgaatggggcgctaaagtcttttactttgaaggatcgcgttgcctgcagctttgtaattttgccagtaagtttacaattgtgatggcgcttgtaaccgatgacatgattaaacgtttgccagaatacatttttgaatatctctatgatgtttatgctggtgatcctcagatgaaaaaactgattgatcgttatctagccgacaatactatcatgtttttcgataagctgactgatcgtgtaaccatcagcagcatgaattattttcaggtttattttatggatgatggcgaccgcttttatgactttgcggaaggcaatctgattcgcacgcgggcattgaacaagaaagtcaattgtgactatttaatggggatgacgattgatggcaaaaagacctacatctatcctgccgaaaaatttgcggaattactgaaagccagatacagctgattttgccagtcaaaaggagggcgcggtatgaacttctactttcttttattcgataaatttgaaactttggatctctttggaccggttgaaatctttggaagaattcccgatgcacggcttaactatatctcaatgaagggcggaatcattactagcgcacagggcactcagattttgacgcaaaaagcacccaaactgccagatgacgtggtactggtggttcctggcggtcggggtacgcggccattggtgaaggatgctgattttttagtgggattaaaggaccttgccgattcagctgccaatgttttgtcaatctgcacgggatcggcattgttggctgcggccggggttttggtaaatgttaaggcggcatccaacaagtatgcttttgaatgggtaacgagtacgggggatgcagtctggattagaaaagcacgctggattcatgatggccgtttttacacgtcatcgggagtttcagcgggaattgacatggcactgggattcgttgccgatcattacggtttggatgttgctaaagccaatgcacaaaaggccgaatatatttggaatgaagattcagaagttgatccgtttgcttaaaattttaaaatgaaatcttttttcgttatactataaacaaaatagtcaccggaggatagtgtgccgcagcacaggggatcgcagttatctgcaggccgcctatcagataaggtgtcgggtgagtccggttagatgttttggcatcgtcgggcttttttagtaccggcattgatttaaggaggcttttaattatggtagaactgattttgctgcagccagctgaccgggaacaatttatcaaggacaatcaatgggcctttagatatggcgcgttggcagaatttggcaagcgcaatgaccaatttgaagagggcgacgagataatcgcgcgccaaacgattgagaactgtattgatcaaggcacggcctatcgtatctggcaaaatggccaaaaagcaggcggggccgttgtaaatattaaaggcgatcatggcagtctggagctgctgtttgtcaatccaaccatgcatagtcatgggattggtaaagctgcctggcgagcgattgagcagatgtatccaaaagtcaaagtctgggaaacgatcacgccttattttgaaacgcgcaacatccatttttacgttaacaagtgcgactttaagatcgttgagttctataatccgcgccatcctgatcccagctggtcggctgctgataatcaagtcggctggctggattttcgctttgaaaaaagaatggaataggcgttatcattaattaattcctaaacacgactatttatttaaaggatgatgaaatggcttctttattattaggtgtaatttatttgatctttgtcagtctggggctgcctgattcgctgttgggatcgggatggccacagatgcaggctgcatttaacgttccttcatcatatgccggctacgtctcaatgacgatcgcttttatgaccatcatttcggcattgctgagtcctaaactgattcagagatttcataccagctggatcgttgtgtgctcgattctgctgacgattgtggggctgtttggcttttcgctttgtactgagtattggatgctgctgattttcgcgattccctatggcttaggggctggcgcaattgatgccgcgatgaatcattatgtcgccagctattattcaggcgctgtgatgaattttttgcactgcttttatggactaggggccgtgatcagtccatatatcatggcattggctctaaagacagcgcgttggaatgagggctatcgctggacggcttttttgcagacggggattctgctggtcgtattgtgttcattgccactctggcatcaaaacgagcagcccgatgaaaagcaagccaaggcggctggtgcgggaatcaaagaagcaatcagacagcggggcgtgattacgacgctgctggccttttttgcttactgtgctggagaagccacttgttttttatggacgccaagctactttgccgggacgagaaacggtttgagcgaggagacgattgcctcatttggctcgctgatctttgggggactaatgctggggcgcttgttggcgggaatgtctgccaaccgctttggtgatcgcttgatggtcagaatcggcgcggcagttgagctggttggcattgtgctggttatgctgccgactgctgactaccagattgcagcagttggctttgtcgttatcggtacggggatgggaccaatctatccatcgattcagcacatggcacctgctaactttggccagcgctacagtgccgccgtaattggtctgcagatggcggcagcctatactggcaccacttttatgccgacgatttttggccttttgcagcagcaattcggcatttggatcatgccatactatctgctggtgtttgcggtgcttaatattggccttttggagcttacgtatcaaaagcttcgtaatcaaattcggtgagcatcacaagttcgatgaatcaatctgcttaatgcagttacgaaattggactggttggagtagactgtgaatcaatcgctaggtgatgaactgttgaaaagctcagccgtttctgcttcggcgtcaacttaatcggttatgaggtgatctagatgaaaatactgcatattggcaagcagggaaatctacagcggttcgcagctgctgacggctttttgaattctttggacctagttgatttaaaaccagatctgccagttgaagaataccttagtcaagctggcgacgcggactttatcgttgctgacgcgattgcagcggtaccaggagccttgattcgacaaatgcctaatctgttggcaatccattctgaaggcgttgcttttaatgcaattgatctaaaagctgcagatgagtgtggtgtctacgtctgcaacgcgcagggcatgaatgcaatggcagtagctgagcagacgattttactgatggttgggatgctgcgcaatattgttgtaaatgatgcggcagtacgagctggtcaccagattgaggcaaaggaaaactatatgcaaaacggcagcttacatgagctggccgactgcagcgtggggctgatcggctttggcaatattgcccggcagactgctcgcttgttaaaagcctaccaggttaagaatatttactactacaagcgtcatcgactggatccagcacaagagcagcaatatggcgtacattatcgtgaattggatgacttattggcgcagagtcaggtcgtcagtctgcacctgccagtaacggaaacaacgcggcatatggcagatcagaccttttttgccaaaatgcagccaggcagctacctggttaatacggcccgtggcgaactggttgatgatgcggcactgattgaagcgctcaagtctggacatttagcgatggctggtcttgatacgctagatcatgagccagtcttaaaagatcatccgctgttgaatcagccgcgatcgattgccagtagcctgctgtttagtccgcatattggcggtattaccgcagccagtttttatcgcggctatgccatgattgatgaggatctgcagctggttgctcaaggtcaaaagcctaagcgtatcgtcaatcatccccagattcctaaagcagattaagtcgcttaacaaaattacagatttcaacctaaagcgctgcactggactaaagtcagagtggcgttttattacattgacgacctactcaaaatggctgctgtcggtggtggttgacttaggcaacagctcaaaaatcttttatttaccattgacttatagttaactttaagtagtagggttagtcataaagggggattcggaatgtctgatatgacgatcactgaagtaagccgcaaatatcatctcaatgcggcaacgcttcgctattatgaacgaattggcctgcttcccaaggtgccgcggcgcataaacggtaatcgctattatgatgctcacctacagtcctggcttgagatgatcatctgcttgcgtcattcaggcgtgccagtggaagaattggtaaaatatgcccagttgcttgagcagggcgattcaacgcttgaggccagagaacagctgttgaaagaacagttagccatgttgacccaaaaacgcaaaaatcttgatcgctcaattgaacgtttgcagcataaaatctcgctttacgaaaatggtgagatcaagcagaatcgatcttattttgaagagtatgacattttagacgattaaggaagcgtgcgatatgaaaacaataattaatctttttcatcctaattttaaacagtcgcgggttaataaagggttggctgaccaggttaaaggcgagtttgaggtacgcaatctagctgagctgtaccccgactttatgatcgacgtaaaaaaagaacaacaggtactggaaagagcagatcgggtcgttttacagtttcccatgcaatggtattcgtcaccagcgctgctgaaacagtgggaagatcaagtgctgacctatggctgggcgtatggaaacaagggaacggcactgcatggcaaagagctgctgatcgccgttacggtaggggccgacaactatgggcatgatgattttgtcggttacacgattgatgagctgctgcgaccattgcaggcaaccagtcatttgattggaatgcgttatttaaagccgtttgcggtcatgggcgcttcttcaatcagtgatgagaatctgcaaaaagcagctgaagaatatgagcagtacctcaacaaagacgtggcgatgcttgatatttttaaatagtttgacggagggatggttatggaatatacgaaacttggcaaaacggatattgagatctctcggctttgcgttggctgtatgagttttggcaaaccaggaaccatgcatgactggacactggatgctgctgacaccgaaaaagtggtcagacatgccctttcgctgggaatcaacttttttgacacagcgaacggttattctaaaggtaccagtgaagaatacctgggccaggcgcttaggaaaaacgtagctcgtgatcaagtcgtaatcgcatcaaaagtgtactttaatcctggacgtctttcttcaaccgcgattcatcgtgaaattgacggtacgctccagcggttgggtactgattatctggacctatatattattcaccgttttgattacgagacgccgattgaagaaacgatggcggcattaaatgatctggttaaggctggcaaggtacgggcaattggtgcatcggctatgtatggctatcaattctacaacatgcagctcgcagctcgcgatcatggttgggcaagctttcaggcaatggaaaatcactataacctgctttatcgtgaggacgagcgggaattgattccgatctgccggcaaatgggtgtctcattgattccatacagtcctttggcaggtgggcatctgacgcacccatactggcattcagatacgctgcgcagccgaacggaccgagttttagcaggtaaatatgatcgagcgcagggaaacgatatgcagattgtcaagcgagttcaaaaattagctgagcgctatcacgttaagatgcagcaagtcgcattggcctggcaatgggcgaaaggagttgcggcgccgatcgttggtgcaacgaaggcatcctatcttgacgatgccgcaacggcacttgatctgcaactgaccaaacaggatatagcctatctggaagcgccttatcaaccgcatgcaatcgtaggagcaatcgaccataacccagctgaaggaacagttttgatcgatgaaaagaaagataccaatcaatagatctgcccagaattcaggcttcgttaagcgggcaggtaatataaaaacgctgactgcctttttgaatcagacgatcagcgttttattatttgatgcgggcgttccaatcgattacgccgttttgataggcagacggctttaaaagcgaagccagcttgaattgatccagctcttgataaaaactgtcgaaggcgcgttcaaacgcatgcgtgattttctgctcactttgctgagtatgcactttatcggtaaagatatgctgagccaagtgactgagctcgagctgctcgttgctgagattaagcgcgtcaaaaacgtccttgatactgatgccttcgattgagcgtgccagctgatagccgccatgcttgctggcactggaagtaatcaaaccattttttttcatgaccattaagatcttttttagataggagtctgagacctgcaggatctgacttaagacgcggctttttatcggggcatgatctttttgcagggccagaatgactaagacgtagattgcttgctcaacgcttttgtttactttcatgctgtttctccagtttttttgccggccatcaaaattgaatgatacagacgatgggcggtattaattgccagcttgactaaccatcggcttggcaatccaagctcaacggttcactcgatacgagtcaggttctcatttagtggcgtaaagctgatctgtgtaaagtcttgtcttactttaggcaggcgatattgaatcaaacggtcaggctgccgttgagtaatgacttcagaataccagctggctatcatgatgatatcacgtcgcgcgtccggaagacagcgaaccttgcgccaacgagagttgaagacgatcggggaagccaaatagttttcgcaatgatcgaaccagacaaacgtatcatacaaaaaagcattgatacgtttcctttttatgagcgataatttttgcgactccaagcattgcagccattcgcagcaggttgggatcatctcgttaccagtgagcgccagccagttttactgtacattgatattgagtagccaccgcgcctaagattgatttggattatcctttttgcagctgcttgatcaagtcattggcaacgtcattaacgtcaaccgggcggaattttttgttaaagattcccaatacttttaacaatggcacccatctggtcatatcatcacggcgtccgttaccatataccagcgtaggcgagacgaccgccagagaaattccgctttgttgcagttttttaatgatctgctgcttgcccttgataaatgtttttggtccaagactgcccgcgataaagcccatcttcttaacatgatgactttgagctaagtgcagcatgacggtagctggttgatcattgagccgtttgaatttttctggatctttttcaggcgcgccaacaaagtcaacaatgtaatcgacatcggttgggataagtttggccacagcatcatagtcagtgacatcggccgttagattatggatacgggggtcttgaagctggtttttgccagaccgcgacacgacgtagaactcaacttggggatctgctttaagccagtggtcagtaacattgcgacccaagtagccattgcctcctaataagacagctttggtcatcattaattcctcatttcttgttcgttttaggttaatatatatcttaggatatttattgtcaacgaatttttaagtttaagcagcaaaaccattattgtcaaagatttagaatggagaataaaaagttgattgtcagcgttgaataatcaaatacccagtagttatcagtcatatcatactgatgattgccgggtttttactttttttgcaaagatagcgtttacagcaatggcgaatggttggcagtcaattgaaagactcggtttacaaaagctttacccgttaattacaaaaacgtggggttagtcgttacgttgcttgagtaagataaaccccgttgaaatgcaacgaaactttcaagcacatgaggtgaaatgaatgtccattgaactgaagaatctctcaaagtcatatgacggcaataccttgacgctcaaagacgtctcggtacggatcgaaactggcgagttctttgccattgtcggtccttctggctgtgggaagagtacgctgctacgcatgattgccggcttgattccagccactgacggcaatgttttaattgatgaaaaagacgttaccaacctgccgccccaagatcgtaacttaacgatggtgtttcaaaactacgcgttgttcccatttctaacggtcaaagacaacgttgcctttggtctgaaagcgcgcaaggttgaccagaccaaaattgatcagcgggtggtcaaagccttagagatggttgacttagcagaacttggcgatcgcaagccaaaggaactgtctggcggtcagcggcagcgggtggctttagcccgagccattgccagtgatgccaagatctgtctgatggacgagccactttccaatcttgatgcccagctgcggactaaaatgcgggctgagattcgcgaactgcaacagcaccttggcttaacggttatttatgttactcacgatcaagtcgaggcaatgacgatggcggatcgaatcatggtactgcatgatcatgaggttcagcagattggtacgccgctgcagatttatcaagatcctcgtaatgcctttgttggtcagttctttggcacaccgcggatgaaccttttggaaacgacgccaaacgaaggtcagctgcaaaccgctgctcccctttattttgccaagccagctgagattgagccgcacaactgcctgattgggattcgtcccgtcaacttgacgattctgacggatgtatcagatgccaatgcccgaattgaaaacgtagaatatctgggaacgcagctgatcatcgaagcaacgatggatgatggacaagaggttcgcatcgtgcaggatactgaacaagccgatttgtatggggtcaaccagcggatcaagatcgtaccaaacggcaaattctttatttttgatcaaaagggtcaacgcatcggtcaaggcgaggaggaaattgaagatggaacgatcaccgaagcaaaatacgctctcagctaatggcgccaagtcatatgccaagtcgtcatttcgtaccaatcaaaaagatggctggtatgcggtgctgtttttggggccgtcattactgctgctaacgacttttgtcttttatcccatgcttaagacgctgtatctgtcattatttattactgatagtctgggacagccaaaaatctttgtgggcttaaagaactacgtatcgctgtttacttccagcgcctatctggccagtgtgcgcgccacgctgatctatgtactgtttgtctgtgtcttgacgattgttttggggttgcttttggcacagaccgcaacggctaaactacgcggcataggtttctttagaacggctttttcggcaacgatgggggtttccgtttcagtggcggcaattttttggctgtttatctttaatccatcagttggtttaatgaacaatattgccaaatttttacacttgccggtcatcaattggctggctgatccaacctgggcgatggttgccgtgattattacaacggtttggatgaatctaggctttacgtttttggttttgtttggggctttgcagagcgttccgccgaccttgtatgaagcagcccagattgcaggcgtctccaagcgttaccaattcttccacattacgctgccgatgatttcgccaaccttgttctttgtctgcatcgtgaccttgattgaggcattcaagagctttggcctgattgatctgatgacgactgggggaccaaacaacgccacgaatctgatggtctaccgcatttatcaagatgccttcttaaacggcaattattcattagccagcgcggaatcgattattctggcggttattattgcaatcttcaccctgattcaatttaagttcttggaaaagagggtcaactactgatggataccgttcaaacatccaataaaagcaaatggggacaatacctgctgctgatcattctggcaattatcattttggtgccatttgtcatcggcttttggaccagtcttttgccaaccgcggaaatctcgcaaggcaagctgttcagcaccaacatctcgctgcgcaattatgtttcagcgattaccacgacgtcaattctgcgctatctttggaacagtttggtgatcgcgactttaacgacgctgtttcaactgattttctgttcaatgagcgcctatgcgtttacttttctgcattttaaaggacgcgatgccttgttctatgttttcctggcaaccatgatgctgccgtttgaagctgaagtgattcccaactttgccacgtttaagagtctgaaccttttgaacagctattcggtaatgatcattccgtttatgatctcagcatttgggacgttcatgctgcgtcaggcctttaagcagattccgggtgaactgaaggaggcttgtgatattgaaggactctcgcattttcagttctatggcaagtgtgtgctgccctatgccaaaattagcctgctgaccttggcttcatatagtttcctttcaacttggaatcaatatctctggccaatgctgacgacgttttctgacagtttccgccccgttcaagatggtctgcggcagctacagtcgaccgaaacgttcaatgattggggaatgattcaagccagtgccgcgatcgtggtgattccgaccttgatcgtactgtttattggacaaaaagcctttaagtcgggagcaaacgagggggccatcaagtaatgaagcagcaagcagtcaaatttttcagtcgtttgttgttggcattcagctgcttattcctgtttgccacgactttttccagacccgttcatgccgcggaacgcaccaaaatcgttttttggcatgagatgacgggaccggccaaagagcagttggtcaagttttgtaatgaattcaacaagtcacaagacaaatataccgtggtacctgaatttgaaggggactacaatcaagtcgtgcaaaaagttctaaacacgcatggaaccaatacttcaccggcactgtttcagtcaatggacatttccacggcacagatgcactacagcaactatacaacgccagtacaaaaatttattgatgaggatcactatgatatgagcaagatctcaccaatggcgcgcgcgttttattccaaagatggcaagcagatttcaatgccgttcaactcatcgcagccagtgctttactacaatgccacgctgctgaaaaagctgggggttgctgcaccaccaaaggatccatcctattcagacctgaccaagacggccgaggcaatctatgaaaagtcgcatcacaaggttcatggaatgagtgttgagatctatggctggttttttgaacagttcctggccaatgccaacgtctgcatcgccaataacaatgatggtcacagcggcgtgccgaccaaggtttcgtttaataattcagctgcgatcaagacaatgcagtggctgcagaaaaacatcaagagtggtgcttttatgaactatggagcaggctccaatgctcagaccaacgagcaggcggctttcttgtcaggcaagctggggatgttcttgcagtcgtcaggctcgattacgcaattgacgactgggaccaaggataagattggtgtctgctactacccgcacatggatggtcaaaaagctaatggggttgccattggcggggcgtcactatggatctcaaacgataagtcagctaaggttcagcgcggtgcctgggaattcatcaaatatctgatgaccgctaaatcacaggcacgttggcaggcagcgaccggctatctggcattgaaccgtgactcgcaaaaagaaccggtcctaaagaagctctataagaagaatccagcggccaaggttgccagcgaacagctgcagcgtaccaagccaaataaggccaattcagggattttcatgcagaatctggttcaggcgcgcctgcttgagcaaacagcaatggaacagatttatggtggtgcggatgttaagacggctctaaacaatgcgcaaaaatcaatgaacagttatattcaacagtctaatcaagcaaatggatttggcaaatagcaaaaaagctttgactctcatatgagggccaaggctttttgctgtcaggctgagcaagaacaattggattcgcagtcaacggatggtttgatgacttggaaggtgattggcaattgtgaggggtagtaattgcgacaattgtgggagctttaataattgcggtaattgtggtgggtgcaaacgattgctcactgaaatagggcttgaaatggattggcagattcgcagacagttgctctccttggtttcgacaagcagaggtttggttgaaacgtatttgatgcaatctctgcaaagccgttgattagttaaagcaatgtaacaaaaaactagatagagtaatcataaataaaatgataggctggtgatgcagtatcgcaatttaaggaagcggatctgcgcaatttggttcagttagcgaatcaaaaaagcagcgatgattattaatcaggctgctttagcgtttttaaagaaaatattcaaaaaatagtgtataaatcaagatgacggaaagaccattacctacttttaaaaaaagcgatgtatagtaggtaaaatcgaatgtatattgatttttaggagttttcattgggtgtgtcaataattttgtgtaaaaagggatcttcctctgcatatgatgaagcctggtttctaaaacattgcgtcaagcgtgtccttgcagctggtaaatccagtgcgggttcggcgtattctggacacgttctgatcgttgtaggtcgctacctgcgtcatgacgaaacgatccagggcatcttcattgggaaactgctctttcttgtcgatctgacgcttgagctgcttgttaaacgattcgattacgttcgtggtgtagatcgtggagcgaattgcctcggggaagtcgtagaacgtaaagagcccgcttaactcagcgggttgcggggagatccttggccttgcgaatctctttgaactcaccgacaacatcaccacggtcacctttgcgaacgtagccgtaaagattgcgctcaagatgaacccagcaccgctgaaacttggcctgagggtagtttcgctcaatggcgccttggagtccgaccataccatcggcgataaacagctgaatgtcggtgattccccgctggcgcagtccgctaagcagctccgaccagacgaccccgttttccgttggggcaatacagtagtccaacacctctttggtcccgtcactgcaaataccgatcgcaatattgactgcctctcgctcaacggtatcgcggcgcagcggaatgtaggtcgcgtccaggaagacacagacatactgcgactgcttgaacttccggttgtggaactcttcgaccaggctcgctgtctgtttggtaatgttggacaccgtcgctggcgaatagtactggccatacatcttctcgatcagttcggcgatttctcgcgtcgtaatgcctttggagtacatcatgatgatcgtttcttcaagcgttgaggtacggcgggcgtagggctcaaacagggcattcttaaacagccccagtcgatcgcgtggcgttttgacggtgaggtcgcccagcgttgagtcaaaggaccggttatagtagccattgcgatagtttcgttgcccatcctgaccagttcgcgcgtaaggctcatagcccagtacggccgtcatctcattttgcaggaactgattgacggcatcttcgacctgggcccgaaacagctcttttaaagcagaatcgacatctgccagtagcgcggtaatgatatttttgatagaatcttccatggggaaagcctccgtattctgattggtttttgacgatttcaatcatacggggagggctttccctttttcaatatctcctttaaatttacacaaacaattttacactccagaagaactggttactactaagctcagaaatctgcaacgggcggggaaaccaataatatcactagcgacaagctcttaaccagaaacggcttgaaacggaaaattccgagatcaagccacataatcaaattttatctatttatcttgtacacttgacaggattatagcctagcgctatgtctgtttttctaaatctcgttctctttccgaatcaacactaaaactgccagtaaatagaaaactacaccggtaatcaacaaagctgctacggacatccatgctgacgcggtatgcccgttatacacaaatacaactcctagaatctccttagtttcttttaaaactgctgtcggttgatttgcaaaattctctttgatagaactttccattaatagttgccgatagaggacggctgaatgagcacacggaaaatactttaccagccattgaacgttttctggcagattaccgattggaatatatgcccctaccaaaaagccgattaaagtcccgactatcatactggcagctgagtaggcactgttggtcttcaaaaaagaaattatgaaggaagcgattgctgatgaagcaaaggctgacaagacgattacaccaaatagcttgagtaaaatatccatatccagtactgctccgccaatcatacccatgtagatttctccaaaaatcaaggtgaaaatcgacatgatgatacttatgataaagccagtaatgatatagcctcctgcaatctgtcgtcgactgactggggatgaataaaagtccttgatagttttattctctcggtcgctgatcattaccccgtaagctcccaaactagtagtgatcgatgccgaagccaacatccccgccaacatccaagccctcatcagccggttaggatgtggcaaaaactttaaaccactgcttatcgagtcaccaataaaaaagatgtacaaggcaaaaataatgattacactcagcattgagaagaaaacagcagctttgtcttgaaagtaaatcttgaggtttctcttgaccattattttcattctcgtaggctcctccctgtaatgttcaaaaacacgtcatccatcgttccgtgcaacacttcaaaactctgtagctggttccgtgctttttggacaatatcaatggcatccagtgtgtctgttaactcaacctcatagtagtcttccatcttgctccaggtaaatgaaaagcttcccagtaaactatccagatgctgctctttctttgggtacagtctcaatcgatcatagctgtagcgctcttttagactgattggacttcccttcgcgacaatttccccgtgatctagaattattacatagtctgccatagctgcttctgccattatagtgggtcgtcagaaaaattgtcatcccatgctctttctgcaagcgttggattgtcttccaaatatgctgtcttgtttgcggatcaagccctgttgttggtttgtctaagaagagaatctttggcgtgtttaaaagggctcttgcgatatccactcggcgcctttgcccacctgacagtttcccatactgacgcttaagcaggtccttgatctctgtgtattcgactgcacgatcaacggcgtctttaacttctgccttgttgggataataaaaaccggctctaagcgttaagttgtcagcaaccatgagtttcttatccaaaagtccctcttgaaacacaatcccaatcttctgtttgatagtttgagcttgcgtctttatatcaaagcctgccaacttaatctctcctgaatcgaatttggtcaaagtcgataagcagtccaccgtcgttgatttgccagctccattagggccaagaaaagctaaaagttcaccttcacggacatcaaaagaaatatcattgacaactttcaagtcaccataagatttggaaagatgcctgacttcaattgcattttcgattgttctacagctcctttctttttattctcacaagaatctatagtacccctaaaggtaacactggaaataatgaatcaattctccacaatcacgtgttcatttattctaatcgtccttcttagactcatcatcattttgtgagtttttcttcgccccgtcatcaaagaactctttgatgatcctggctgctgaaccactaagaatgactggtctgctctcgcgcgtaatccttttccaaacaaagaacgaacgcacaaaaacaatcacgctgatgccgccaatcataaagaaatactcattcgcataggcgcgcatcgttaggaagccaaccaaaaaagctagtaccatctgacccaaagcaagtcttccctgcttaagctttcttctcgaccccaagatcttcattttccatattaatcgactgcgtttgtctaatctgggtgtgttttctagattgcggagtaactgttttctttcattcaaaagcaacattgccaatacagacatcattactataactacaatccccaaagctcttacttcaatactcatcatactgcccctagcgtcttactcagcactcccaatcatcactaggaatgcctgtttgtatattaaggataactcaatttagagatatattctgcttgatcgtaaggaatgttggtgcaaattatatactcgctataaaattctaagacaccagctaatgagtatcgacttgcctgatttttgaacggctcaaaaaaaactcctttttcagttttctgtaatttaaagagcataagggaaatcgatccatgaaacctcatggacccgccagtgacggggatttgacgtggataccaattttctcggttcgcgcctataatgcaccctcaacaagtacgcttcgctgcccaaaatgactccgcaatgcgtccatcaacgatttacgaattctgcactgtacgtggggtattgtacattttgaaattgccattcttgtacaatttaacgctgccatttttggacattttcatactaccgttctattaatttttgcgacagcagagagatacaaatatgccttagcagctcggcaatttttgttcaatacactccatcagcaatcaaaaaacaggctcgtggaatctccacgggcctgcttttcataagttggtctagtcttcaccaagctttgcaagaatctgatcgtaaaccttgtctacaccgattccagtcagcagcggaaggccattgataaccttgtcgcgaacgtcttctggaacaaccgtcgtgctgacaaacacatcgtaatcatcaatattgttgatctgttcggcaatgttgctcttgtagatcttgaccttgtccaacaatccttttgaatccagaaagtcgcgaatctttccttcagcaacagtggaggtagcaacaccactaccgcaaacaaccattaatgtcttcatagtaataatctccttccaaatttaaacaaatctaggcagcaggttcagtcttcttggcttggctcttcttgtggaacttgttgtaccagatcatcaatgccaaggtaacgacaccgatcaagccgataccgccccaagtcatgatcttgccaaggccaacaacgacccaggtagtccagacaccaccgtcactaagaacggaaattgaagtgttgccttgaaggctgaagttggcagcttttgcagaagccgtaaccagtggagcaacccaagaagcaatgtacaggctcaagatgatgtccacgatcccaccaaccagcgtccggaaaatgtcgccgcggaatacggcagccatgatggcaatcatgtaagggatggttgccaagtcaccaaatggcagcacgtggttacctggcaggattacggcaatcagcagcgtaattggaaccagcagcagtgaggcggacagaaccgtttcgttacctacagcaagcgcactgtccatcccgatgtaaaggttccggcctgggaagtgcttctgaaccagttcgttggcaccttcagagataggagtcagaccttccatcagcagtgaaaccatccgaggcatcaagaccagaacagcagccgttgaaacaccaagctgcagcgtcttggtaacagagtacttagccaaaataccgattacgataccaatcagcagacccattacgccagagtcgccgaagattcccatacgcttttgaatcgtctttggcgtcagcttgatcttgttgataccagggatacggtccatcagccagttcagcggcagggccaatacgtagcctggtgccgaggcgccttgtgggaacgaaatgccatccaatccatattgcttttgaacgtacggagcagacatatcggcaagcagataaatgaccattacgtgaacaaccatcgtaaagatcccaagcgagaaactgtgcgaaaccgcgtagacaagggaaccagtaaaggcaatgtgccagtagttccaaacgtcaacgtccagcgtctgcgtcaatcccaacagcagcagtacaacgttggtgataacgccaaccggaatagccagactccccagaacggtaccgtaagcaatggcagaagcagccggccaaccaatgtcaatcgtgccaaggtgcatcccaaagtttctaaccatggcatgcgaggcagggccaagattcttggttaacagactaatgaccaggttcaagccaataaacccgatcccaaccatcaaaccagctttgaaggccttgcttggcttgatccgtaaaatcaaagcaaagataaacagcagtattggaagcataacgcttgccccaaggttaacgaaccattggagtcccgatgctatagcactcatatctttatccccctttagctctattcaattatttcgttcttcttcatcaaatcgagaaaatcattcttctgatcaattttttgcaaagcgtccatggcttcttggttttggaagagtgccatcagcttttgcagcatgctcaattggtcgtcagactttttgagcgcgagcatgaagatcagctttacttgaatctcagcattatcgcccatttgatgaaaagtcactggatgcttcagactcatgaatccaatctgtggttcaatcaccttatctggatctgtatggggaatcgcaaccccaatcgtttgagtcatcagtccggtgggaaagctttcttcacgcttcagtaaggcatccctgtactcgctggttactactcctttggcatacatactgtcagccagccgagtcaaggcgcttacgttgtcagaagcatcttggttaaataaaataacctctttatcaaacaacatgcgtttccctctattcttttaaaagactttcaatagttttcttctctatgcctcgttcacacagccgttctacaaaagaatcatctgccatatgaaccacaaaattacttatcgcttcatcgttgccttttacaatcagaaacgttccggtatccactgaatgattatcaaaccattcaaccggggattccaattggctaacgatgagatagctatcggcaattccaggcattacgacatgcggcattaccaacttttccgcaagccttgtgctcccgatttcttctcgattgcttaatgcatgaatgagcggcgttgaatcatctacgaaatcggggatgatacctgcaacgtgtttaagccattcatcgcggtcaggcacgattacgtttttgtccagaatcagcttagtcttcatcattcaataacctgctcaatcgattcctatcctgttcgttaaacatcgcgcttgaaaggatcaccttagcgtcctttcgcggcacgaccggtactgttgagacaatcacgtcaacgttatcgtacttgtcgggattctcaacatagtcggtctttgaagtaactcctacgatattcagatccggaaatgccttatgaatctttacgtacaggagttttgaagtcccaatcccactggcgcacatgatcagcactcgttttggcaagcttgattcttcaatatatttagcaaagtaaagcgtaaggaatccaatctcatcatcattgatcttccaaggcagctgtaattcgttttctgcctttttggtaattgccgcgaccttcttaaaaagctgaccgtattctagcttgatatcagcaagtaccttgttggcaactacgatatgattgttcagacggttgatcataggccgaatatgactgaccagatcattctgaagcgagataacgcgcgatgaccctggattcaatccaaactgcttgatatagaattcagccagctccatcgattcagatgaagtctttttgtcgtatacgtaattgttgttgtaacgcatcgaaatcagatattccaataaataatagctttcaatggctggtatatcgcagttaagataatcggccacgttcttgatcacgtcattgcttaccttatagaattttggattggcctgaatgatcttctcatatcgcttgtttttgatctgcccgtccttagagtcgatcatctttccttgacgaattctcttcataagaatgtagagatgggaaaagatgtttacgttataaggataggggatcgttgtattaagcaggcgctgaatcaattccaactgtgtggttatgaattgattgtcaaagcgactcagatcatgaaactcactgacgaaatcgttgatgctctcttggttcatggcattgctctgcatcaagactgcgttgatggctcgccggatgttccgctcatcaccaactaccgaaacaaagctgccatcccgctttaagctgagatcatatttttgaagctgcttgctgataatcgtcaaatcttgatgaatcagctcaatgcttacgaagaagtcctcatacatctctgacactcgattggccaaaggcgcgttgaacagcagcttggtaagaatctggttccgtcgctccaatggcgtactgtccagcttgtcgttttcagaaccagtctgcttcgtcaattcgagataccgatcgtaattcaacttcaaccctttgccacgctcggagacaatgattggttcgtcatagtggtcattgatcccattgacggctcgataaatcgtctttgtcgagatgccaatagactttgccaactcatcggctgtgacaaaacgatcgcttttcgacagaatctttattattttgtcacgatttccactcatcttcctccctccttgtctaaactatatcagtcaatgtaagcgctaaaaataaattaatgtccattgttgtggacactcttttaaaaatcgtatcaaagtataaacgattatcaaattgatttcattctccagtagttaaatatgaccactttaatttctatctttacgaacacttattcgcagattataatagaatacaaacagaggttcggggaggacagcaagatggacagttcagaagagccgcggggaattttcctggtcattgacaacaaatcattctatgccacggttgagtgcacgatgcgcgggctagatccgctcaccacgccgctcgtagtcatgtcggaagccgaaaataccaatggcgggctggtgctggcatcatctccaatggccaaaaagctttacggcatctccaacgtcaatcgtcagcgtgatctgccacgcgacaaccatttgatcgtggtgccgccgcggatgaacacgtacatcgaaaagaacattgaggtcaacaacatctatcgcgagttcgtggccgatgaggacctgctgccgtattcgattgacgagtcgattctggacatcacgcattcctggaagctgttcggggatgatccaattgcggtcgttaaaaagatccaaaagaccgttcatgaccgcctgaagctggttaccacggtaggcgtgggtgagaatccgctgcaggccaaaatcgcgttggacgtctatgccaagcatgatccgcgcttcattggcgagattacctatgacacggtcaaagattggaatcgatttctttatggtaaaattaaataaatgaaacaattattaaagattgctccattacgagcagaaatagccgtttttccttgaatttgttgaaaaactatgtgactatggaagcgtattcaaatgtcatgaggaggctactatttatgaatagacaatttgatttcttaatgccaagtgttaacttctttggccctggcgttatcgccaagattggtgaccgtgctaagatgcttaacatgcacaagccactggtcgttacccaagagagcttggaaaagatcgaaaacggccccgttgttcaaacgattgaatcactgaagaaggctggcgtggactacgccatcttcaccggtgttgaacctaacccaaagattcgtaacatcaaggctggtaagaagatgtacgaagaagagaagtgtgactccatcattactgttggtgggggctctgctcacgactgtggtaagggaatcggtattatcctgactaacggtgatgatatcaccaagttggccggaattgaaacgctggacaacccactgccacctctgatggctgttaacaccaccgccgggactggttcagaattgacccggcacgcggttatcacgaacgaagaagaccacctgaagttcgttgttgtttcctggcgtaacattccgttggtatccttcaacgacccaatgctgatgctcggtgtgccaaagtcagttactgctgctaccggttgtgacgcctttgttcaagcaatcgaaccatacgtttctgttgaccacaatccaatcacggacagtcaatgtaaggaagctatccaactgatccaagaagcattgccagaagctgttgccaatggtcaaaatgttgaagcacggaccaagatggttgaagctgaaatgctggccgggatggccttcaacaacgccaacctgggttacgttcatgccatggctcaccaactcggtggtcaatacgatgctccacacggtgtttgctgtgcattgctgctgaccacggttgaagagtacaacctgattgcttgcccagatcggttcgccgaactggcccggatcatgggttacgacaccaccggcctgaccaccatgcaagctgccgagaagtcaatcgacgggatgcgtgagatgtgcaaggcagttggtattccatcatccatcaaggcaatcggtgctaagccagaagacttcccattgatggctgaaaatgccctgaaggatgggaacgcattctccaacccacgtaagggtacgaagcaagacatcattgacctttaccaaaaggcatacgatggtatttactaattaacggtgtggacacatttaattagcaacgaaaaagtcacccgcaggtgaaaacctcatctgcgggtgacttttttagtattgtaagcacaccataatggtacgggttgaaaaatacacgaaaaaatgaggcatctcgcggcttggcgagatgtcccatttcattatcctagtgattttatttgccgcaaatctgctgaacggttggattccatggcaaataagccttcagatccaggttctgagagcgtgtgtaggcttcaaagatcaattccagatatttgaagacatccagattattaagtttggccgtctgaacgatcgtatagaagatcgcattggcttccgcaccggctgtagatttcgcaaacaggctgtttttgcgaatgatggtcgacggtcggatgctctgctcaaccgagttattgcttaacggcagctcgccaatcttaaagatctgatatacacgatccttaagtttcaagacgtttttgactgcgtctttcagcttatgcatcggataagcaatcccttcgataaagcgatagaaggcatccaacagtggcttgaccagttttcgccgctgcgtttttttctcagccggtgttttatacctcaagttattttccctatgaaatactcggctaagcagcttgacggcctgcgttgcctgggcattattctttaacgtgaggcctttgaccaattcaataaatggtcggcgaatatgtatgaggcagctgccaaacgttgctttcggcagttgctcttggccgtagccacgatagccgtcacacataaccgctcccgtataattaggagtcagtatgtcactgatgacttttcctgaacgagtcggcgcatagtgaaagtaggctatctgatgttttgagactgggaaaaaagtctcaaaactaaagaatcgctaggaaccacgttgctgaaaacgttgatttctagcgatttttaatattactattctctaaaattcatctgaaaatatagttttttcccatcctcttattagttaatttgaatggtatcggtcaggaaaaactcgccagttagtcttcatcgctagccttgtcgacggcatcaatcacaccataacggaagccgtgcttttccagggcagccagtccccgaatcgtagtaccagcaggggatgccacttgatcgcgcaaagtagctggcgactggtgcgtttcataggccaaggcaccagagccctttaccatgctggcgatcaggcggtaggcagtttgccgattcaagccatgcttgacggcggcatcactcatggcatccataaagacatcgacgaatgctggaccacagccgccaatcacgcccacgatgtccaactgttcttcaggcaccagaaccacgtcgccaaggtcattcagcagttgaacgatggtatccttaacgggcttatcaaacttaggatccagcgacaaaccaatcgtaccggcatttacggaaactggtgtatttggaatcatcgtggctactggattgttaaccagtgctgcttgcaggtcggcacgcttaataccggctgctgcagaaatgacgatcgtatgcggatccaaggcttgcaactgttcagctacggcaaccgtaacaggggccggtgttgttaggattacaacgtcaggctgcagatcaatcagactctttggatcaaaaaccagcttaaatttatactcgtgcgccaatttttcaacgcggggattttgtggattcatggcaatcagatcgtacttggtcaaattgttcaaaccttgcataatggcgccgcccatgctgccgacgccgacgatagcaactttcatactaatgcttcctttctattctatcgatatcattttaattatatgactattgaatcaaattaacgtaggagccgttgataaagccaagatccttggcctgataccaaacgacaccattattgtcattaagtttgccgatgatgtctaagcgttcgccatcaatgaccttgccgatgctttgtccataaggctgatcgtagacgtccagtttctttccctgtacgtagtcaacaacggccttgagatgattcagcggcaaaattgccagctgagtgccaggttttggtgccagggagtcgtcgttaggcagctccttgaagtccttcatggtattgctgtcgtatttcagccagcgatccgcattcacctcataccagaactcgcctttttgggtggcaatgcgctggaacgtcttgacgaaaattccgccaggcagcggcgtatcgaccggcatgccatcaacgtcgtcaaacagctgcgttggcgttgataattttagatacatagccacggtttgaacctcgccccatgaattgcgacgatagtacaggtgaacgctgtgtggctgcatatcaaagctgccgttcaattgaccatcggctttaatgaatcggtagttgggaaactttaactcgacaatatgaaaaggcgtaccaacaaagccccgcagcagctgcggaacgcgcagattggcaccagtatcgatatcggtatagtagacccagattgggtttccggttttaaatgaatcagccataaaaatcgctccataactctaaacgcttgttaatcacattataacgctttcgaacgctaaaaggtcttgaattatcgagcaaaattactaattcgttcgcgtctaaaattcaaagcatgttataattaactggatatttaggcatagtgcgagaaaggggatatcaatgacaagtgcttcggtgagaacaaaacgcttaacggctcagacactgctgttggcgattttgatactgcaggattttattccagcgctagggaatattccaattggtccattgtcgctgacgacgctgcagattacggtaatgattggcgcggtagtcatggggccaaacacgggaatgcttttgggcggtacctggggtgtgattacttggcttagagctttcttttatcccagcagtccactggcgccgctgatctttaccaatcccatcattgcaatcgttccacggctgttggtcggtttggtggctggctatctgttcttgtggctgcgcaaggtgatgaaacagcgctgggcattgacgatcgtgggggcggccggtgccatgaccaatacgctgctggttttgggcggtatctatctgttcgcgcatacgccagcagttgctaagggctaccataccgatgttgctcatttagggacagtcttggggacggttttggcaacgaatggcctggcagaaatggttttgtcgatgattctggtgccggcaatcgccattccgctgctgcgctatacgcatttcaatgatcaaaaatagacaaaaaggcgcgactgccaggctcataagcttgacagcgcgccttttatattcagactaaacagacttttttgagttactcagcgtcggaatcgtctttggctgcatcggttacgctgggagtctgcgtgttggttggaactggcgtatcagcagccacgacttcgatcttgccgtcgccatcgagcttggcagccagcttgttgacttgatcgtgatccaaaacgtaatcagcgatgcggtcttcaatctgttcttcaatgacccggcgtaatggacgtgcccccatcttaggatcgtagcccagatcaaccagtttttctttaacgtcggttgggacttcgatgtgtaggttcttgtcagccagcatggcattgacgtcatcaagcatcagtgaaacgatcttcatcaaatcaggcttggttaatgggttgaactgaatgatggcatcgaaacggttcaaaaattcaggtttgaagtaatcggtcagcttgtcgataatcgagtgcgttgcgccgcttgcttctgggccaaaaccgatcgaagcctcggagtcgccagtaccggcattggaagtcatgatgatgatggtgtccttaaatgaaaccgtgcgtccctgcgagtcagttaagcggccatcgtccagaatctgcaggaacatgtgcattacgtcagggtgcgctttttcaacctcatccagcagaatcaggctgtaagggtgacgtcgaacctgttccgtcagttgaccagcttcttcgtagccgacatagcctggggcagccccaatcagcttggaagtcgaggtcttatccatgtattcggacatatcgaatcgaatcatggcgtctttggaaccaaacagcagtttagccagctgcttagccatttccgtcttaccaacccccgtcggccccacgaacaggaaactgccgattgggcggccagacttgttaagcccgatccgattacgccgaattgcccgagcaaccttgtcaacggcctcgttttgaccaatcacgtgcttttcgagctgcttgtcgagatcacgcagcttgttttcttcttgtttttgcaggtcgccaaccgggatgtgcgtcttttcttcgacgatcttttccatgtcttgaacggttacagttgcggcttgatcagtatgattttcttcggcatcctgcttagccttggtcagcttggaaacttgatcgcggtagtaggcggccttttcataatcttggctttcaacggcttgctgcttgtgagcctcggccgtgtgaatctgattttcgatcgttgccgggtcggcggtcttcaaggtcaggttcttgcgggatccggcttcgtccagcaggtcaatcgccttgtcgggcaggaatcgatcttgaatgtagcgatccgacagtttagccgcggcttggatggcatcatcggtgtacttgacgtggtggaagtcttcatagcggcccttgataccgtttaaaattttgatcgtttcttcaacggatggctcattgacctcaactggctggaaccgccgagccaacgccgcgtccttttcaatcttgcggtattcgttcatggtcgtggcgccaatcagctgcagatcgccacgggccagggccggctttaagatgttgcctgcgtccatgccgccttcagcattgccggcacccatgatttcgtgaatctcatcaataaacaggatgatgttcttattcttctgaacttccttcattaactgctgcatccgctgttcgaactgaccacgaatgccagttccttgaaccagggaaacaacgtctaagcggatgatttctttagaagcaatcttttccggaacctgaccagaaacgattgcctgagcaagaccttcaacgactgcagttttaccaaccccggcttcaccgatcaaaactgggttgttcttagtccgccgattaagaatctcgattacacgcgcgatctcatcgtcacgaccgattacgggatcgatcttgccttggcgggccaggtcggtcatgttgacgccgtattgccccaacagacctttgttacgcttgccgccgccattgctgttggattgagcattaaagttggcgctgccttggttgttggcgtcttggccctgcatgttgttcatggcattcataaaatcttcgagactgccgaagccaaagttgttgttcattccattacccccattcatcaggttcatttgtgcctgctgcatgttttggtagcagttttggcacaggtcaatctgcatgcgttgaccgttaaaattcatttgtaggtgaatcgttgcgggattttgatggcatacttgacaaagcatttatttttaccccctcagaagtcaaaaatatatttgaccttttttgaccataatgcaattatacttacttttagtaatatatcaagcagtttattcgataaaagtcaaattaatcaatacttgatacaatgcgctttatcaacaaaggtcaaaaagcagataaaatttctacctttgattttagcactggttgaattagaatgctaaaaaccccgccattttaaaaaatcagttataatataaataggtgaagagcaatcaagaaaagaggtggggaattcgtggctgccaaagattaccgtcaactgcttgaagatctgcgcgccggtaagattgaggaatttgtcgtgacgcccgcagaatttatggacttccaaccgatttatcatgattatgagtatcgaacccagattgaagggaaagccgaacggggcggagaattgcactatcatttgataaaacgagattaaatccgcattttggcgtcatttgccaagaaatcgtcttgtatttaccgcttacaattgctacaatggtgatattgaaagcgttggttgccaattgccaatgcccaacaaagccttaaggagaatgattacaatggaaaaacgcgattttacgattactgctgaaactggtatccatgctcgtccagctacgattctggtacaaactgcatccaagtacacttctgacgtatctctgtcatacaacggcaagagcgttaacttgaagtccatcatgggtgttatgagcctgggtgttggtcaaaacgctaacgttacgattactgcagaaggcgatgacgaaaaggaagctatcgaagccatcgctgaaacgatgaagaaagaaggcttggcggactaatatgtcaagacagctcaatggcatcgcggctggtggtgggattgccatcgcgccggcctatttgctgggagttcctgacctatccgttaagcagcaacataccgataatgtgaatcatgaagtcgcccggcttcatgattcttttgctattacggccaatgagctgcgggagatttgtcagcgagcccatgctcaactcaacaaacaggcggcggtgatcgtcgatatgcagctgcagctggtgctggctgatgattttcaacagaccattgagcaccagatcgttgccaataaatatacggcgggctatgcggtcaaaaaagaaaccgatcgctggctagccgaaaatgcatcttctgaacagggcctgcatcaaagaagaattgccatgcaggacctttttaagcgtttaatgagtcatatcttggggatcgagctgccggatccaagccggctcaaacatcaggcgattatcgtcgctcacagcctgacgccgaccgatattgcccgctttgaccggcgctatgtcgtagggatcgtctctgatctaggcggcagcacctcgcatttttccatcatgaccaaagaaaaggcgattccaggcgtggttggtaccaaaacggcgacccgtgagattctggatggcacctcgctgatcgttgacggtattcatggccgcgttttgctgagtccaacgccggctgagatcgatgaatacgagaaaaaagctggcgactatgcgcgggaaatggagtcgctcggtgttttgaagcatcagcgaaccgtcagtgccgatggtcgtcatttcgagatcggtgccaatctgtttatgcccgatgagatagaaagtgccaaaaacagtggcgcggaaggaattggcctgatgcgcagcgaggctttgtttatgggacgcgatacgctgccaagcgaagaagagcagtttttggcctataaaaaaatcgtcgccgatatgacgccagaacgcgtgattatccgcacgctggatattggcggcgacaaaccaatcgcagccatccagacgccgacagaagacaatccatttttggggatgcgttcattgcgtttttcactggcgcacccagaaattatgcgaccgcagatgcgagccctgcttagagcatcggtttatggccgcttggcagtcatgtttccgatggtcagcacgctggatgagtttttggcggcacgcaaggtattagaagaagaacgtcaaaagctgcaggcgaaaggaatcggctgcgcgaatcagattgaggtcggcatgatggttgaagtcccagccgccgtggaaatggctgatcaactggcacagtatgccgactttttcagtattggctccaatgatctgacgcagtatatgttcgcggccgatcgcggcaacagccaagtcgcgcatctttaccaaacgctgcacccagccgtcttaagagccattaagcatacggttgacgcggcgcatgcagaaggcaaatgggtcggcatctgtggtgagatggccaataactcgctggccacgccgcttcttttaggaatgggtatcgatgagttttcgatgaacagtaccagtattttgccgattcgctcgctgattggcgaactgcacgtgcggcagctgcagccattggttcaccaggctatgaatgctcgtaatgccaaagaagtgcgacagatgatcattggtcgcgttccggccttaaaaaacttcaatttctaaaatttaatcaaggtcgcttcaaatggcttgaagcgacttttttgtagggttaaaatcagttatctgatgatgaatcggttaaaatgaaaattgctgaatctgaatcgtaattaaccgttcgccgttgttggcgattgaaaattaaaggggatcgcattgtgaatattgggttgtttacagatacttattttccacaagtcagtggcgttgcgacgtcgatcaagactttgcgtgatgaattgactgaacaggggcatcacgtttacatcttcactacgaccgatccagccgctaagcatgatgagccggaaaatggcatctatcgctttcccagcgttccgtttgtatcgtttaccgatcggcgcattgccttgcgtggctgggtaagggctttgagactggcccgtaagctgcagctggatatcgttcataaccagaccgagttttccttaggggtaatgggcaagatggtggccaaggagatgaacattccgtgcctgcatacgtaccatacaatgtatcaggactatctgcactatattgccaatggtcatatcatcaagccgcatgatgttgccagattagcgcatctgtacctaaaaaacatgacggggatcattgcgcctagtgaacgagtattagatacgctgcaggcatatgacgtgaccgcaccaatcagaattattccaaccggagttaatctgcgcgtgtactcaaagccagacacgcctgcacaaaaacataagctgcggcaaaaactgggttatgaagatactgtgccggtattgctgtcgcttagtcgcctggcttatgaaaaaaacattcaggccctgattgaagcgctgccggatattttgcagcatcgtcctgacgtgcagcttttgatcgttggtgatggtccagccagagaaaccttggagcggcaagttgttaagatggggcttagcgatcacgttcagtttaccggtgagattaaaaatgaggacgttcatcacttttatcaaatggccgatgtctttgtctcagcatcggactcggaatcacaggggctgacctatgatgaggcattggcatccaacttgccgattgtcgtgatgcgcagtgaatataccgacgagctgattgatgatccagctattggaatgagttttcaaaagcgcggcgatctggtcaagggcgttttgtactaccttgatcatcctgacacgcaggaaacgattaccaagcgtcagcaaaagcttcatgatatttcctcagaagtctttggtcagcgcgtgatggacttttatctggaatgtcagaagcgcctgcaagatgagcaggacgaaaagaaacgacagcatcatctttttggtaaacgaggttgagcatgttaaaaataactatgtattcttcagcggataaagtagctggtcaaggggtgggcagcgcttatctggagctgatgcatctgttgaaaacgaattttaaaggtgagtttgatatcgcggttaatcagtaccgaaccagtgatatcagccactatcacacgattgacctgccattttggttttccactttttcaaagaaacgcgggcgcaaaatcggctacgtgcactttttgccagagactttggaaggcagcctcaagattccgcagccttttcgcggaattttttatcgctatgtgattgctttttataaacgcatggatcatttggtagtggtcaacccgtcgtttatcgataaacttgttgcctatgggattccacggagcaagattacctatattcctaactttgtcgatgatgccaagtttcatcccgttgacgaacttgaaaaaagaaggctgaaaactaaatgggggatcgctcagcaacggtttgtcgtggtgggcagtggtcagattcaagagcgcaagggcgtttttgattttatccaattagccgagcagaatcctgacgttcagtttatctgggcgggcggtttttcatttgggcggattacggatggctacgcggcgcttaaaaagatcgttgacaatccgccggcaaaccttaaatttccaggaatcgtcagtcgccaagagattgctgagctggataacattgccgatctgtttttactgccgtcttataacgagctgtttccgatgtcggttttagaggcttttagctgtggaacaccggtcatgctgcgtgatctggatctttatcattcaattattcaaggatattacgagccagccaaagatgttgatgaaatgcagcaaaagcttgattggctgcagaagacaccggctcgtttggctgagcttaaaatggcggcgcataccgcatcgcgtcaatattccaagtcacaccttgccaaagtctggcatcaattctatctggagcaggcaaaggagggctaggtaaatgtcgcgaaaaaattgggttatttttgttttgatgctggcatgcggaatcggcatttttgcttattcgctgcgtgacataaagctgtcttcgattatcgtggatttggtgcatttaaactggggctggtttggggcagccttgttgtgcatctgcctgtatttgtttttggaagccgtggtcgttaagatttttatgaatgatcgtcatgacggctttacctggaaggatgcaatccggattccgttggttgagcaattggggaatggtctaacgcctttttcaactggcgggcagccggcacagctgttggcaatgatgcaggcgggcgttgatgctggtcaggccagttcggtgctgttgatgaagtttgtcgtttttcagtcgatgatcgtgatcaacttcatcatcagtcttttggttggtttccactatattgctgctaaaatgcacgttttgtcgctgctggttctctttggctttttggttcatcttagcgtcatcatcggcttgctgttggtgatgtattggtacaatttcaccaaaaaagcggctaacatcgtgattcgccctgctcattggtttatgaagcctgataagtacgaaaaaatgcaggcaacgctgaatgaaaaaatcgataccttctatcaagaaagcctaaagatcaaaagcgaatacggcaaaatggctaaagtcagtttaattaccctgctgcagctgggattttattatctgattccttatttcatcatgctgtcgctgggcatcgatggcttgaacgtgctgatggtagtcagtctaaacgttttgatctttatggtaatctcgctatttccgattcctggtgggacagggggagcagaatacagcttttcggtgctgttctcaagctttattgcctcaggaagcaaattggtgttggcgatgctgctctggcggattctgacctactactttgggatgtttgccgggatgtttgccttaatgatcaagccagatcgagtgcatgaacctgattaataacgatataatagatatagtgcagaacctggtcgtttggattgggttcttttattttagtagttagtgaggctagatcatgattcattcagaactgcagcggattttgcgtcgtttggatgcaatggcagaggatacgcatggcgatctccagcagcgtactttttctgcttatggcattcaagtctgtacggtaacgtatcaacaaagtaccggtgagtttactttagagcagtttcagccggctgctcagctgacgtttgacagcttggatctaacggcaatcgaagtctatcgctgtttgtatgagtttaagaattctttttgagcgccactcgaatgttaaaaggtagtttagtttataaccatcgagtttcttgttcggttaaaactgttatagttgagtttgttcgtccttttgaaattagcagaaaaacttttaaaatatagttgacgattagccacaatctcggtatagtagttatcgttgtcaatgaggcagacgctgatgacagacgaatttgcttctaacagttattaacgactttaaaaatgttgttgacaactatatgacttcatgatatattattctagtcgcttgtttaaaacgtttgaaaaaagaattaaaaagttcttgacaaataactaacaagtgttaaaataataagcgttgtaactgatcaattaaatcggttgcatggtagacctttgaaaactgaatacagtttcgacgaacacaaatgtgcagggtcatcaatcattacgattgatgcaaaaacatttgcgaagtcaattcgcttaatttaaatttgagcttttcaagt
